United States Patent 10,233,495 (METHODS AND COMPOSITIONS FOR SCREENING AND TREATING DEVELOPMENTAL DISORDERS) - sequence listing, part 206

SEQ ID NO: 1649 - DNA, 573441 bp, Homo sapiens
ttctttttctttttctttttttttttttttttttttttactaaaacagaaagactttcaggaaaatgtcatttaatgatttcagctatacattacatatacaactctgtagcctagcaacaatcattgctacaccatcattaactttaaatattttgcttggtgagctattctcaaatgtagcacattttaagattttgccatcattatgactgtggaatcattgtttggttttcataggaaacagatctgtcacagtatgaagctttgtttattttaagaaactggtacacaattacatttccacttacaagagaacgccacagatataactaaaggcaggcttcgatggctccacaaaggttgcgtgctggaccaaccccacacctcctgcttccccgtcgcaccgccctggccaggttcacatggtttcatttccagagatgctttgctcttcgcagttaggtagttttaattccttcaaaggcacacagcttccatcttttttccagcgtggctcccacacccgtgaattcctgtttgaacatgcgtggcagcctcatcaaaagcatttctatttcatttgcagatatctgttagaaaggaaggaaagtcactttggggaaaggaactcatcttaaaggaggaatggattggggaaggatgagctttcccagtgatatgaacagcatttagttttctactgggctgtcagggggatgtccttatagaaggaacattcagaagtactgaatgtgattatcccacctcccgagcagctggcggggtggggcgtgggttggctgggcggaaagtgccaagttcacccttcatatggatggctaccttactggcagcaccattcctgaacagccctcccctgatataaaaggagatggggagggaatttaagagggctcccagcaaatccatcaccactcctggaaagctactagtggcttcatcctcatctatgaaggacagcaattttctttaatgctgccaggagcagaagacattcgggtggatttcttgccacccaaatttctttctcttccttaattttcacatagaccagagaccataaagcttttggaatggaatctaaactccaaaacctacaacaatacaagtcttgatatctagtcataaaattcaggtatattttttaatgcaacttttttcttctccatatttttatttgatgaatttttacaccaataattcattttaaagaacaaatcagccataatccctctgctctagcacagtgattgcttttgttgtcctgtgttagcatgccaatccatgtgtatgcatgtggattttatacagcagggcggccaatttggggtctgatattctgtttgaatatccccaaaatttggggtctgatactctgtttgaatcctgtatcttcattctcacaagttaaatgacccttacagagataattagtctctttaagcctcagcaaatggaaataacatttaataaggatagcatgaaaattactggcttaccacagatatgggcacatagaaatgttcattgaatcagagctattacactttttcatggtgtaatcactgtagagatatcattttagagtctacactttccatttaacaatattaggattcatttaaaagagacaccaaatagaccaagaagtcaaatcaactgtttatttaatattctcatggaaaagacttcatatgacacattcaatattcctgggcctataatacaaaactttagttaaatagaggcagttctgaaaattgaaatacattgtattctaaaatttttgggaattgttttgaaatctgaatgcattttctgatacacaccatattagatggatggttaaattcccaggtcaaccgacaaaagcctatgagacagattatgtgaaggttcataataactttgagaagtaagttttctttcagtcaccaccagtgttctcatttcattctcacagcactctggtgagattcgtgagcagatattaagatgcatctccattttatagttcagaaaacggtgtgagctacagagggttaagtgttttatcaaagacacaacttgggaaagaacccaagggttctttcatgggttggggcctgggccttgattggtgtgccttaagcacttcccatgattgtcaacagccaggggtgaacaaccaggggtgctgggaggtctttctcagtagcggtcacctggaggcacttgttaaaaaaatcagatcccccagccagcctcttctctggagatccggattcagctggtcttgggtgtagcccacataatctatttttaacaaccatcccagatcattcttatagtcaggcatatttgggttaagaatggggacttaggccgggcgttgtagctcatgcctgtaatcccagcatttggggaggccgaggtgggtggatcatgaggtcaggagatcgaggccatcttggctaacatggtaaaaccctgtctctactaaaaatacaaaaaattagccgggtgtggtggcgcgtgcctgtaatcccagctactcaggaggccaagaggcagaagaatcgcttgaacctgggaggcggaggttgcagtaagccgagatggcaccaccgcactccatcctgggggacagagagagactccgtctcaaaaaaaaatggggacttaagccagacaagcttggattttactctggctaggcctcaagctgtgtgactttgggaagattacttaacatttgtaattctcagtttcttcaggtgtgtaatagaagtcatatctctcagggtattgtaaggattatatgtaaaatgtaacacagtgcctggcacaagttctctctccttatgtagacatgtatatgtgtgtgtgtatggaatattgatagaaaatgacactattatctaaccttttgtagtacggagtggtatgtggtcaaaactagtttttcataggtccaggaggcagctttttttaagcctcatgagaccaagttatcttctcaaagagttcccttctttcttttggaggaggacagcacagatcatctatggtgggctctagtctccagtcaaattcaagtgccacccctggcatgtccttccccagatcaaggagaggccatagcggaacacacaggccgaggtgcctgccagcccaccagcaccttgtttacagtgtaaccgccacctcccttggaaatgtagggaagaaggtttgtgccattcattagggaggggataaaaagctaagtttttgagggtaaaataaatatctgatttaaatataacgtgtaggaggccagctggggtcagaaggggcagtgccacccagcagccctgcagctggctgtaaaaagtgtgacaacttacaatcaccaggaaacttttccttgccaaactcttctgaaaacactatttaattctcaccacactctcataagatagggaataatttaccaataagaaaactgaggccctgagagactcagtaaatcccacagggtaacacaggcagtaagtgtggaccagacctcctggctgtggtgccttgttcttaaccacccctgcccacctccaccagggagaggaccatggagtaaggacaggaaataatcctcttggtcactgcctctctggccctgggtgggtgtggatgccatggcaggcatctgtgtacaggagggcagggctcctctgtgatgaatactattagagtgatagcaacatcaacagcaaaaaactgaaaattcccaactcacctggctcacacacgttcatattgctgatgctcgggcacccccacattaaccatccatcaaaacggtaagcaaatcatgggaagtcttggctagcatgtactgaaatgtggcaacatcttgttttccatggtgtcttttgacctgagcctagactttaaccacaaaggaagcaggacaaggcttgcagcgggacagaggtagctaccatttaccgagtcttcactgtggggcagggaagagtaaattcttcaccagcattatctcatcagaaagctcattaaacaagcaagtgcccccctcacttgctggagtaaagaaaaggagacacaaaagatttggatcacagtgatagaacaatcagtaacctcttccagtttagtagttaagtaaccagtcacttaacttctttgggcctgtcttctcatttccaagacaagggaattggaaagaaacacagggaatgccctgaggacttggtttgtgtgctggcctctccatatcctagctctagccttaggacaagccattcaaaatttatctgtcaattaggttgtggcaaagatcttaaaatgagaggatgtgataggtcttttgcgcaccttaaagcacaaaacaaatgacggtccccactttagtagcacttattgtgtgccaggtactgttctggaatgcttttcatctactaagtcatttaatatcaaggataaccccccaaaaaccactttacagatggtggaacttaggcacagagatgttaaataagctgtccaaggtcaaacagctaagaagtgatgaaactgggatttgaaatcctcgtaattacttaatacatacttcagattttgagaaagccagaaattagtgtaatgggaattaatctcaaatgtattagctgtagtttctgttggtagtgtaagatataacagctgggttctgccacaaagatgcaaataatacagagttgtgtcataattatggaacagaccacttcaaataaaaatctatctaaaatatccatttaataaggctctcagcagctgggcatggtggctcacacttataatcccagcactttgggaggctaaggtgagaggatcacttgagcccaggagtttgagaccagcctgggcaacatagagagacccaatctctacaaaacatacaaaaattagccgatatggtggcatgtccctgtggtcccagctactcaggagactgaggcaagaggattccttgagcacaggggttggagcctgcagtgagctgtgattgctccactgcactccagcttgggtgacagagtgagaccctgacacaagaaaaaaagggatctcagctaattctagaagaattccttaaagttgtttaaagatatttatatctcatgacagaagaaagatcagggagaaagctgtatcaggtaagttagttttatgattttcaaacttttcccctaccctgacaaaataacctttatgatattttatcttttgggatttttaagacaaattcaagagaaaattcaatttgtcctttgttttctccctatggccaaagaatttttactttataaatacttccacttacttcagttctgttctcttcctaataatttgtcagctattatcatcttgccatcacaatatcctttgccttcccaccagtacattctttgtctagagaattgagactctggagtcattacttaaaccaagcacccagacctcactggctgagctctgagtgaagtttacccctttcctcatctcctgcacgattttcttccctgaatcacttctgagaccagggattctctctaagctcctacttctgttcacacatggagccctgggttcctgggaagagctgttgcttgcccagcaggtaagtgaaggggtagaacttggagcaaggattatgaatccagcccggctttcagagtgacgcattccctcactcccaagcatattatgaggagatgattgcaatacacgtggttaagggagcactgtgtagcactgtgatatagattagagatagatgccatgactatgaaatcttttccccatacaccatgtatttggtgctctagcaagtggagaggatagtcataaccctgaagttttgattaccctcttacccaggtggcttttgttccaagaaatttgtggcctatatattttcaatctttgatattgtcagtggattcttctacctgttttgtttgaaactttcttaaatttattcttttaggaaggatttatttgctacaaatacaaaaaagaaagaaagcaaacatcagaaggaaacaggctgtgtgtaactaaggagcttgtgtgctgttgataccgcagaggtcatttataaaatctgcttgatttattttttaatttgctcactctaggccaagcctactgcctccttgcccggcctctaatcacatgtacaaatggacacaagcagatgcaaatcaatttgttctcatcatggttggctccataccccgtatcatcaggcaagggaagcctggtgaagaggggctcctgtttgggctactgaaaagacgccggcagaggccggagcgtcagggaagccagttgaaaaccagacttccttccatgggcaaaactgacttctagcctttaaatgcacatttaaatcttgttcattcttcacatcctgggcagggcacagtgttagcacacacagacacctcacaacaaatgttcacagagagaaatacaaaatgtagatggggcaaagggaggggaggaaggaagggagaaagaaggaaaagaggaaagaagacaagaagtcaggaattcgaaggagtgaagcaagaaactggtagaggaagggaaggaggcagaaaaaatgtgatgaaagaaggtaaacaggagagaattaaaaggagaaaagaatatggaaggaaaatgagggcaggaaggagagaagaaagggtgggtagaaagaggagaaaggaaagaaatgtggcaatgttggctaaagcatcccagagggaagccaccagaagaagcatggactcgagggtaccttgctgttaatcatgactcacagatttcacccttctctaactcctagttcagagagtatcttccctacccaatttagcacttcattagttcatgtctgagtctcaaatcatttcataactaggctacaagcttgttgagaatagggttctatcttaggtttcttttgtgccttggtcatctcctgttcttctctggtccctaagacagtgctgggtacatgaaaagcagtgaattatcccagcattcattaggtccctggtaaccttaccaacttctctcactgtggtgcacagccttttttttgttctttatgtagtcaagtggggagtattgttatctctgctgtcatatgctttccagaagtgctgtaatatctaaaaaacccattcattatagtctgtctaaaggatcactcattgatattactgtgacaggctgctcttaaggagaaccccagaatatgcatactattaaggatcattcaggtgggcaatctcataaacactactgagagcatttccccaccctcatcacctggttatagtctgggaaagaatgctatccaattaattaaacaggatctgaatctcctttccatagccaagacatttaaattttgtgtttgcagaggtatgctattagtacagaagtgcgaatgattctcccctctgtgggaaatgtaacacatgcccatgacctctcaagctggtcacagtggtgtcgtgccaaaatagcaggtccttctatatcctccagcctctgtggccacattacgctgagtctggttttcagaaccaaatcttccacaccatgggccttgggaagaggctgcaggtgtgtagagggggcaaccagacacgcttggaaaactgagccttcatctcctaaaggatatataaacagggaagagcagacgaaccctcctcttgactgtaagaagtattcatctgctaatgctcaagtcaaatgtttcttctgggctgcttcggagagacaagaggttgggcttgatgggccctggggctgacatgggagattctatgtactgatagaaaccattttcatcatagtgctgcctattttaaagagtttgcctgctgtgctctgggcatgatttttgactcagcaaagcttcagaagccatggctgcccccaacccggaccctgttttcctctgaatgaatcttcctttttcaagtgtttctgatacaagagaaccgggtgaatgagagtgggtaatttagaaaaggccaagaagagaaaaatatgcaaatatgcaaatatcaacagcaggaataatatttaactggaaaatagcttattattgggctacatggttttaggaagccatgtgcaatgtacatgcccggcataatttaaattaattccttccattcctagtcattcttacacccatatgtagcctttggggaaatcctgaccacaacagtgacattacaggactgggtggagcctgctttccctgttctcatcagtacagggtgggcactggattttgctctctggattaaaaagtctaaatatcctctcagcctcactggaatagaaagcatgtggtctgatccctggtgcccagcagttttagagtactttttcaatatactttctaccccaggcatgagaaggaacctgacagctctgtgggcgtttcattcagaagatggagagctatctgggagtaggcaggggacacctcgtgtgtttcctctgtgagggaaatactttcttcatcactctaaaataaaagtaccagtctgcgatgagatacaattcctttgactgaatcccatccagaaaggcccatcatctaatggccagggacaaggcatgtgaattctctctcctcagagactggtaagggaacgtcacaaatcttacctgagccctgaggataagaatagaacaagagcttctacccgccaccccctccccgccagccaaaacaaatcaattcattacttatcaatccctgcccattcccaggagatgattttacacacacacacacacacacacacgcaggcacacacacttcactggtgatcatcatagattctcagcctgcgatgatggagtggaggaaacaaagtgtcctgaaattctttgataaacgacaagtggattgttggccattttagctcctactaaaacaacagctgcttctcaacaaaggcttctcacttgggacttgcagaaagggagaacagaaatgtcaacagtacaagggaaggatggtagcaacaataggaatcatttcttgaggggttattctttgccaaacacattggtgcaagcagtgttttgtttaatcctccaggcaaaggtggtggtgatattaaggaacaataataccagtaaaggggaaacaacagcagagaaatccttcaaatctatatgacaacaaaggaacattgtgcagcaagtccttcttatttcatctgagtttaacatgaatgctttctctttcttacctgtgcatgtgaggggaaaccacaatgaaaaaaatagatgattctgaacctctagaattttaaaattctctaactcctttcaccctgttttgttctaccctgtcatgaaaggcatgaaatctgtatgactgaaaagattcctctcaaaggggaagtgttagatccatttaagaggttaaacagttttgggatcatgtattgggaagattatttgaatcaaaataagaacacatgatagtcatttgatgcatgctagccattgaaaatttagcatgatttagctgtgtctgttcagggacacagcactgcagtctgctggtctggtcgtaccaatcccatgcgttttgctgtgctctatggaggaccttcttacttatttccattttccttcatgaccagaaatttgacaggcaactcgctggcttctctagcttctctgttttgcttctgtgtccaccccgctcctgggcttccctagtgttggttaatgatgttgttttattttgtcagggccccttccattgttcacatgaatttgacacataaatcacattctttttgtctcttctctatgggtacacaaatactgcggtggggtaggagtacagctaatttgtggatgggaaaaaccgagcttcagggaggtgaggaatgatgtctggctctggatgtgagcctggaggggcacagctgagaagaattttgcagccacttttttctacttagagaacaacgctggaaaacagccattaatacagctttcttgagtcatatcagatctttatattatttgggatgatttttcctcaattgtgtgaagtccagaacatggaatcctataagaatatggtctgaggataatgccctattagccacactcacctgatttcacccttattttgggaactttcaggtgaacctatatttttaaatctctcataagctttccaaattaacttggcatctgctaaaagtcattgtcattttagataactgctcttctttttacaaagacaaaagcaagcaaaaagaggagaacaagctgccaaaaactgaggtccttgcaaaagagaagggctgatcaacccccataggctgctacagccctagttcagttcatgcagagtccacctgcaggcagcaatcaacatgctaaatttgagcaacgaaagttcactcgagcaaaataatttaccttggagtccagctgctgcatgtatgaccaaagatattctatgttggctccaaaaggatggacgtgaagaaacgttgatatgatacctgaattaaaaaggcaaacattggaaattattcaaaggcatatgagagtctctggttaaataatgctgtctaatcccagtgactattttgtcaggctgagttatggtcttgccatttctagcagcactcaacaagcattcaataatagcacattctgaaggcagtaagagtaacatggcaaacagaacactttatctcctggaatgatagtagttagcaaagctagactctgagataatatacagctgaataaagatatttcaaaacaaagactcctggaagcatttcaactaccaattttatgcttgatttaccaatataaaattatagttattggaaggataaaattatcttttctttccctcagtggactttgcagtatgaaaatggctcatacaactgtgtcagaaatcacactgcctcagattttcctgataattacaattgctagatatgaaaagtatttaatctatatttcccccaactgccattgaaggaagcccaaattcttcctgaaacatttgctgttctctctggttgtcgctcttgtttaaaaggagccagctcattctccccttcttgctgctgtaatttacaagatcattttaaaaggtctgggaatggatggtttggctgcagtttgattataaattataaggctcttccatcgtgcaaatcagctgtcaacattgtactgacaaatgaaaagctggacgttgaagtcaggaatgaagtaaaaagcattaccttcctcttctccctgctcctggatccaaaatcaaaatagtgaacatgaggaagtcaactccaaaaactgtagactgctttttgttaagaagttgtgcacttgttattcacgatagcaaaaacatggaatcagctcaggtgcccatcagtggtggattgcataaagaaaacgtggtatgaaccatggaatactatgtagccataaaaaagaaggaaatgatgccctttgcagcaacattgatgcacctggaggccattatcctaagtgaactaatgcagaaataaaaccaaatattgcatgttcttataagtgggagcttaacagtgggtactcatggacataagaaggagaacagtagacactggggactgctagaggcgggagagagggatgagggaaagggctgagaatctccctattagggattatgcccattaccagggggatgggttcagtcataccccaaacctcagagtcatgcaataggcctctgtaacaatcctgcacgtgtacccctggattctaaaataaacgttgaaaaagaaacaaaagaaaagttgtcctcagactgatagttttagctttctgttaaaaaagtttcaagatgaattaaatctgagggtaagccttcatgttctgttttttgtgagccttcatgcttgggagccagggaagaccctcacctgtatgaaatgccatctgggtgggcacaggtgcacacagcattcttgtactaggtcatcctataggtgaccttggattgatctgccatagggtttcatggctccctgatgctatgggatgagtgtcaagtttttaaagaaaagttcccagttcatcctcaggctgagaacagaaaaccaaagggactctccaagacctatcctcagaatgttgctttcccagggcttctagaggatgacagtgagatggggaggtagaaacaattcccacatttccctgtaaaggtagaatctcagtttttaaagactgacctgttcttcctgagatacaaagaactaccacttcattctgaggttatattcttccttttttcttgtcaaaatgtccttttttgaaataatggcaatggtagaaggcaatgatgatactttaaaaatatctttaagtggaaaaatagccacttttaatgtactcagggagcattgtgttgtcccctccccttatttatttacttatattttaattttagagacctgacagctacttccctgtaactgaaattctcaattctggtgaagtggcattctaagtaattctattactaataagagttaaaatataaaagctcaggagtgatttctttaaaaaaattagaatatagtagaactatttaaaaatgattattttcatttgcatttccttttttgttttacaaagttttaaattgatatataatatttgtacatattttttgggtacctggcatattttgatacctgtatacaatgtgtaatgataagaatcagggtaatttgcatggccatcacctcagacgtttatcatttctttgtgttgagaacatcccaaatcttttcttctagctattctgaagtatacagtaaattactgttaactataatttccctactgtactatcaaatactggaacttagtccttctatttgttgaatgagagagtaagggctgaatcacagttcgtgtagagggaatcccctgtttcacgatggtgagtggggctttcactgaccatcccaggtactatggccactgctttccacagagagcctcccacaagtgatgggcaggagaaggacaggggagggagaaggaagagtcagctttggctttgtgagcaggtgagggggtgctcctagtcggaagctttttttctcctcctcccctgcagggttctcccagggaggtgagggctgctgcaaggtggggagcagcattcctcgggtggacatctgcttacgcagcagggctgagacagggagtggcagcagcactgcagactttggggtgacaagggtgtataagtctcccatggagaaagagggcataagacttgagcagtcttaagtaaactaccccaggcaaataaataacaatatttttcatatttaatattccccctggccagagagccttcaacatctcctgcataacctacagccttttgtaaatgtccataggtgtatggttatcaacataaatgtctttaataggatgaatagaacaagtcagaggaggatggggtgggttgggggagaggttgataacccttagcctaggagacgaagtgttgacatgggtcatttagggacaccagaaatgggaggacctagagtgcctctgtgaagttggcaccctctgtgaacatggatttgctcctccactgtctactacctttcaaccctaatcctgggtctgcaccccaaggagctgtgctcttagtctttgtgtgttctggttccatatccagaacatagtacacattcataagaggtatatgttgaacgtatttatttgccagaactggaaatctccagtatacttgtttaaaaattctattagtctattattgataaatgggaataaataagaaccttaaacatttctacaagtagtaacagatctttcaaaaaccaggtaactttgagatattattcactgaaaattcttactcttaacccgtcctgtcatggatttagaaggatggagtaacttggatgttttgagcaaggaaaattttcattgaaactattttgctcataactaaggggaaaatcagattctaaaatcagattagaagtcctgacgtggacttgagtgttcttttaggagggtattcagaaccatctctgtggtagctgatattaagaagccattagcttttccttataagagttcagcaattgccactagatatatgtagggccaaggcaggcagtcacaaataggcttcccaagcttttcctgtggatgacaacccaattatccagtgttgctagagacacagccgaaaggaaagcatgagtcatcatcctccccggtaccttgcctctcctcagcccacctcccactcctgcatctgtccatccctgtagcaccacagaagcatcagtcatgccacttgagaaaatgtttctaggccctgtgattttggatcaggttcatttgagggaatctttctaaataaacaagtaaagcctctttgcagcttttttttttttttttttttttttttaaaggaactgggacattccctggggatggaaaaaggatggctgtaactcaaaagttaatgaaaaatgccacaaacctggaatatggagactattttatggtcctctggaatagacctaaaggcttggtaaaatgaacactaggaatggagggtggtggatttagctgttactgaactggtggatctccaaggggatggctcaacaattggacttgcttgtttccatggagatgtagaaggcctccatattggagaatgggtttccaaaagtggaaaaaaaattttaagtgcctaatttaaaaaaattttaaaagaacaaaggaggttcagtaccattgggctttttgcacatctcagaatcttaaaaactactttagaaagagtaactagctctagaggcctgtgccaaacctcgttaggaaggtccatttaaattggctacccaaaagcactctgagcttctcccatcaaaaccatctagtttatttacattattgggtctcactaagactaaggatgcagtatttaaattaaccaaatagtgccagatttgtactgcttcatcacttattttaatacttgaaacacttagcagccaggaggtggcaaggtgctagaggcacagcattgtataagataggcaaggggctggtcctgtggaacttttattccaggtgagcaacacagataataaacacaaagatgaaaaataaaaatttttagatagtgcttagcacaatgaagaaaacacatcagggaagaggacagaagagacagcaacctgcagtttgctggaacgctaccttacacaaagcgattgatgtggtttggctatgtccccccaacaaatctcattgaattatagctcccataattcccacatgttgtgggagggacccagtgggagataactgaatcataggggcagtttccccatactgttctcatgctagtgaataagtctcgtgagatctgatggttttataaggggaaacttctttcacttggttcttctctcttgtttgctgccatgtaagacatgccttttgccttccaccttctgccatgattgtgaggcctccccagccctgtggaactgtaagtccattaaacctctttttctttataaaacacccagttttggatatgtctttatcagcagcatgggaatggactaatacagcgattacgtgaagccctctccctgagaaagcagaccttctcaagtgtgagatgagaaggagtcagccatggaaagcccgggggagaccattccaggtacaggccacatacagtgcaaaggccctgaggtggaagtgagctggcagaacacactgggctggagagtggcacatgtgtttagaggtaggtgggggccagatcacgcaggaccttgtgtgccaggggaaagagtttggattagatttaaattctaaatgtggcaggaaaccaaaagagtggttctaagcaggtgcttgacatgatctgaattatgttttaaaaacttccctcaagctgctgtatggagggtagagcagagggggaactgggaggccagttggaagtgtttgcatgagactggagtggtgagtcatgatctggactgcaaagggagaagcggactccaaagggagagccagggggctggtgtgagcagtgaggctggggaagaatgaaagatgagtaaacagtttttcacttgagcaactgggtgggactattttctcagatgagaatattggggaaggagcacattagggcaggaaaaaggggaatcgggagttctgttttgtcctcattaaatttgagatgtgcattagcatctaagtgaagaatattaaatggcagctggagatggtatacatttgcaatggcaacaaaaagggatttgaagccaaagtattcattgagattacctaggtagagaagaggcctcaagactgaaggctggagaagcccaaaatttagaggtaagctgaggaaaactcatcagaggactctgagagggtttaatcaataagaaagtgtggcatcatgatggcggagagaagtatttccagatgtgagtagtcaaccacgtaaagtagctgccaggtagagggagttgagaaattggtgacataaaattctctggtgatgtggaaaagaatggttttggtgtgaggatgcaagtcagactggaggaggctggagagagaggggaggagggaatggtgactgtgagcatagtgcgttggaggaatcctgctttggacaggggcaggaaatggactgttgctggaaaggggtcatggtgtcaagacagattttccttctcgtttgttgcaaaggtacaagatagtagagttcatgtttatatattgatgcacatgatgctccacttacatacaagatcactaaggggtaatgcagctttcataatagtcctcatacattacagagaattgagttgaaaaggaccatctaatcaaacttcctaattttatgcagtatgagggcttacacacttaccacagtggtttggataagtgatttgccttagattacccggtggatgaaatgcctcaatccacaaatatttaggaccactccccctcccccaccgctcagggctgcttagagatcattaggtattatggtttctcctttgcatccttatacaaaagatgggagtgggatgggttagccctgttatagtttaattatattggttacccgatgagaataaactatcactttgtgcattcagtttggtcagcacattattctctttgagtggaatgagaaatggaatattgccagaatatactccccactacccccaggctgcttggagttttcattccaaactctctgtgtcaggttctaaagttctggctgagatttgctttctctacacctacactggttgatagtctcctaggaagcttcaaaagaccctggggcccatcagctcactgggatagaggagcaccttggggctttccagagaccttggctctgcagatgaacagctgtgtctctagacacagtcacatcttgctgggaattaccagaggcctgaccataaaccagcctgaaatagtcttgtttcatgttgacacccatataaatggtccacggatgttggagaatcagcaggaaaaaaagccatgcaaaatctgggtctcctagtaagccctgaggggacagttgtctgtgggcagctgcagagtgatgaagcgtatatgggaagtggagagaaactgtaggaaaccgatcaaacacttgtggtttgggctgatgcttctcagtgccttgggattccaaaaagctttaattttccaaaaaagtttattccgcttacttggtgagtacaaaacctaatcttgtatggttggttagttagttttgtgttgtaatatttgtctgtcttattttttcgattaaacccctcagactgtatttgaacctcttagtagtaaattgttcctggtacctgaaatgcccttaacaacttctttatccatccagtgaaaacctcttcatcctttaggactagctcagctgtcctttcttctgacaaggcatctgtagcataagtagctccttctctgtgtctctgattttactacgaaccacagttcattgtaattaactgcattctttctcattatctatgaacttcttgaggggagatcatctttccaccatcagttaatgcatgggatagcataaatcaggccagcgtttctcaaaacatagtaccagatatgcctgctttagcatcctctcagatattagtattgcaatgaacaggatcactttcttttttttcttttttgacagggtctcactctatcacccaggcagttgtgcagtggtgctgctcacagctcactgcagcctgatgctcgtgggctcaagagatccttccacctcagccccccaagtagttgggactacaggtgcatgccaccatgcccagctaacttttttttttttttttttttgtagagatgggagtctcactatattgcctaggctggtcttgaactcctgagctcaagtgatcctcctgccttggcctcccaaggtgctaggattataggcgtgagccaccacacctgtgtgtggggctaaagattctgccttataaataggctgcctagataattcttttccacaatgaagacggattattcttatcgtaggctcttgataaatgtttgttgatttattgatatggacatttgtgccttggaaacaagatttaggtcaatgactcattctttatggtcagtagttttcagagaggaacatactcccaagattacttttctcaggtacagcctaaatatagcctcaactttattcactgaaatcaccaaaaattattgcttaaccttctttaaaaatatttttccatattctactcagctgtttctttatacccacattaggaggagccttctgcttctggtatagtctggttttgtgcacgtgtgagatggtgactgtgatggaaatgatgtgtatgtcctgatctgcagaggactcaggatatgtaagaaagtttgcccaatcattgtcaacctgaggacagttctcaggggaccagggaggttttagagaaaagctgctttgttacagttaaaagttgtggagaagtttttgactacatctggatagtatttacaatgactagcatcaacagggcgtcaatcagagctgctgggattgaaatctattgtgttggaattattataaaaagcaagagaatatagagtgatacggacccagagagttatactctcagctctctgcagaactattagcttgtcaataaaaaaaatttgatccatttttcctttataacaatatccagccaaacacagctcccaaactttggccccaaatcaaaagtaatgactcattctatcccaaacaacttcagtgtatgccaatccaacatgcaggccatatgtgaaataaactagttctggcatagacattgagcaatgtcaagctgaccttatgtgtggttactatagcattatgaaacaaaatgctaccctgcaatgcccccataaaaacagaattctctaaggtccaattatatgtcaacctgtctccacaaaaattgattacaaaatgaataacccagaaatcacaaaaataaagtattttccaggggcctgtcttctttagttgaattggaagacccattaattgtcaagaagaaagtccatcagaatggtcgaactctaataatactcaggatccagatctgcaaaattccaaattatgtcaatgaaatcccacggatcctctctaataaatatcaactttatgccttgaaataaagactctagttttatacaatagtcataagaatgtctgggcagaatacacccttttgcccagataaatcagtgtcacaaataattatatgtaactagaattgctcattgtttaggaagttctagcctcagttttattctttctgtagatggaatccatttgaagagcttttttctcactccctttctcttccagggaatgctttctgccagtgtgcgtttcttatataacatttatgtgccccaagagggcactgatcatctgactatattggcatacagcatacactataagcatgcagatatgatgaagattttgccaattaatgtttccaagttgtgggagattttctgctgtgtccttggccttctaggctggcctagagcatgacttttgtgtcctctctactgacttaattattccaagggaagatttcagggggaattgcaaagagtatttatgactgctccagatgtaccagaaggccagagggctcctagaatcattcagtgcatgagaattcttcagaaaagtgtagccccagcaccaggaaatcctttttctctattctgatccagagcagttttgtccctaccacagtctgtatctagattccagaagcttcaggggagctctttatggacgcaagattcaggtatctacaaagtatgaatgaccaaactcaatgagtagataggatcatttagtggcaggcagaaactgcagcttttggcaggatccattttgctggtcttggaaactctttcccattgtggcattcttttggaggattatcctcttttggaggattatacaaaagagtagaagtatatagatgttttggaagtgggtttggcaaggaaatcacatctgttgccaaactgtcattaagaataataaaataaaatattgagaaaggtagcaaggtaatggataactgaagggaaagttaaactcctaagtttattttaatcacttaagtctctggcctcccttctacctaaatgttctcatatattgattcaaaataagtgtcaccccctgtttctcttttgctctactcctaacttcaaatgctaatattagtaaactagttcaaaagaccaacagtgaggggaaaagtcttggaaaatttagaattggttgtatatgctttttattggagatcctgactaatatttttctttctaacacacttgatttaactaattttatatagttttttgtgataccaaagacatcagcaggcatagcatgttataaatgtaatcttcctacctactcccattaatgtactgcatataaagcacatcatttaaaaatatttgaagtagccaactgaaaaaagtacatgtatgtgtatacatatataaataaaacctaataactacttagaaaacattttaaatgaactgtgttctccaattaaaacataaaagaagcagctatctctagtgaaaggaaggaaataaaaaaatagagactggttcccatttttttaaccttcaagtggacagaattcttcctacttaaagagggaaaagtttactgcagatcattaattgctttgttcataccctaaaagcattatagggaaaaatcacaccttggtcacactgagtgacagagaaacagttgtcagacttggacatgttttccaatagaagaaaaatccagttaccaactacatatgggttcgttttgggttcctggaactgatagcacatcagcatgtcttctgagactcatgcatggcatgttattacagctgtatatcatcagagcaaaaaaaaaataattggttttcctgggagtatctctaagttgatgtcatattcaataaccctgtagttgaaaaatctatatatgatggatggactctggactgtcttttgaatttaattcctcatgtgccagcttctctaggtcctgttgtacctgtcatttttaggtgagcacatgcagtatttacaaaatgcacccagggaccaggcgcggtggctcatgcctgtaatcccagcactttgagaggccaaggcaggtggatcacctgaggtcaggagtttgagaccagcctggccaacatggcaaaaccccatctctactaaaaatacaaaattagctgggcgtggtggtgtgcacctgtaatcccagccactagagaggctgaggcaggagaatcacttgaacccggcagaaggaggttgcagtgagccgagattgtgccattgcactccagcctgggcaacagagtgagaccctgtctcaaaaaaaaaaaaaaaaaaatgcaaccaggcactatttctgccagataatgaactgctgaagaacagtttgtcttgcatgtacattggcctcattcttcagtcttaaccatgccaccatggagccagtctcacctggcaaccccacactggggtcagtgccaaggtgcagcttgaatcagttctgtgcatcacagcatgagggtggtggcttcccttcctctgaatttgagggcttcaaagacagccttaaacatacaggcatctaagatgggcttccatgcacactgccggcacatcctcatcaagaattcttcctcgtgaaaataagtaagacatctggatccactgaggatgcttcttttgttcatcctggacaaaaggatccatacttggacagggaagcctgaagccgattgtcctggattagcctagcatcagtaccctgcatggccctatttgtcagcattgcaggtctagccttgggagtgactttaggatgtggcctctgctaaggggcttagagtttaatctcagggttcaaagctgctcttgagcctggggatatggcttggtttggaactagatgcaacctggcctccagttggaagtgacatgcccaagctttgaaattcagatttgtaacatgtgagatgcaacttagcgtattcttgaactcagtttcatgtctgacaatcagttaatatatacagttacagaaaggcaaaacccccattagtttgtatgccactaatttgaaatgtatgtaatataatcttgatgaaattaatctcaccttttaccagaaggcaatgctgtttaaattaataagttaataactaaaatattaagttaattacctaataattatttaagagaacagatgaagaaaacagaatttccttacctattagcagagcttctttctctgattttaagccttggcttcttttctcaatattgttctctcggtcttggttgactaatgcaactgtcaacacattgatttcctataaagttaaaagccaaaaaccatatatgggtttatgtagattctgtgcatgtcaataaaaaacaccagatctcttaaactctataaataaggtcatcacttctatttataactaaagatcaaatcttttatacaattgatctatttgcccaagagtagaaaagtaattatgtaaagttaggctcctaggtactgctccccgcataccaagtaattctctgcacaagtggcaaatttggcacaagttatcttagatttttgtccatgttttcattaaactctgttcattaaaactgtgtttgattatagctactttaacatgttttatttcaaagatgaataatctttgggaaagcatacaggaaactgatttataataccatgctaaaaatttctgagtgtgtggagaaatagggcctattggggagctaagatagaattgttagaagtgtttttaaattgagtaggtatggatcctcatgaataaatgcaagaggcagataaagcaaagcttggtaaattcttttttttgaaaactaaaaatgaagagttgtacaacaagccaataacacgtgaaacattgaggctggactatttttagttctttctgtagtcttttacatttaaaaacagagatgaagatttaactcatatcatcctagacttttgatattaggactcaaaatggagagtgatttaatggaaagtcaaattaatgatctgcatagatgacctgcatatatgggatagtagaatcattagggaagttgagtcttactggaggaaagttgctcactgaaagatggctccaaagaaggactagtatatgagcagtggtggggaacctgcagggatgatagagaacaggtacggagagccgaatggacgaagaattcagaaggtttgaacaaatgtgttgacaggtgtccctagaactggaagtggttataggagagatatttagatagttagtacaaagtaacaaaactggtcagatccaagagtacaggaagtattgggagcatgccgagcctgcaaaaagtgaaaaccacacccgaaggcattcaaagaaaaataaacccagcacatgccatcaaaacagatctttgagcttaatttaacttatgagctaccactttgtaatccaggggtaattagaaattgccatgaaagaaggctctactgagaaattgcagttggtaatatctgataagcattttagaggctccacttaaggtcccacttatttgctgaagaccaagtgatgaagactgaatgagaaatgaaaatggataaggtaaagaattgagaaaatcacagtgatgtgatgatatatcacagggaagaacttggttggctagagggtataacaggcctcaggctgatggtaggaaaatcccaataaggacaggagtcagaaagagtttggggagtggtctaagctaagtctggagccagctgtacatcaaaggttactagagatgaaagatgctcttacaaatcaaaaacaggatcttgggagcaagcctcaatggaaacacaatgaagaattttaaaatagaacaaatccaaaggcttattatgtagatgggattagaacatttataaagaggaattgcaggaaaggaaatagaaattcctgctatgataaaataacatttggtactttccgattaggctgattaggcactttctccattggaacagagcaggtctgtgtgtacacatcatctttctagggtagtggggtcaatgggcctgctgaattctgttagttgtatgccctaaggacaaataggtcccacagggacatggcagatggacttccaggcctgggaggttaagattgttgagcagacgcaagctgaagctttgtaaggtctcccaagagaggtgtaggaagaaagtggatggaagaacattaactaggataatgattgcatcattaaaaaaatacaaaaaatgaaccctggagctgagtggaaataatatctccaagagagggtgatctgttcacagcctggatgataattggggccaaatgaaattattcagaatgagtttagcagataacaggcccacattaattgccaagactgagtggtgtcctggggccatcacacagttgaagatccaggttcattgagggaaatggactgtagagggcaggcagatgtcaggagccagcagagaaaggcaagggtggaacagacagaccacctgagaatgctgttttctccccaggtccaaaagtggagtcacatagaaagggggactctgagcaaggttcaaagaaatactgctgcatcaacaatgtctacaaggagccagataagacccagtgactcttgctttggtgatgttttagggttgaaaaaattagtatggagagataagagtcttagggtcaccattctgtggaagtatttcttgagattggatactggagtgtgtgctctgctgaccacaaatggtgtgttctcatgcagtcatggccagtgactggagtggacacatctctctgcatggctcccacaacagtccagcaggccttggcttgatggacacctaaggcttggcagacatctcagcttttggggacatctgtgagttttgtccaggttggagatggagctgtttttctgactcctctaggaggcagaagaactatgctggaagtggtacagtatcattgaagctgatcaggcaggctccaaggaatgcttgcttgcatcttataataaactggcctcaagaatctccaaaagggaaaacatcatttccattagagtcaagggtgtgtccaagcatattaaatagtctatagcatagcattgagtgaagtggaccaacttgtgaccactcaaaagagtcactactgactaagctccagatgctaagcctgccttgggcatggtataagctcaggctcttgctgacaaagtcacagagctaattagatgggtgaatgcttatgtcatccattttgccaaagagaacagttaaagttaatatagctgtgtttcaagggatagaagacaggatagtgattttagacagccacattatatgttgtagttttaccttttccaattattagaaaaggagagttttgttttaatgactcactaatcatgggttccttagaaaaataaggttaatttgatttgtctgtatttatattggtattgttcagttgaacaagataaggacaattatcgataatctccaagtatggggtagtctacaaagtagatataagcaacaactgtaccctctctctttgtttttatttaatgtctagaaatctaagttatcacatttgtcaaaagagctccatcatcatgattggttaaggcgaagggaatacacagagagaatgtggaattaattaattcccaaaccaattccctgttgcacttaagctaagcctgtttttactttcagccaccaaataaatatttctgctacatatatacatcacatgcctactatatgccaagaagttctaagtttttaaggatatggcattcaaactgatcagaagtgcaagcttacccagggaccagcaagcaattcttataaaaggtctaaaagaaagaaatatgagaagatgaagctggagaagtaggtagatcatggtaagaagtgtagattttatctgggaggcttaacaagtgaagagttttcagttctgcattttaggacattggtttggaggcaaatgaaactggagtcagcctactgcaaaaatgtatccatttttgccttttgatgatgacagtcaaaacccatgcagagtgcaaacagcatttaagaggtggaactaaaaaaaaaaatctggtgacctggtggctgatgaaaatattgagaacaagtaggtggctcagtgaataggcaaatggagaaagaagctagtctgggagaagattgtgtgttcagttttggaaatgttcaacttaaggtttctatagcatcttgtcaaaatattttggaggaagtaggattagccaggaagtaggatgtgcacgtttctgaacttagaagcaaggctctgacagctctttttatggggcctttctctggttttgtttgcagcaggaaatcttgatgttttcttgtgggacaaagagcaggcttgcttacacttgatataaaaaaggtagattcctaagctcagtgtttctatcttgtaacacaaaccactgcatgtgctggcatccttctggacccctctacggagatactgaggttataagatccatgagagtagactggtgaagccaaaattcttctgggaacagtctctcagtgggatttcatattctctacacaggacattccaacttatctttttagtaattggggaacacataaggacattgaatcataaattacacatggttttgctcctttcttaaaaagttcatggtccttattactctctccaccccaaatctctagagaatggaaaggaccttatcagaatgggaaagttttatcattagaaacataaagttatgaagaccctttatccttttatcaccttaaaatcctttagcctgatagatgcaacatgcccagaagaatgatgagtctaccagatattccagaaaagaggttccagatgcctagcaattacaaagtagaagtgagtgagtggggatggagtgggaggtgaggaaggttactatgtatgaattgttagtggtatacaaagtacacagcgggacgggaacattaggatggagatcaagagtttcctctcagtgagatctattggattatgaagtagtctcccaaaggaagtgggaagaacacagtaaaagcacaccagactagaaaatgcactgcagctaacaattctgcacttgacatgagattggagattacctaataaatcttttctcagcctaccttttaactctaatttctgtgatacgtagaaggaatcattaaagggctggagaagaggttttcagtaactggaaactagatgtcacagactttttaaaagacttcttaaagagttagctacttgaaggcagaaatttcccttctaagagtcctcatcacttactttgagaaatgatcaaagtaatttatcatttagaggagctctttttcaatagcttattgagctagaatcatgctttgttattttgtttttgtttctctccacctacccaagcccctaaggaccaagaaaatggcttccctgccttataaaatccttctgctactgctttcacttaattattcctgtggcttccttacctttagggctgttttctttctgttgcaaagcttcttgaatacatgttgtccacctgtgtctactgcctcatcatctgaaatctcagctttttcatcagtcactccaacaaatctactctgagatatttccagtgaccctcttcttgccaaatgattattttcccagtcctcttaccatgtgatatttgacacccttgacattggcccctcttaaaccatctgcctcacatctgctacacaggaggtcctggtctttttcctcttaatttcctgtttagtcttcactggcttttttgtttcctctgctggcccagtgaatgtaaagaagaggctactctcttcctcctcttctctagctttggcccttgccaaagtgtgctccccaatttttcttacctgttccctttctttcattctcgtgggttcagctatgatcaatcttaattctttaagcttctgttctttaccaccaactgaccactgggcttgtctgcctgaatttaccaatgcccagttcaaattcagaatgagaggtggccatgaggcagtggaagagacactaaatacttgggtttcagccttggctcttcctccagcagccaggtgaccttggcaaattactcaacatcttcaagacccagatcacttgtctaaaaatgaggggctgggtagggccaatcatctttgaatagtacttgatggaacctcattagctttatagaggtgacatggatggtccaaggggacacatctctggaattctactctttcactcctttcttttgcttaatgatacagggctcctatgtaaagcttcatttaaagaaatgtccttaggccgggtgcagtggctcaagcctgtaatcccagcactttgggagactgaggcaggtggatcacttgaagtcaggaggtcaagaccagcctggccaacatggcgaaaccctgtctctactgaccatacaaaaattagccgagcgtggtagtgcatgtctgtagtcccagctacttgggaggctgagacaggagaattgcttgaacccggaaggtggaggttgcagtgagctgagtttgcaccactgcactccagcctgggcaacagagtgagactctgtctcaaaaaaaaaaaaaaaaaaaaaaaatctgagtccaggtccttcctaatgtaattttctaaaattctataattttatgactaaaacccagttcatctcactcgtcaaactgcatcctcttctaacttttctgtttttattaaagtcagcatcattcttccacttgctggcgctcaaaccctcattttgtctttgattcattctctactatcccctaagtgcttttaagatgtctctaaatccaaattctctcaagtgtctgtgagatgtctctcctgctgcattcccatttccactagtgctctactctcggttctacgtgtttcatactttgttttagggatgcggtctcactatgttgagcaggctggtcttgaactcctggcctgaagcgatcctcttgcctcagcttcccaaagcactgggattacaggcatgagccactgcacctggcagatttcacaccttgaccattttaaccgctgcaggaacctcctactttgtctctgcctctaggctcttcctcttccagtctatcttacataataccaccaggtcaattttctaatatgtgacttttatctcatctatctctggttaaaacttcagatgctttctgataacctacaggaaaaagtcagatgctgctgcttggcattttgggcttactcctatcaaactagcatatcttctttctatgctatgtccagaaatgctcttggaaagctctctcctccttgccttgccacttcctacttacattttacacacagcacaagtcctgtatctcccagaggcatctgtttcaggccacttgcaaggcttccttatctgcacacatttcctacgccacttatatggcagttcatcacttatacatcacatttcacctatttgtttcctccacaaaaccactgccttctttagacagtaatcacatctaagcaagtgaggcagaatggccgaatggaagctgtgttctaaatctgtcacattatttacatactagataactttaggcagggcatttctctaagccttaactttctttaatgaaaaacatggataataccatgtgcctcttccccatggttgctgtgaggaccaaatataagtgagacagcgctttcaaaaactataaatttctaggaatagattgtggcatgattattacaaccattactcacttttatgattcacaggattgattggatatggaacaagtgttaatatatacttggggtactgaatccatgcaacaattctgtataagactttgactacaattatataaaaatatttatgcaaaaataactgtggttgtattcaaaaatagtggatattttctattttctctatttttctgtcagtgttgttgttattatccttataagtaaagaaagaaaaagaaaccaatgatatacagttgttgttttgaagagctataggtaaggacagccagttgctgaatacttaattaagtaacatactgagtgacatcacccacaccctaaatagagaaaccaccgccatgtgacttcccctatgaccctccaagggctggcggcctccatagctgctagtgcaagatgagtgggacagtcgacaagatctatgtggtaaagattctccatgtcaccccggactctgccagcagcataccacaaggctcgttttccttccctgcctgcttgttccatggccttcttgtgctgttggctcagttctgctaattgctcataggccctactcttaaacatcacacttcatgaaatcgggggccctatagataattgtcaagatgtgtatcagctacattcttatcctttactcacattttgcaaagtttcaaaagcaatccatcaaatgatgtgccagttgccaataaccttcaaattattccttatatgattagaactgtggttgggggaggatggagaatggagatatcccttcacactttcctttatgggcacatagcaggtgcccagtggctgataaatgaaagaatgagcctcaaacaatggcctggaatattgaaaacatgatgatttggacatagaagacactggttctatttgccgctggcctgctgtgtttctttgtttcatttttgctgtttgtacaaagacaggattgaagtggatgacctccacagtgtcttcctgctccctgattccatgcctgctctgtgcccttttccctgacttggaccttcccttcagattcaggtagccagcttggtacagaccatataaacttatcctttatttctgatgccagtaagaattagagaggaaagaggaagcagagtgagaaaaacaataaaaaaccaaatggatgaggaaaggattgatgagcatgagtgactaagctttagaattttttatggtttcttatgggaacataagaatgcatccatcccccaatagtgagcaggatcgcaggaatttcctgtggggcagcaatcccaaggccttgctgatctaatcagttgtgaaatcttggcactgcccatcccgagggtcgtgggctctcaccacctctgccctttcccagcagcctttgatggtcaaggtctgtataaggggagcctcagaggcccaatagttttcagcatcagagagataatctgaaagcagatgtgtggggctccaagatgcagtgattcatcatgatgtgaccatattttacattctgagatgttccaccttattggggttcaattgccggatcggaagcacatacattatgtctttagacaactccaagaaccgtgttttctaagatttccaattgcaaagattaaaataggcgagaactagttacggctcacacgaaggaccctttaaagaaagataaaaactcagtgtagtttactgccagagatatccagatacagcatttatcctggtggccttctttctaggtcatctttggttatatttatttaacaaacatctgtacagtacttactatatgcaggaagtgttataagcacttgacaaatataaactcaattgtcataagtgctcttcgaagtcaggctattacattcttaatttacaggttaagaaaatgaagaataatgaggctaatgacttgcccaaggtcacaaaactagtaagaagcagactcaggatctgaaccaatgctgtcttgctccagagtcctaaccactacactaggttgccggttgcgtggatattgagtgcctgtggcgctctgtgaccaaatccctcctgagggctgcctatagtcctagctcactcaggagccagccaggctccaggcaggcctggtgagctgtggttcttgcataaacatgaaaggaaaggggagcagggaggaagccacccacgggctggctgaggagcagcattagcagggactgagggggctggctggctgctgctgtttgcgggtgacggacttctttagtgtgacttttaaccacagtctgcaacagggagggatttcaaaggcagagtgctggggccaatgaagaagaagaggtgggacacatgctctcttgatttgaaggatgtgggtaggggaaggccaaggtcagaggagcactccaaaagactgtggttgggccacatgcaggattggctgggcaggtggagaggctcaggcaaggaggccccaggtgcttctccagccacaccccaaggatgtggcaataaggtggaaccacagaggtgacaggaagagaaagaaaaggtggatagagaagccattcggaaggaatggaaagaagccattctgaaggaagaatggaaagattctatgtgtgaagcagagaggggcgagctaaaatcatttaaacaagtcaggtctacacagctagcagaatattgataccagaatcagagatcacgaagaattagaagtattgcctctaggctgggtgcggtggcttgcacctgtaatcccagcactttgggaggccaaggcaagtggatcacttgatgtcaggagaccagcctgaccaatacgttgaaaccccgtctctactaaaaatataaaaattagccaggcatggcagcatgcgcctgtaatcccagctacttgggaagctgaggcagaactgattgaacccaggaggtggaggttgcagtgagccgagatcacaccactgcactccaacctgggcaacagagtgagactccatctcaaaaaataaataaatacataaataaaaaagtattgtctctaatattttaaaatattggagctgaggtcttagaaaggcagctggaaatagggaagatgagggtgatgagctctcaccacctgtgccctttcccagcagccttccatggtcaaggtctgcacaatggaagcgtcaggagatttttcatggtagtacttcaggctgtgaagggcgtggacttgagtagctatagcagtgtgagttacattttctacatactgaagagaaacagctatttttgagatcaagtgtattttttcatttggttatatctaccgtggcattcaggctgggaatacccctttccagcctcttgcacggtcccagtgcacctgttgtccccacagaagtagcaacagtgctgcctttcaccctcaaagacatctgtttgaattttatgtgatgactgtacctataatctctacagagcaacagtgtcctcagtacctggcacagtgctctgtacacagatgcaacatatatatatatatatatatatatatatatatatatatatatatatatatatatattttttttttttttttttttgagacggagtctcgctctgtcgcccaggctggagtgcagtggcgggatctcggctcactgcaagctccgcctcccgggttcacgccattctcctgcctcagcctcccaagtacctgggactacaggcgcccgccactacgcctgtctaattttttgtatttttagtagagacggggtttcaccgtgttagccgggatggtctcgatctcctgacctcgtgatccgcccgcctcggcctcccaaagtgctgggattacaggcgtgagccaccgcgcccggccgcaacttatatttttaaaagaaaaaatataaatagtagaccctctaatattacatcaaatgaatttgttactacatagacaggccagacctcatgggtgaaaatgactggccatcataagggtttggtcagtaccctgggcctggagtcagctagaagtctatgaggaatatatatgtatggtggatagtgaaaaaaactatgcaatcgctttggacattttacagccttttggtccctaaatacatttattgtagtatcattttaaaataacacaatttctttaatctcgtaggctgaaggaggtaaggaagttaatttttcatttgtatctattatcaatgctttcaatgttttaagtattaacttttaatttttttggagaccaaaccataagcttataaccttttttcctttcttttccaaaatatataaccttttctctttcttttccaaaatataagacatattttctagttgactttcttagtaataacctttgttttctcattacaaataaaaatatgtattcactgtagaaaatatacaaagtaaagattaaaaattaactgaaattctactaccaagatataaatgctattaacattcagatatttgccttttatagtttatatataaccccctcccacatacatataacatatatatgtgtttgcatatacacatacatgtatatattgttgtttaactcttatttgaaaaataggattatgatacatatatagcccccaagtagaatattctacataaagaacagagactttgataggaaaggatcatttcaatttcttaatgtttcccattaaatactaagaggatcactgctgcctggatcataacttaataatgactatcacagttcacaccatgcttaaattgtggtctcaagctggcaatgaaatgactttcttttggtctagttttgtgacagccatgttaaacaaaaatgatctaaaaatgagaaaaaaaaaattcctttgtatccagtaaccccattcattatttaaactgttgtagtattttatttttagttttactatatgccactgtagacataaccaaatgaaaaaatacacttgatctcaaaaatagctgtgtgtttctcttcagtatgtagaaaatgtaacccacactgctatagctactcaagtccacgcccttcacagtctgaaaaagtactaacatgaaaaatctcctcaaccaataaaactagagcagcaaacagaagacattcaagtgaaatactttttaaaaatgtatgtatgtgcatccagaattagtcggtttgatttatcttgtatgatactaactctattgctggtaaagattaattttattatggtgctcctggcatgttattttctcagttcatttctcagtatgacatttcttatttttctctgctacaaagcacccactatcataattttcacctgctgagtttatgttactgatgataatattaaaatttagagggttttttgacctttctagtggtaaattaggtcataaaaatagatgggacacaatctgataaatgagaaagagaaagatttgattattattaaagtaaaatcaaattttacaaggttttcctggcatactgtgagatcttagtaaacattgaatatcttccttctctcacacccccaaattgaattctctctattcaccgctgccttgcatatgccacacatgagaactattccaagaaccaagcgttcctgattgcttctgcatggtgcactggagatcttctgattataaaccaaataatacaaataatagtggtgataataatactaacagcttttattgagtgcttggtagatggcaggtgctggtctcttactatctccattttatagattaaacactgaggcacaagtatgcctcgctgtttaatctgtaaaatggagataataatagtaagtagcttccttaagttcacacacctggaagttagtggcatcatgactgggccccaggcagtgataccccagggcctttagtccatgctgccttctgtctgaatgatctctccggaaactatagcttctccacttggttcaagcccttgatcccaccccaagtctgttccttactgagaagcctgcagtcagtcttgagtgagttcccttttcagttgtgtgccctctcttcattgggcatgtgctcctggaggacagtgactgctctgtgatccaatgtgctcccaacaggcggcattgtgcctgtcatgtggacttggatggaccttgttaggagcggctagttatgggtccactgactttttttgcatattatccaaatcaatgtgatttcttaagaaccagagtctcacaattactaatgatgtattttcttttgggggctgaatggcagcaaaattcaacatttggattaaatgaagtatctgtacacctcagttcagtataatttgattgaatttattgagcctcctcctcttttcatttattgagtacctacaataagggtacattttgtgttaagacaacaagattcaaagatgaataatagtggttcctgctatcaaagaatgtaggagtctatagggcagccagctatgtaaaatgtattaaaatacagtatgatataagccatataaaatatattaaatacagtatgatataagccatgacaaaggaagagccagggtgctggggaagcccagagtggcacctagcctgtcctggggtggagagtttgtggaaaagtatggtccacagactggtaacactggcattatctgggagcttactagaaatgcaaattctcaggccccagcttggacctgcccagtggaaaactctagggtagggcccagcaatctgtgttttaaaaagctatctttgattcgattgcttattaaagttcgagaagcatagcctcagagaacataagactcacaggcacaacaattagacaagaaaacatatatctaattaaaacctgtaaaataagaaagttggatgatgtgatctctaccacctcagttttaactgtcagtccacgagacttttatacacatcttaaagttaactggagtgatgtgtgtttatcttcaagatcacctgcagataatatgcagaaggaagatttgtacttctcacctaaccactccaaacagattcatgagctgactgaggctgctgcacttccatcaatgcaatcatcaatcgatgagtgttactaatgtatctacctgcataggctcattactgtgttaggttctgcaaggaatacatacaaattctccactttaaggaacatgatctgagttggggagataagcctgtcagaagtgggttgttcaagatggttggaatgatgataaattgtaggaatctagagaagatggtgattgatttggactgatcttagggtaaggacctaagaaatgggaattgaggtaggcttaaaaacaggcagaatttgcattgcagacaaaaagggcgataagatagatggagaagctgagttatcaatacaaaatctaattacttagaatttttaatgaatggtgcaccaagctgaatttgacctgctgactcaagccatttattcaggaaatcaggccaacattttttctgaataccaggctgatggttattccattttcaccaaggggactagtttgaatactgtcatataaaatggtcaggaatgatatatatgcttacagctgtgagacttatatgttatgcatatatgtgtgtgtgattgtgcgtgtgtgtagtgaggggacagagaattatactgacacaggtactggggcttgatatagattgtagttgtatactgttcccatagtttcaagtcatcttcctaaaagttggcatggaaagaaattgcctttgcaaattagattctgcaagtctcaaacataagtagctcaccagcgtacactgaacagtctggaaattgtccagacagagaaagccactctgtaatctcacagagaggctgatagaacaatagaaacgacgtgttactgagcatcacggccacaagtctcccctgcaaggacagtttcaagctgggaaagctgagactttgaggtttttcttggaaaaaaaaattaatagatttctgctctattaagtgttccaagcctggcggaatgtcttcaggggaacctagagttttcagagaatggcctccatatacctggcaaggtgctgctgcccagagagggtgacagggaaagacttccctggctctgatgtctgcacagcttagaaatgcactctttctttttattttcttcttcaggaaactcttgctgtctttcgataaaaacataatttaaaactgtaacaaaacatgtgaatgtcttttcctttgggcaacagctttccttccaaattcaacttttgctctgcctgaattaggaacacgtggaggagataaacattgaggtgcagtttgctgaatttctgacttttgtgagaccctaggttagatttaaagccaccagtgtggggttcatagtcttggaggtttgatttaaatgcccagttatagctggctacaaacaggatgtcaggtccccctgggcatggtggcaggtcagtaaggagggaaggtgtagctgcatttggtggccatgaactcacaactggggatagttctcactgttaggccccagcaagggaaggggggatctccatcagagctgggaagagttttgaggttggaaggattaagacacactccagtttgttgtgggaaatttaaacatatttattgccaagtccaatctttgtttcccccaggaagaccaccaaacatgttacttgtagactgacatttgagcttttttgcttccaattcaagagccttattttaggataagcatttcattaagtgtggatatttgtgcaactgcaaacatacctttgatgcaagcagatttcacagctagagttggcaggagagctgcatgatggtgaaaactgctgctctgccgcctgccagggtcaatttagaagggctgacacgcagggcaccacgacacttaggcagctcttcctgttccagtctttcccgcctttcttcccttttttcttcattctatctttgtacctacttttttccttgtcattttcctacatatttcctcaaagaaatgccacatcccagtgagctatgtgtcaatgagatggatgaggttggagatgagcagtgtgtgaagaaatagagaatgactgccctttgcagcactgcagaaccatcctgggagagctggagagtaccaggcaaggaatccttgccaaagaccaatgtcaaagatggagtcagaccagcactggctggtgcatttcacaactctccccttcctggtctcacgtgtggttagcagaaatgaagtggtgcgaaaatcactatggaatatttaataatctaaatcataaaaacaaatgtctaggaagccctatggctcctgagtagcatacagaactaagaggaaggggagttcacctgctggtgcatccttgctcctggctgcttttataccactaatcctggtgccttgtcccctcccctgctgccttcatgaggcactagggtaatctgcttctgtccaccttttgggctcccgactctttccatagatgctactgaatgttcctcctgttccttgttgctcagggtatcaggcagtgctaagccatacctcttgtgaggcaggaataccgtaattgagccctctaggtttatttgactttaaaatgatattgcttgcatgcaagtcatgtctgtatgtttgtatatgcatcccttgttgatggtttggagcttacctggaacttcttggccataagtagaaataaatgcttaattttggggttgggttagaactcattttgttaaactttaaattaatcactcttcttaatctcacatattttctcgagaggatggacaagtctcatttgggtacggatggccattaaccttggtctggggtccatacagagcataggctctagaatccctaggccacaaagaaggttcggacatagagttcacagcacacgacctcaaataatatatctaagtattgttctcctaaattatttatgtagtatataaaatttgcctttctcttcaaaatgcaaatattattgaggctatttcctctcctgttgaggaactcagtctcttctctatgtggtaatatctagccattattatgggctgtttatttcattatttaccaagtaggggcttagctttaattaaaaaaaaatcagtgaatcttcctctgttcctaaattccaatcaagtacaaaagcttccctatttataaattgctttaaatgatagctgaattaaccaatacattgtcaatatccactgcttattatccatgagaacaaaaataagattttaaagtcccacagcagggactgattaaagaaattagagtacatctgtggcatgaaatattaggcagtcattaaaaatcacaaaacaactgataccacagaaaacacaaatgatccttagagtctatcatgaataactatatactaacaaatcggaacacctagaagaaatgcatacattcctggacacatataatctaccaagattgaaccatggagacatagaaaatctgaacataccagtaacaagtaatgagattgaagcagtaataaaaagtctcttacaaagaaaagttcagaacctgatggtttcactgctgaattctaccacatattaaaaaagaagaacaaatagtaatccaattgaaactattaaaaaaaccacaggccaatattcatgataaacatagatgcaaaaaatcctcaacaaaataccagcaaacctaattcagcaacaaattaaaaagaccattcaccatgaccaagtgggattcatcccagagattcaaggatggtttaacatatgcaaataataaagtggtacatcacattaacagaaccaagaatggaaaccatatgatgatttcatagatggtgaaaaagcatttgggaaaattcaacatctcttcatgataaaaactctcaacagaccaggtatagaaggaacatacatcaaaataataatgaccatatatgacaaacacagttaacatcatacaagatagggaaaaacggaatgtttttcctctaatatctggaaaaagatgagaatacccattttaccacttttactcaatactggaagtcctagccagagcaattaggtaagtgaaagaaagagcatccaaattggatggaagaagccaaattagccttgttcacagatgacatgatcttatatttagaaaaccctaatgactcggccaaaaaactggtagaactgatgaattcagtaaagctgcaggatacaaagtcaatgtacagaaatcagtagtatttatatatgccaacagcaaacaatctgaaaaagaaatcaagaaaactcatttacaatagctaaaaaaatgtaaaatgcctaggaataagtttaagtgaagaagtaaaagatctctagacaattatgaaagactgatgaagaaattgaagattacacaaaaaaatggaaagatattccatgcctatggattggaagaagtgatattgttaaaaaggtcaatactacccgaagcaatttacagattcaatgcaatcgctatcaagataccagtgacattcttcatagaaacagaaaaatactatgaagccacagtaaccaaaacagcatgctactagcataaaaacaaacacataagactgttaagagtagagaacctagaaataaatccatgcatttatagccaactgattttcaacaaaggtgtcaaaaacatagattggggaaaggacagtcttttcaataagtggtgctaggaaaacagtatgcagaagaatgaaactagacccctctctctcaccatgtatgaaaatcaagtcaaaatggattaaatacgtaaatgtaagaccagaaagtatgaaactactaggagaaaacattgaggaaatgctccaggacactggtctacgcaaagattttttgaggaaaacctcaaaagcacaggcagcagaagcaaaaatagacaaatggaattacatcaagctaaaaagtatttgcacagaaagggaaacaatcaacaaactgaagagacaacctacagaatgggagaaaatatttgcaaactctccatctgacaagtgattaagaaccgtaatataaggaattaaaacataaggaactcaatagcaaaaagacaaataatctgattaaaaataggcaaaatatctgaacagacatttcttaaaagaggacatacaaatggccaacagttttatggaaaaaaaaagatgaacatcactaattatcagggaaatgcaaatcaaaaccacagtgagatgtcatctcacctcagttaaaatggcttttatcaaaaagacaaaaaataatggatggcagtaaggatttgaagaaaggggaaccctagcacgctgttagtgggaatgcaaattactacagctgttgtagaaaacagtatggagtttcttcagaaaagtaaaaatagagctaccatatgatccagcaatcccattactgggtatatattcaaaagaaagaaaatcaatataccaaagagatgtattgatatattgcagtactattcacaatagtcaaaataaagaatcaacctagtgtccatcgtcagatgaatggataaagaaactgtgatatatatatatacacacaatggaatactatttagccatacagagaatggaatcctgtcatttgcagcaacgtgaatgaaactggaggtgattacgtaaagtgaaataacccagacataggaagttagacaccacgtgttctcactcgtatgcgggagctaaaaaagtggatctcatggagttagagagtagactggttgccagagtccaggcagggttagggttggggatgaagagaggttgattattgggtgcaggaatacacttagataggatagagtgtgatagttcagtaggttgacaagagttaacagtaatctattgtatatttcaacatagctaaaagagaagaatttgagtgttcatagaataaagaaaagtgtttaaggcagatgatatccaattgtcctgatttgatcattatacattatatgaatatatgaaaatatcacaggtacctgaaaatacgtacatctattatgcactgataaaatacattttaaaaacctatttaataacatgggcaaatgctcattattgataaagaaaaatgtaggttgtaaaattgtccatatgatatgctataaatttgataaaaatgtatatacatgcacataaacaaagataatggaaatacaaagaagtggaaactgatttgtgagtggtgagatggcaaatggttatctttttattttttctgcatttctacattttccacaaaaagaaaatggtacttagggataacagtatttatgcatatttatatgtatgtatattggctctataaaagttaccaatctccattcaaaacaattgcttttgcatttatctctggtaggattatcatgaacctttctgggggaggacattctgtctccaaaatgggtaacttttgttcagatcttggttttatctatacaggtatccatgtccatgtcagaccatttcacacagcactgaaatttgtttcctttgcctgattttctctaacctggcctggaggaagaaggtattttcacttctctaaactcaatctgtcagctttattaaacttgctaatcctgttacatgctccaaattcactaatgaccaagcaggtaccaccaactctggccctgataaaaaggacaaacttctagccccagcctccagcagtggaaacatagtcagctggcattgaggtgtctgggaaggaaacttctctgagccttgactggatacaagaacattcaccgtgagccagcttctgtctgtttttgacagcagttccctctctaatccttccttggagctctgtacatgctgggatgggggtgtcctaacaaggtacctttgcaatcattgaccttttcaagggtgctgggttgggacatgtgtggattttttcagttggaactatgggtttcacagtgaattgcagcacatacagttaattcacagcagaaaatgtggtgaaacagctggaagaaggcagctgcataggggcaggggttgtagagggagagcagggttagaggtggggaaggaaacattggcaggagaaaagcaataatgttacagggctataactgggggagaagagcaagttctgggtatgagcatttaatatgtggacagggtaatatattcaatagggtaaaggaaatattagtccacgaaaaatccaacttcttgacttcaggcatctgcagagcaaaggtgacctcagacatctacagatatgggcccatccctctctaaagggaagacaaagtggctcctgattttccagttgagcttttctggaggccgtaaagttctctgtaccactcattgtgccccactcctactagactctcctcccaagcctaccatggagccagtccttccaaaaaaggtctcgtctccagaggattgctggaaaaatacaaataaaattacttcaagctcatcattcccactgtgatactgacctacaggcagagaatgaggcctgatggaatgaaacaggactagcaggttttggtaagtgaaaggcatgaggacatggagtcagctccatgtgggggcagaaatcccatctttattactcatcactgggtctccaaaaccttgcccagtgcccagtgtgtccaaggctgggtaacagtaatgtctaacacatgctgatcacatcagcactgcaaagcaaggctcacagtaccctatgaggtaggtatggttattaccttaattttggaggtgaacaaaatggaagtgcaggggttcagtgtatggcttagggtcactcagattgaaactgggctgcttcatgtccagatctgttcttaacctctacactctgctgcctccctcaatgaatgtttgtgggtgtaccaagtagaaagtgatgtcaggctgtgtggggacacaaatgaggtctctgtacaggtcaagggcagcaaggaggaaggctggaaggagaaacatatggagcaggatgcaagagctgcaacacctttggtcccaagctagtgcttgctgggcttagtcctggtgggtctgggctcattttccttctttttttctttgagacagagtcttgctgtagcccaggctggagtgcagtggtgcgatctcggcttactgctacctctgcctcgtgagtcccagttcaagcaattctcctacctcagcctcccgagtagctgggatttacaggcatgtgccactatgcccagctaatttttgtatttttagtagagacagggtttcaccatcttggccaggctagtcttaaactcctgacctcgtgatccacccacctcggcctcccaaagtgctgggattacaggtgtgagccaccgtgcccggccttattttccttttgatagagctgtgggttggggtgaggaaggtgtgaaaccttatatttgtccctttctgctttgtctgctcctctcccagttcaagatcggggcccctaagaccaagcagcaagttctgggaagaaagaatccagcctgagttgttttttacctttagaagatacggtcccattctttcgtacaggttgtctttttcttttttgccttgtttggtacatcagtatgtattctctctcacgcctccctgcctaaagggtggaagctacattcagaaactgagcagaggactcagcacatgcagaggttccctcacatacatcattaaaatacatggttaatgatagccttctgctgtgctgtactaaacttgaagaatgttctttgcacatatctcttccatacgctcctaacgtctttactctgacagacttaaagacagctctgaggatttactttcttaaggaggtgacgtgaaaaactgaaaagtcttttttcttttgtgtttttgtttcactggtgaatgggaaggtgttctgtttgacagtggcaaccttcagcatcaccaattaaacctctttacaaattgcaaatgatttctttaaccccagtgtgggagtgtgaattgagcaaatagaggaatgtgaggtagcaactttactataacagaaacaaggacaggaggagagaaaattcatggaaagcttttagatcaaattgttttaaacattgctggctgaagctgtcactgcatttcattcctcctacctgatcctacagttctccctcctcatccttcccctccaccagacacacacatgcaaggatcataggtggcgatcctgctgggaagaaggtcatcaaaaaagatgcaagataagaacatgatatatatacatatatatttacaatttaagatgttgatatctgttatacataattaccagggaccaggttattcagcagtcctaggaacgtggagatagctcagagacagagatgaaaagaaaatttataggtttgctttccaggaaagaaaattgggtctgaaacaactgaaatccttaaagaaactggaataaaggttagttttaaatttggttacacttaaatggttgacttgcctatctgtcgttaatatatccagttccaactacaaagagaaaacaaccagcaggcatgagcgtgaactgcacaagtcctcttggagaacaaggcctttgcagttgacgtcagtttctggccctaacagttttaaatctgctttcagaaaacttctcctgggcatgcattcgcagatgatcttgtgataaggggcaagggttgggctttttaagggtgtgtctgttttgagacctcaagcatgctggacaatgtgttggtcagatcctggtggtacacagtagaacgtaaaaacaacagaaaagtaatactaacagaccatgagctagatgagtcttgagactaagacaaatgaggaaatacaagactctacgtatcctttagtggattccttcaggacgactaatagatactataagggtgcagcagctgcaccaacattctgaatgccaggcaattccagaagtttgaagctccctgtcagactccaccacacagctattaatatacagaatcccccagaaacaaatatgagatgcaaccaagatttatggatatgttaattacagatttataatagcaaaaacaggaagttaaatgcctgacacacaggcgtgtggttcaattatttcacatctacattatacagccgttaaaaatcatgtctttgacttggaaccaacccaaatgtccaacaacgatagactggattaagaaaatgtggcacatatacaccatggaatactatgcagccataaaaaatgatgagttcatgtcctttgtagggacatggatgaaattggaaatcatcattctcagtaaactatcacaagaacaaaaaaccaaacactgcatattctcactcatagatgggaattgaacaatgagatcacatggacacaggaaggggaatatcacactctggggactgttgtggggtggggggaggggggagggatagcattgggagatatacctaaggctagatgacgagttagtgggtgcagcgcaccagcatggcacatgtatacatatgtaactaacctgcacaatgtgcacatgtaccctaaaacttaaagtataataaaaaaaaaatcatgtctttgaggaacatttggtgacaagaaaaatatttataataatataatgaaaaatcaaaaaggtacaaaactgaagacaagatgatagtatttatttattcatttatttatgggcttttccctctggtcatatacatgactggaaaaaactaaaataaagcgttaatggtggttatctctgagtaatgagataccaagattttttttccttacccctatattcttttctttctataatttgcaagcttcaaacatacttttgctttttacttttataataaaacatagtggttttaaaaacacaattgtcagctctcacaagaacacccagctaagttggcaccagtccactgtataattgttattaataaatgataatgcatgaaattcctgcccccagatataaataattataatgaaaaataatttatttgtctcagacaatagcctttggtccagaggctttaaaccttgtgttctgccttaaaattcatcctgccaaaagtcctgtctgctatattaaatactttgttatttgttgagacagggtctcgctctgtcacctacgttggagtgcagtggtgtgatctcggctcactgcaacctctgcctcctgggctcaagtgatcctcctgcttcagcctcccaagtagctgggactacaggtgcgccatgttgcccagtctggtcttgaactcctaggctcaagagatccgcccacctcggcctcccaaagtgctgggaatacagacatgaacctccacacccagcctatattaaatactattgatgcatgaagagagaattaatacttgttgagtatgtactctaggcttggtgttaatgtacatggtttcatttaacacacaaatgaggaaggtgaagttcagaaataatttgtctcagtcacatggctactcagtgatcaaaatggattcaaaccctctcagtcgggtctgaaggcctcgtctcttttgaccaccacaaggctggtggcaacttcagatgagacgtagacttcatttcagacatttaagaatagatttgcaaaatattgccagtgctcctaatgtgagggcaaaataattgatgattaattcttttctttcacataccctagtggaggtactggggaaacttccaaaaggagacaaagttcagacagaaaagagggtgagtaagtaatccaccacctgggaaacccctgataaaacaggcagtgattgtaaagattagcccagccctctgcctagggagggaggtggccacccgcagtgactggcaaggactgtcaggttctgttacttcacaaatatctcccccaccccctaggtcaaggtgctgctcttccttcctactgagccagaaccccatctctcaacagtcattgctttgagttgataacaaagcctacgtcatagactctagacaggtatcttaaaaaagctgaaaactttcctgtagaagggacaaagacctcgaagattatctcactttactttttccattgaataataagtgacttttaaaatttttcaaaaagggcctatgggctagatactgtgttaggcctgtctatacatgtatcatctaattcaatcagcagatcaatttataatcaaaacatcttagctagaacctcacaattacaagtacttccacatacattctctcatttgcttctcacaataagccttaaggaaggcaaggtaggagttatccccattttacaaaccaggaaactgaggcctactgccactttgtctggcttattggaacagacagcagcttccctggaagccacagagggactggctgtgtgtggagtggatatgaaggttttggttgagaatgtggcagccttgtgtccctggaagacagggtgctgaagaagggttttagggtaaggatgagggtcatgaatatgagagtggaaagataaactatgtctcacaacattgcctatggggagctctgtatgaatggcttcctcctttggctttctactttctcaatcctattcactccccaaaaccaaacccaagtcccacagatccaggaaacctttcttgattatctagcacaaagaaaccatacgtgtaacaccttaaggttttcccaggccttagctcattacaatattatgacatgcttttgagataggctttgccattctttttacaagtgagaaaaaggaagctcagagaggttaagtaacttgtcaggctgatacatttaataagcagcaaagtctggatttcaaactacatcacatcatagctgcctcaacttcctgtacacttatcatgtcctgtatcttgtcatgtgtttcttaattccttaactcagttgtaagttccccgagggcagacaactagtcttatatttctttgtaacccccatttctgttcccctagaacttagcagagtcctatgagcacacaagtcctcaataaacatcatatgttaaatatctgctgggtaggaacaataatgattaagtgggatttttttgatactctgaatattaggctctctgttgtatataattaaaacaagagtgaacaagaaatatataatttctcctagctctagtgtaatcaggcattcattatcatgtctaattctgtgttcagtgaaaagaactgcttagtaagcattttctttgatgaggataatcaaatacagatatcagagagatttaaaaaagacaaaatcatcaaacatatggagaggcaatgatctacagggtataatattccatctgagactaaagaactttcaaggcaaaaagaacacttgtttactttttgacaattggatattcaaggaacactaagagaggaagtcacggtgtaactgggatcttgtaccatcacacattattctttatcaagaagatggatgcactgtgctactgttctgggtgaggaacagagaaggagtacatttcaagggctattctgagagaaggggttttctctgagaccttttcagcatgtcagtcatttaggtaccaccttcgctggcaggcaaacttaatgaatatacatgcaatgcgcaactgattaccctgtcgggtctcttgctatttccctcccagtatatcatcagttatagttttggaaatacaaagagctcaaacagactcactgaaattagaatttttgatggtggggattagctcacatacttctaaattgacatttgataaactaggctgacaatagcagtgcctgtcaatcacattttcttgccaaacccatatattaatcttaagctgctgacaggcagagcttctgatttcctttatgtggtagataaagtgctacatccccatgtgttcaaccaacgtcaagcaagaagaacaaataccaggtttgtggtacctacatttgaatcctcatggctgtggccattggtctcgaccaattccttggtaccttttaactgcaaattttaaggaaaaacaacacaaaacaaaaaaatgaataagcaagcaaatctcttaagtatatcatcttgttaactgatttatctgaggttgcattttataaaacttccaatgagataaaacagatggagcacatatttctaatgagccttattggagccagtttgagaccaatattttatgaagtttgatgcctggcaaaagaataaatgggtcttggtcattattttttaaataataagattagaaagcagttccataggcataaaatgtataaaattggttcttaagaataataaatgatttcatttcctagttggattgctattaatttaaaccctgcagtgtttgcaagttgccaccagcaaaatgatgttatattaacgattattcgtgaatgatgcattttcagctgcttttaacatgctactgtgctaccagacaggtcctccttgagaatatatttgaatgactgacatctctggaggactaaagacggttgcttctttggtagagaaagagtttggatgacatctccttggccgctgaggcattagaagaaattatatttctctaatgagatttttagcagtgaacatttgaaaacatttctctttctcagaggcttaggagtaatcagttataaggaggtttcaggaaacctttaattgtcattttatcctatcctgacgcaaaacagacatttagaatcagacggcaaaggaagagggtgagctggcttgcaactgttttgccagtattttttcctgacttaggaaagcagcatctcctccattatcttttttatacctaatacaaagtattcatggtaggaaaaaatacttaagatttgaaagaaaatcaatgcacatataccaccaatgtgtttgattcataacattggttccttctggctacttgtgcatattaaaatgaaagcttctttagttttttaaggccagtcttaaactcccagcaaaaaaaagccctacccgctccatgccaaagaaggggttttgccaaaggaatggtaacatgaagaaattgaggatcaggtagttgattatggaccaaaggctctttggctcatttccatatcactcccacttaagaaaaaagtctgcccactgttctctagggcaacatcattgatggttctacacacaacagacacaggggagcatgggcgatgtatggcatatatgacaaggcagaggtgtgccacaataataggaatactgtctattatcacaggacacaaaaggactttttaaaatcccctcactcttttcctagctgagggtttcttattgtaggtatccctcatcttcatcaacctctctgctcatcccaccttaggtcctgtagcttgtgctcccatgagttcgagtggggttagctcagaaggtcttgttctttttcagcagaagtagaggactattttgtgaatgtctgttccacctttacgtgtttaccaacataaatgtgccagttgctctcctctcttttaaataaactccattcttcccattccatgatgtcctctaactctgctctcgctttttctgctcctgtttattctcccctcactccctgtctcctggcattgttcactccgctgtgctccattgccagaaccgtggaggaaacccctccccgctgcagcccacccctctccttcctcgagctgcagctccaggacagctgctgctttgttcttctctctgctccctgttcttctctcctttagctgctactctcccccaggtagggctgaacatcctgtctgatgaaactgaggtttgtgaacaagctccagaggtaggaagctatcctcattgtaaatgagatgaaaggcaggagtcagtggggcctggagggacctagaaaagctgcatcttcgcaaatgggaagactgagagcttaggggttagcgtggccttccctggaggggctggggcctgagggtgggaaaggtctgccctcaggacctatcctttcttgtcaggattcccagcacggggcaatcctgtgaatagcaacattccaaatctgcagagcagggtgtatctttccctgcatgtgtccatttgtttaggccacatctatgtgggcactgaaactgtttacgcatagagttactctacacaaatccaaagaaagcctcaaaggcagtggtcagtggaggtgagaggtgtcatcagtgcacatctgtgtgtgggtacagggacatggaaagaaacctgtaccctgcatggccccttttgcaagaaccaccaaggggtagcaggtgaggggctcttggacaaacagcttggtaatggcaccagcacccaaaaacatttggtgtcaggcttaaagattcttggtatctgtgcttgtaaagagctatcccattgaaattaatattgcagatttaaaattcttccttctcaattgtattttctaggtctttaatgattttagctgtttcgaatcttcttcacgttctcttttttttaaaataatggagagtgaagtgtgatgtttcacccataattgtgtgtgctctgctctttaaaaatgcatgccacaacaagatatatcaatactttcagcaaaactcagaatctatttttatgactagggtttggacttcaaaataaaggatttgagtcatttagagaaaagagaaattcacccctccccactctagtcaaagctatctaaaagaaaaaaaatcggggtgagagagcagaaaacaacaaaagctcagagctatatctggttgatttggagcaaatttggaccaactcagttccactttgctgggagtcttttcataatataacagtggaaagcacagtgatttcaggtctcctcaactgcaggtcattgtgaattcagtcaactagatttttcatttcaatctactatatctgaaatcatacagagtcagcctcagtacaagttactgaatctatattcatcatataaagataattattagttttataaagcattttcttccaaagctataaaggtttataaactaatatctgtacttttctctcacaaatcactcatacctttgggagaaaataactaaaaagatattttctggaccccaaaccattaaaaaaaaatcactcataaagtgacacagagctgactttatattttctcaaatgtcacctttgaagttatgtatacagtgtaaggttatttatacaatataaaacgattatgtgtatgaaaaatttaaaacaatctgcatttgattactcacagagggttggggtaactgtatgcaactttttccttcaaattaccattcatacattgttggcagcaagtgaaggccagaaataggaaggcatttcaagagctctcctggctcctctcatgtagatagtgggcttagatttcactctgctgcctgccgagtgttccatcttaccctgctgtaagacaatactttccaatccacttatcaatgtcaggccacacttttgtatcaaagaaagccagaatgaaatgatcaggtttacaaacttcatataaaaggtctgttgctcaccatggttagataagtaccctgatgcacagggaagatactttttaaatgttgctatgaatcagtccttgttcatgtgtctgcaggagtctcatgggttatgctgaactcattttcctcactgttagacttaagaggaaaccagctgcttactttgaaacatacctcattgccagtattttgaaactttatcgaaatttgattgtcttctggaagaaactttcacacaacactggcaggcttgggcaatctaaacaagtacaggagtgaggatagcgatgctgggaatgaggttataaattccgcatagcaaagctgctaggaagtttgacagggttcagactaattgtactgcagattactttcagtaaatgtttgcacgggtgacgcacaagggaggtatgcaatggggtgtttggactgattcataaatcagagctgtttcattcacttacttgttcctgcaggacttttagtaacgcttgtgtatgggactgctcttcctttgcttgttccaattctgactttttgttgtttaactcctcctggatggttagcaattgctgtgaaattaaaggatatttagcataagtaggattgaaggtcaggtgatttaaaaatatccacaatacccattcaaaattatgagtagaagatgtttacaagtcttgaagcttaattcagacctcagttgaccttgtgtgttttccgcactaagtatcaagggcattgcagttttgacacactttaggttgtttgtgatactgatgcacaaaacttgttttcatatttgtgaaggcatcattatattcctttgagcaaatgcctatttgtaaaactatataggatagtgctaatacattacattcatagatgaaaaaattataatatagtcaacttgtccaacgttgcttcatttcacatattacagtaaagctagctttacagtaactctataaagctactttgccaagtggctgggaccacaaaagatccttttactttctctgttatgatggtgatgttttattagatcagtaggactgaagtccaaactgcaatcaatatatcagctgagaaaactgctgatataaactgtcaaaacatcaagctatggcctacactgctatttttaagcagggccactgtatggatttttgtaagccctgagcttcccttgccctatcaactgtaactcatgtgaaggctttccttgtctgccaaaagcacagcgctgcgcagtgcgaattctttgggacatggtgatatgttaatatatacataggctggagaatacattcaagagctgcaaaaaggccctggaaacagctctgactattcagagcttcttgacaacaaaggactggttcgaaaagacagagtgcatttcttctgctactgtacataacaattgctgtactaatgatctggaaatgttagtggattcctgctatgaagagacctgtctccaatagccaggctacttcttcagggccttgacaagctggctgcagagctgcctggccagttcctaaccatcaaagcctggagaaacactggcactggatttctcaggcttaaacctaccaactggaaggattaaattaaatctccaaatctactggtttggggggattttgcagggtaggaagtactcagaaaaacacactgtgctttccctgggacttgcttgttctgctaactactgtggcactgggtataaatgtaagaacctactttggtcctgtagcataaacagtgatttcttgcaattttctaaaagctcagtgtgtcctatttcaccacctgcccatggaataatcaatcacatgtgaggtaatgtacacattccatatgcgctcacttaacaatttgtgggatttaattgtgcatcattgattaaagtacagaaaccaaggagcccattttgcactttggcacagtgacaagcacctacattgtgtccagaccgtggggaatggctctgttccttcattcacattcctgactggccctagaacagttccaaagggaactggtgccctgacttgggtaatgccgagtgaattttacttcatgagacgatttcaaatccaatccttaaatctcttttgaaaaatgagccaaatgaaagataggaagttgtcttcaaaggtaggtagctcatgtttgcttattgcagcacttgaggtggcaaaaccaaaaataactgatgtccagaagaagggaggtggacattaataatcgtgtatctgtatcatcagacactatgcagccatttaagatgaagttgcacaaatgtcttctaatgacacagaagaagctcaaaaagcactgctcagcaaaaaatacattcaggttacaaaatgtaactttgcagcatattcataggaaaggatctagatgctgtctctgggtgggtgggttcatgtatctttcttttttgcttgtcagttttctggtatatctgtaacacatactgctttagtaatgagaaaaaatcaaatgaatttaagatcggggaagaacaaagagaggaatactacttggacacctctctcagctattaccaatactgtgaataaataagagggagaagtgcattggagtcttcattgcatccgcacacttacaactcttccttctattaaaacacacacacacacacacacaagcatgtgtgtgcatatacacccctttctcttgaccactctttttcttttagcctccctcttatctcatccattcttggattcacactttttaaatgaaatgtcttccctctcatcagtgcttccttttcttcttatgtgtcagtgatgtagtgtctagatttttatttcaatgtgtttttccaaaacatatattgtcattgttttgtgtgtttttttatgtgatattatgtttcttattgtttgctatgttttaaattagcattatgtttttaagatccatccatgttactatttttttgttaatgaatttatttaaaaatctaatagattttccccttttattcccaaaatgtgctatacataaggaaactttgaaattcccttgagattttactgagcttgatttattattattttttattatactttaagttctgggatatatgtgcagaacgtgtaggtttgttacataggtatacacgttactattttatgtatctaatccatgcttctgatggggtatatccaccccattttacccaacccactctcacagtgaaggccattcagattaccccaattcttcccactgtatacaagcctgcaatggaatatgctagtgcaagttcccttatggccctgtgggaggatttccctgggatgcatatccagtggtggaactcttaggtaaaagagtgaatttggcaaagctgctctctgggatggttatgccagtctacctgcctgtcagtggtgtgtaagagctgctgtgctctactgaataataacactaaaagcattgttcggctttctaattgttgccagtttaatagaacaccaagattcttcatctttgaaaaattttgtacttctttgattccctgtgattttaagcatcttatatacttgctagctataggggtttatttataatttttaaaatagtcaagagcagtggttcttaattctgactctccattaacattatctgtgaagattttcaaaaaaatacttatttctgggcctgacacaagaccaattaactcagaatattgagaggtgggacccaggcactgaccatttttaaaacaccttcacaggtaattattctaatgtgtaactggggatgaaaaccactgtatcctgaaatgcttatttaatcttgcttatttaatcttcagtctactataatgtgactttaatccctagtactctactcagactgttctcactacagtcaccagtgccttgctaattgccagctagtattccaggttcttttcttctcactacacgctctctccaggggatcctattcacgcccatggctttaactacacatcacatgtgctggtgctttacaacactgcctttacagcctctgcctctttcttaccacctaccagacccttcacttcctgtgtttacaactgtgcccattagcacacctacccttcccaccccaaccagtctaaacgtctttccctggtaaccagagttaaaaccttgaagtcaacgctggccctttcatcaccttcacaacctctttgccggttccttgaccttttctccatcccatccttgctgtcatagtaaaggctaccatctcctctcctctgggtttttcctgttccccctgccatttacccgacactcctgagagagttgacttcccatgaattaaagtgctcccatgattaaaagtactgttaattctctaacccctatagataaaatctaaaccactaaactcatccttccccagacatgccagctgcttccatgacttatgacaagtttaccactcagaattctgcctggcttattcctactcattctttaagcaccacctcaaatgttgcttttggcccaagatcaactcagatgatgcctttgtaaaactgaaaagagccccatcctctctaggtagagacaatccctcaccaggcatatggttgggcactggctttgaggcttgatttcattcccacttacccctttggcctgctgctcttgtccagggcagaacctacactacgaaatgcggtagccttgggttcttgctccaaaaaaatattctctaatcactgaagcaaagttagttcatctatcttcttgctcccaaagcacttaattcaatataccacatttcatatctgtcttcccaaccagactacattcaccaatattaaggtcaatgattaggttacctctaatatataatagctgctgaatgaataaatgaataaatgaagggataaatgaatgtttgctcttgtttccccacttctatgggattaaaccatgatccaacaacaaacaataaaaaacccaccaaaacaacaaaaacaaaaacaaccccccaaaacacctgaggaatgataaactactaatgtattgttctaaacatatggatacataaaactttttgaggaaaacagcagtttcatttaagacattttgtttcattacctggcagttccagatatcctttttaatctgaaaagaaatatttctcaacaggctaaggaaatccaatcaatgaatttataattacgtaatttattcttcaagtttcaccacaataagaacaaaatcaccattatcagaaaaataaaatcactcctagactgttttctgcattctgcaaagttaatgtgctcttttgttttcaaggtataaactcataaactaatatttatatattcaaaacaatggtgattcaaaactgccactcttcatgtgactagaggtcctataaaaacggaggtagttcacaactagatgatttaagtcagcctttctggtctttttcacttgaaatttatgagtctctataatattctttccagtttgaatttttaagtactaaagtgcctcaattatagaagttcataagcagctagaacttaatcagaagagtctcttggttggattggctgatggcagcgtaattttaacatttgagagtgtggcattaaacagatgcactattacattctttggtggttacaatggagtgtgttccaattagacaattatccatatgccaatcaagtggaaacacttgggcggaccataagcaggtaaataaatgctgtacctgacacatcttgatatttccaggccactgatttaatgggatcatttgtaatgctctttggggatgcagacttcagtatgtaatgggtctttctttctgacaaattcaaagagcattacaaatgttatttggagccctagaataagtgaggtcacatttccatttttacagatgggagaatcatgggcacatagagattaaggtcatgctgtctgggagacacctaccacttgcacagttcaattttcctacctcaacccgtggtttctatcctggcaatcacactgcactgtgaatttggaatggaaatcagaacatgccaaacttaaaaatcctcctagcaacgacttctatctaaacattcatcatttccacttaggagccaggcttgttacagacatgcttttgtgtatacttctgtgagcggtgtgtcaaatttgacgtccctttaagaacaacaaccccttccttgtcttttttcttaaattgtataattttgttaccaaggtgaagtttttatatagttaacagactatgtaagtttggttccatgaaagtcatagatgacagtgcaaataccctatatgaaatacatcagccacatcttgttgtaagctgaaattcacaggattgtgattaattcaggaatctttggcaggatagtgtggggttaggagaacttctgtgggatggaggagtaagtaccctttctaaatttaggttggtggtgggtcaggtaaactaacacaaggtagatagatatagacagtgactgacaccaacacacacacacacacacacacacacatacacacaatttcttttcttcttctgtttcaggatttccccagtgcttggctctttgtttagttctaaaacaatctgctaatatttattcattcattcctttagtcaacactgagctcctgctgtgtgcatggtactgggctgggcaatgtgaaagatacagaggaaacaacagtaaatagcctctcctctagatgctgggtcacaaaaattcttacatgtacatgataactaagtcaggacaatacaaaggactcttacaatggctataactagtatggtttccataggaatccaggagatttctggggatcagtttaggggtcaggagaatgagctcaggggatccatcttgaatcataacttgttccacttattggaaatgagccactgaatattcacgataatctgggaatatttgaacccacagaatgttatcaatttaaattcaatgtgttttttactcttttggttcagttttaataactgttgttccatctctgtaactttgctataaatcagatgtcctactcagtgggataatcctttaaggctagcagagtatcacctaaggaaatgagccccagaggtttccaaagggaattctcaccaaaggcgatggtgggtgtgactgcgtctgatggtctcatcccagcagtccttttaacatttgctctacgtggcaatacccatgagtgtcccgccccatcctgcctctgtaaccctgttgccaacctgatttttcccagtattttggcctgcaatctgaactccacctgtgaccagctctgccagatccctgtcctactgtagagcttgagatggaagtatacaccccttaatcccctttctcttggtgggatcctgttacatcccaccgccccacagcttactgtgtcttcaggtctccccaggactctccagaccatccactgctccatcaagttttggttctcactgacttcagaactctttaggaatgtcagccttaggtcccgctgatgaggtctacctatgcttgttttccatctgacactgaatcctgagctaatccctgattgttagagaaagtttgagatttaaaaattcaagtgaacattatcacaacctaagagcaaggctttgcctaaaggcaaacacatctaacaggatttctgacaaaggagagagcctgtctctggggaaggacaatcatttgccacctggtatctacaatgctcacttttctccttggggaaaaaaagaattgaactagcttgaattttcttgttacatgggcttgtaagactactcaagatctattctagtttaaaacgtcatctgcttccacctggggatgaaactgcactcaatttacactaaggcatgagggtatccaagcctatggccagtgtattaaccctggtgcccccctccctgcctcaggcatggtgacccctgggggagaaacatctcttggagagaactccaccattcagacgactgataacaggaatcctggatcatggaaatgaaattgtgttcacagcctaatatgctattacactaggctatacatatttaattccttgggtctttcctcataaatcaattcctctaggcctttaatctcgtcaatatcttttctgatattgaattttaaatgccattctcattgctaggcagaaggcaatctctcattcatgatgagatcaggcttcatttatagctgagagatggtgggagcatggccctgttccctgaccctgctgttaagatcctaatgtcagctagaccgcacagccgaggtgcaggcctgcctgggttgatctctgagaggtcaagataatgaaccctggggtcatgcctatcattactctgggagcctgggacagctatggagaggagtgagaaagctcaagtaagtgtttccaagggtctggcttctcatgggggtgcctgaggcatgaaggaccctgctgcaccctgacctggcaaggatccctgtggaccgagtaaggcatgagctgaaggatgcacactgtgtgcgtacatctgagcaatgtctcccagcgcaggggtgaagggagggcacaggctgtgtgttcgctaggggaaaagagggcatggaggaactccagagaacaaggacttagagctgaaaatgtttccaggttccctagggctggcctggaatgcagtgggatttcctctgctgcagagaaaaggaaaaaaatccaagaatctttgagccatgaaaaatctccaaagggaggagtgagtttttttaggacctcaggaggcacagagaggttgagaaaacacaggaagccatctgagatacagatttgagggcctaagtctgcagcaagtggcggggcaccaaggacggggcctgggctacctgccttggtgtaggagttaagcaggtacaattgtacaaaatgtaaaaacaataataaaactaaaggtgtatccatctatcatcactatgcaccagcaattctaagcaaaatcattgataaaactctccttcctcataacaatcttttgctgatctaaattctaattgttgccattactgttaagatttaataatatgtatgtaatcttcaaattagcatattctgttgcttaccctttaacaaacattttatgtggcaactgatttggaaaatttctagctttatacagtctgccccagctctctctcacacatgacttagctgcacacatttgttctgatttgagcttgctttggatacagtgtctccagcctcctgtagcactacatatattctgcatttctatactagattcaaaataaacaatgacagcacagttttgcaaagacgatgaactagaacttgagctacttccattcatcccacaggaccactctgagaatttttatgtttaaaatttaaaacaatgaaacatttttagttggcaagtgaaaattttagttcatatgtgaaatatgtttacgtttcagtatttttaaaattgaaaattttctttatagattgcttgctttaaaactaaaagacaaatcaagaaaatgttacatcagagacacaatacttgcctaaattgtgccctttgcatttggttttattaatacttatgatttactggacaattatttatatacagcaatatgttaactataatcaagaatcaaagttctaactgttaggtaaagtaaagaaaactattgaatagatagttgcaattttttccttttatcacactatttaattttcttactggcataaatatacatgaagttcaaaagaaaaaaattttagtctgcatttctttcttggccattattattcattccattttatgataattaatgaaaataatgttgtctaaatttagaggaggaaatatttaaaaaaggatcctctgagtgttaaatttcactaggtgcacaattatcaggcagccagtgcctgagacggggagagtcatgaccttggcctgttgggctaggggctggggagaactgtttcatcagacaagattttagagaccatttcctttgcttgaatgtacccctgggagggactggtgtgaaagacagatgcttcgtggcattcccataatccactggagttattaatcatgatatactatatcccaatatggcaacattattctgaaaagaaatatagtcaaggactggcaaaaaggcaaaaatgaagctgcatgtcggcatttcaaaggctagcgtgattagctccattatcagcttgctgtgcaagcttgaacaagctactgctctggtctcctcttttccccaagccttctatccttacaactgccaaatgaggaattattgatcattcacaaagcaagatatcaatgaatttcttgactacagaacacagtaaaggtagatgtaaaagtggtttggaaggctctaaaatctattttctcttctacagatgattttcttaacactgtaatttgcagggtcatctcaggttcccgtttttcactttcttcacatgttaaataaatataagaatacttaccagtgggatattgtatgactaaagaacatgtgttaagtatgtgatgctccttgaatgacaaaaggtgcccgctgagttaaatgaaagtgctgtcattatcctctttgcaaaaatggaaacactaagtcccacgaggtgaagtgacatttaagtcatatgagtgggcagtactggggattaatattcagagagaaaggtcggttgttcagccccagcctagccatgctgggtgcactccttcagcccatgctgaaaacataggccagccaacttgaattaacaccattcatgcaattcacaagagaaggtgtcaaataccttgctgaagtaggaacatgtatcagtgacattctctcccttgcctttgctggcagttcttctgcaaatggtaatccaatttgcttggatttatttattcttatcagttttgttttttgcaattatgtgaggtggtcatcacccatcctctgggcacgtgtacagttgttaatgtagaaatttaaaatattaacatgctttccagccaggttggcccatttacttcaatcaaataagaacttgatggaacagctgggtcttgcactatgccctgaaggcctacagaaatttgttctttctttacagattttataacctagtcatgatcagagattacagctagaaaaacccctatgggtgacttgtagccaaagacctgtggccctctttggaggtaccttttgcaagcgatctgggcctcattcagtttaaccactggagaaccaaacaataacttgttttagcatcattaacaacagatattaccatcatcactagtctctttggttgcaggtttaggaaagaagcttttgccttaatcattatggaataagaatgtgttggagtccagagagcttttagttgaatcttaatggtgagagttgcaatgatctagcctgttttgcagatcagtgaagagagaaaatacagctgaaggtctgatccatcagccatagatgtctgactaaggatggaaaactttattatggatttagaaggtctgtatcacctatattacttaactcctgataattgtagaactttagtgaagttaatccaatgattacaatattcccaatttttctttgttaatacaagtaaacatttttacaactaggagaatcacacatttaggagcagggtaaagagagaagaatagctctgaacttagcacatttaatctttaggtggctctggaacaagatatgtaaataaatgggcacattcatcaatcactaagggaagtgagagggagaggaagtttgctccttcccccaaagtttccaagttatttaaacacatttaggctggtctggaacccaacattttaggaatgtcagagtaactagaacctttggaggtctccaagtttcacctatgccctaatccagggtcaagccctggataaactggtgagggctgcattagacaggaacagtttccccataggctttcaaccacctatagcaactactgaacctctgaactatctcagatttgccctgtctttgaacttcagactctctgtaaggaaaaataataataatagcagcagcagcagcagaaaacctcaacaaatactgccattgtgaaatgtgccacatattcttaatacctgctgctgaaatctatctggcaaaatacaatacagcaccaccatcttgcatagactccaaagtgtagaaaattatcatcttaaaccaatctcctctgcttcagaaacattaaatatagaaagcattaaagaagtgagccgagttagaccttttgcaataaatggtgtcagcatggccatgaatgataacagcaaaaaaggcctccaagatatgaaaattaagagaaattagagccccagcttcacacttattattaatatccacatgcctgtgatgaagtgctcctctagctttagcagtccccctactctcagttggcaattgcatacattttaacattgcatgtgatgtttacccgtgaaaatttccaatcacaagttttgctgaagtcatctgaaagtccagctgctcacagtgatggcacaaaaaagatgatcatttgtgatatatgggtatttaagttttcactgtagaaatacgggagggataacaccaaggttagtgttgatgacttttcaaaagggaagaatagggagaccacgtttttagggtctgctggtagactttatgtagcaatctttttctgcttccagggacaatttgaaaatgtaaatcatgatacaaagcaagtgacataaatcagttgcattctagtccaagtgattatatgaggattgaaagagattatatcgggattaatctgggaaggttaaaaaaatcacattttgtcactgaggttgctggggataacctttaacaggataagaaagttcctttctattccaagttgttaaaaccttcatttttcttggttgttttagtttaaaatcatgaatggatatttggtggccatcaaaatgtttgtattattctggttttgcctgttaatgagatctattacattgatagatttttcaaatgttgaacttaccttgcattcctagaataaatccaatttggtgatttataaaataccagattaattttgcttttctaaaggaattataaatctttgtttataactgagcctggcctataattttttgattttaacttttaactgtccttgttttatttcagtattaagtatactagccttacgaattagttggaaagtgtgtcttccttttgtgttctctgaatgagttagttaaagattggtattcttttttctttttttttttttgagacagggtcttgctctgttgcccaggctggaatgcagtggctcgactgcagcctcgacctcctaggctcaatgatcctcctgagtagctggaactaccggcatgtgccaccatgcctggctaatttttaaattttttatagagacagagttttgccattctacccaggctggtctcaaactcctgggctcaagggatctgcctgccttagcttcccaaagcgctgggattacaggcatgagccaccacacccacccttggtattatttttcttaaatgtttggtagaacttgcctataaagcaattttgggtctgttgctttgatataaaattttaagctattggccaggcgcggtggcttatgcctgtaatcccagcactttgggaggctgaggcgggtagatcacgaggtcaggagtttgagaccagtctggccaatatggtgacatgccatctctactaaaaaaatacaaaattagctgggcatgcacctgtagtcccagctgctcgggagctgaggcaggagaatcgcttgaacccagaaggcagaggttgcagtgagccgagatcacgccactgcattccagcctgggtgacagagcgagactcggtctcaagaaaagaaaaaaaaaaatttaagctattaattcgagctttcaatttctttccaattcagttttgattagttattttttcctattgaaatttgtctgtatctccaaagttaaaaaattgtcataaaactattcctaatattcttatatttctttagtctctgttgcatctatagttataccttatttttaatactgtttttaggttgttctctttttttcttgatacatgttgccaaagattttccattttattcatcttttcaaacatttggctgtgttgatcttctctattgtatggttggttgctattttagttatttttattctttgtattatcccctctactttgtgtttattattttttgtttgtttatttgagacaggatctcactctgttacccaggctggagaatacagcggtgtaatcatggctcactacagctttgacctcccaggctcaagggaattatcccacctcagcttcccagttatctgggaccacaggcacgtgctactatgcctagctaattaattttttttttttttgtacagatggggtctcagtatgttgaccaggctggtctcaaactcctgggctcaagcatatcctcccgccttggcctcccaaagtgttaaaattacaagtgttagcaactgtacctggcctatttttttttcaatagaaattggatgcttacctcactgttactagttttttttcctaaaacaaagttttaaatttttcctttaagttctgctttagctgcgtcccacaagttttgatatattatgttttaattatcaattacttctaagtatttttaagttaattctgatttctttttgaagctgtaaaaatgatgtatgttttaaactttccagatatacaaaatttattttagttatttttggcactgatttctaacaatttagtgtggtcaaaaaaatacaataccactcttttgacatctgttgagatttgctttaaggcctagtatgggattaatttttgtaaatgttcccagtatatttgaaaagtatgattttctttatatgtcctacatattgagcttatagtagtatatatttacaatgttatggacttcacagttaggcctttacaaaaacttcctgaaagtgaagttaagtggcactgaagataagaaatacaaaccgttaggaaagaaatataaacaccagagagaagaggacaaggtgcacggagaatgagagaacaaaatcatggcataccaccctatgtttaaatgactgaaaaatgtgtaacacactgactcagcaaatgactcagtataaaatgtaaatcatgggtggaaatatacatatcttaataccatgaatgagaattccaaagctggccaacgaaagccactctgactgaatctgagtgatacctggtttaaaataaattaagatggtaatggtggtggagggcataaaaaatagaatgcagttgtctggtgggtcagcaggatgaattaagagaacaaaaggaagaagaaaatatgataatttatttttatctctttgaaaagtcactgtgttggtctttcatttataagcgctacttattacactcttccttggaaacttactgacaaagttcaaatatactttcttctttattttcttccccagtaaataaggctgttgtggctatttgttaaaggtgtgtgtgtgtgtgtgtgtgtgtgtgtgtgtgtgtgtgtgtaagagagagaggggagataggaatagagacagagacacagagaagaaacagaaagcgcaaaaactggaaactggagaggtaatgagaggcaattataaaagaggagatagaaatatgtagagaaggagagtcagagacacagagagaagaaacagaaagtacaaaaaccagacagtaattaccagatggaagaagctgcacatagataagaacttgaccatgcagggtgtattcactgatcaattgagtgagatgggtggtctgtaaagtgaggaccagattgggcactaacttgtttaagtttcccttgatgactattcagggtgctttgttaaacagaggagaaaacatagtctttaactaaccatctaacatcttggaactgaattcccaattccacactttggttacaattccagacactttaactgactaagtttggctgttctattggccagtatttaaaaatgattaacactctatgtttatatatatatggagaaaaagactgaaaggctatatgtaaatgttagcaatagttatatctaggtagtgacattatgaatgatttttatttccttttatatggttcttttatgtttccaagttttgtgcattgagcataaattcttttgtaaaatgaaaaaataaaacaaaaatttaaatgacaaaccgagacccaggaaaactgctactcccacctatatttctcttcctctgtgctttctcttagtcatataagaaggattttttttgccgaggcaggcagatcacctgaggtcaggagttcgagaccagcctggccaacatggtgaaaccctgtctctactaaaaatacaaaaattagctaggcatggtggcaggcacctgtaatcctagcactcaggaggctgaggcaggagaatagaatagcttggacctggtaggcagaggctgcactgagccgagattgcgccactgcactccagcctgggtgacaagagtgagactctgtctcaaaaaaaaaaaaaaaaaaaaaagaggaattcccccctcttcttctttcttctttgttccaatgctgtatttctttgtccccccatcaaatttctccctgcattttcttcactgctttcatttctgatgagaaggaaattggctggtcttcctaatcctgttgcctctcctagccagctgcatagaggaaagccctggagcatgaagacccccaactgcggccggagttgaaatgggtaattacatcagtctggctgggagcaggacacctgctatagacagccaaccatgttgctggcagggttcagggcttcagtgtgaatgagtcggcttcttggcattggtagactagaaagaaatgaagtcaaagccagaccacaaggaatcattttagtgtccatagctggagggagaaagatgacaatggtcagcgtggtaggccagtatatgtctgcagcaaaagtccgctttgatgtattacatttaagaaaagatccatttcactataaatctcgtactcatcatgtgatatagactgtaagtcaggaggcagtttccaaaagaggcagtgaaagggaaggtcattcaaaggtcatttaaagactgccaggaacacagcgttgggaaaaggagagttcctttatcctgggaatggaagtctactggagagtcaggatttcccattgcagacatcagggaaagcagcaaaaagcagaagtcaaatgattttaatagtctgcagggcaatgccattatttttgcccctggctcctacattgatttgtctgctagcctcattattttgagaaggaatgattactaatgaggatgcatttgatgatcaaattaattaatggcagagcaggataactaatgatgagatgaagcctctcatagttaaattttattagggcttctcttccccttcccagaagtgaattcagagatttattttcatgattcaaatttaataaaagctgcatctatgttactttcctttcgcaggttcttgctctgctaatgcaaagaccaaattaggggctatgacacagagtcagaaaataggcaatgggtttttgccagtaatattttagcaatctatctccaagcatatgaaggagggaacttcttgtcttctgctgtcttgatgactgcagttctgaagcactgctttcagggtacactctggaaagccatggtgtggggttatagagggaacacaggggctcagacaggcctaggctgcagttctgactctacatggtgtacctgtgccctgggtcagtcacctgacacctctaggtctcagtttcctacttgacacactgggacagtcacatacccctgagttgttgtgaggaccgcataaaataacatgaaggtgcttttgtgagttaactggagagactggccttcctgttgtaaggggcattggagtaaacagcacaggccaccctgtgtcaggaaattatgacctagacttgtcccgactaactctgtgagcctgagtcttcttttaagcctcaacatcttttcatattttcacctggaatatggcaatgacagttcacacttgtgagtagcttttcaaaatgtcctcacgtacatgatcacatgtgatgtatgattttatcgtagcaagcccttactgaggttggaggcacctggtctccaggagaagaactggaggtccagacatcctgagtttcccaaagaagtacagaaaacaaacagtgaagctgaagtcacattttccttctactagttcagtgttttcatttcattattcatgcccttaggtggcatcagtacggcttatcttcttcctcatcttatgacctctggtcagtgaagacggcaagatactcagtgggccatcctcactcaaaactgctaaaaaacatataaggaggcttcctctcatcttcatttttagtctttgtatcttgtccagaatcaaaaggaaaagtgctctgaaaagtcccaaacctcttacagatgtcatgtgtgatcctttcaaacaggtagggctttgtaatgtaaagccctgggccgagaattggagaattggtttctatttctggttccaaatggagccaaccgttccttcaagagtctcacactgaagtgagatacttaccttcttaggatgtaccaggagtgtaatctgcaaatgtcagaaaatgcacacactgccagcaggaaccctacaaatgaccttgaacagcctaaagaaaggtgccaaggaattatgaggattatcatcttgtggcctgttattataatgcaccatcccaatattcttggccgaggaatggataaaaaatgaaattacaaaccctggaatagttaaaggaagaccatggtggaccccaaatttggcaactcttgtgaaccttgatgtttaagtcactaaacctttttaaagccgtgtaatctgagagatgtacatgttttaagatttttctgattctagtaaaatgtcggtggcttttaatatgaatgtgggaaatgtcttctgcatttcccacagccatattctattctatcctattcagaaagaaagaaacttaatctgggttgtcgaagaatcagataaacatggggtatgtctttgcagccacagcttgtaaagactccaggtttttatatgtgtatgtctatttatacatacacatatttattttttgagctttttaaagctgaatatttgactacttgtacatgagagtctaagagaaaactcctttctctacactgttaataagattttcttgccctgtccagtgatactgaattattttctgcactaatgtataatctgtcatatattaaagatattaggatatcattcttcctgaatgagccaataaccagatcattgtgtatgggctattccttccttctaattgaacatttttgaggctcatgaactctacttagaaggtagatcctcctgatacattgcaacttaatttccaaactttctatctttagtttttttttacattctacatctaagtatttacatctttcataatggctcttaaaattagtaaagtttcaggatacaataactgtgtacaaaaatcagtagcacttctattcaccaacaacatccaggctgagagtgaaatcaagaatacaaccctacttacaatagccacgaagaagataaaatacctaggaatacagctaaccaaggaggcgaaagatctctacaaggagaactatgaaacactgctaaaacaaatcagagacaacacaaataaatggaaaaacacttcatgctcatgggttggaagaatcaatgtcataacaatgttcatactgccaaaggaatttacagattcaccactattcctatcaaattactaatgtcattctttacagaattaaggaaaactattataaaattcatatggaaccaaaaagagccccaaacaaccaaagcaactctaagccaaaagaacaaagccagaagcatcacactacctgacttcaaactatatactaaaaaaccacagcaaccaaaacagcatggtactggtacaaaaacagacacctagaccaatggaatacaacagaaaactgagaaacaaagatacacacttaacaaccatctaatatttgacaggactgacaaaaacaagcaatggggaaaggactctctgttcaataaatggttataggataactgactagccttagacagaagattgaagctggactcctaacctttcactgtctacaaaaattattaactcaaaaccggtcaaagatttaaatgcaagacctcaaactataaaaatcctagaagccaatctggaaattctcttctcgactttggcattggcaaagattttttggctgagtccccaaaagcaattgtaacaaaaccaaaaatagacaagtgggacctaattaaactaaagagcttctgcaaagaaaaagaaactatcaacagagtaaacagacaacctacacagagtgggagaagatattcacaaactatgcagctgacaaaggcctaatacccacaatctctagggaacttaaatcaacaagcaaaagccaaataaccccattaaaaaatggacaaggcacatgaacagatacttctcaaaagaagacacacaaatggtcaacaaacatatgaaaaaatgctcagcatcactaatcatcagagaaatacaaagcaaaaccacgaagagataccatctcacaccagtcagaatggttatcattaaaaaagtcaaaaacaacagatgctggtgaggatatggagaaaagggaacacttatacactgttggtaggaatataaattagtaaagccactgtggaaagcagtctggagatttctcaaagaacttaaaacagagctatcattcgacccagcaaggccattactgcgtgtatacgtaaaggcaaagaaatcattctaccaaaaagacacatgcactcacatgttcattgctatgctattcacaataggaaagacacagaagcaacctaggtgcccataaatgataaatttgataaggaagatgggatatacatatatatatatatatacacacacacataccacagaatacaactacaaccataaaaaagaatgaaatcatgtcctttgcagtaacagggatgtagttggaggccttaatcctaaacaagttaacatagtaacaggaaaccaaatactgcatcttctcaattataagtgggagctaaacactgagtacacatggacataaatatgggagcgacagacactgtgggctgctataggggagagagggagaagggcacggctgctggatactatgctcactacccaggtgatgggatctgtacgctaaacctcagcatcacgcaatattcccatgtaacaaatctgcacatgtaccctctgtatctaaaatagaagttgaggctgggtgcagcggctcccgcctgtaattccagtactttgggaggttgaggcgggcagatcacttgagatcgggagttcaagaccagcctggccaacatggtgaaaccccgtctctacaaaaaatacaaaaattaaccaggcgcagtgacacacgcctgtagtcccagctactcaggaggctgagacaagagaatcacctgaacctgggaggtggaggttgcagtgagctgagatcacaccactgtactccagcctgggcaacagagtgagactccatctcaaaaaaataaaaataaaagttgaaaaaaatttttaaaagctcttagaatacaatttatcattaccaaatgttgaatttttcttttaaaggggtttctctttttccatttttcttgtccttctatgcttgtgcattttcctttgaaagcggtttttaactggagaggaagaactgtttgttcttctgcatccctcactacttctgcacatccttcccatccctgtgtctggaacggactctactgttctgtgtcctgcacatgcatgggggcttaggcgtgccctgctctggaccattagtcctgccaccttctcttctagaacagggaaacagaaatagtgtggagagcaagttcactatctatctttgttccatatttcaacctcttcatgtcaccttttcctatttgtcttcctttctcactttcagaaactattttactttgtgcatctgcctcttcttgctgattcagctatcttcactccaaagtgtgccaccttaagttcccttgtccttcctcctagacattcatgaacctgcttgctgttcctcctttctctatatgtttccgggcagccagaacaatttgcaatactctccatgcttcccactgcaccacttccccctgccccaccccagccacatggtaaccaagaattcattcaaagactgggttaaaggtaaaggcccccgaaacaggctcctgttcaagatgtcagaggcaatgtatgtgtttgtattttcttcctccagagactcaattaaaatatctgtcaatgaataaacttacaaaaacaaggagaaaggaaagtgagttccaggagttcctagtgtatgacaggttctggcattcaagggatccccacatctccttaaaatgaagcctgcctgtcaaagagctcttggctggccactgcccaggagaaagactcggccacgcagcagatccagacacagcaatgagcaaagccacagagcttcacagaaaagcaaaccaagccctccacacctaaatatacacagactgccagccatcaccttgctcatgaagaaacctgtacataaaagagagagactgaaacacaatagctaaacaactaatcctggagtaaagagagatgattcaggaaccacaaagatcttaaaaatcctacttagtattcttaaaaagatttgagaagatactgcacccataaaatacgaataagattgcatgagaagataatgattagaggacaaaataacctcttgaaaataaaataatatgattaccaagcagaaacttcaattggaaggatcaaagataaagttaaaatggaagatactaggaaaaagatgatgggcatggagcgcccacctattaggtccattatctgactggtgggtatttcagatagaaattaaaaacagaagacaaaagtgaaaaatgatcaagaaaaaggaaagcctcctgtcacaaactctggtgacactctgtgctcctgcctgcagccctgcatttgctcagttctctggagcactaccttctgaagttggctgggagcatctggtctgctgcacttttgaggctttccacaatttttaagggacaaggtttaaaaaaaaaaaccctataaaatattagtgaatatgctcattttatctctttccctaaagctttctaatcattaaaagcaccaataatgctaccacagcctccttcaccaccatagccaccaacacagccatagccaccgttgccactatggccccttcaccaccatagtcatcatcctcaccataactacccttcatcaccacagccaacattaccatcacagtcaccatttctaccccagtcaccatcttcatcacagccacctttaacaccatcctcaccatggccatcaccacaaccacagccactagccccaacatggccaccttctccaccaaagtcaccatccttgccacagctgcctccatcaccacaaccaacattagcatcagagtcaccatccccaccacagccaccttcaccatcacagccaccaacacaaccacagccaccatcctcaccatggctgccttcattaccacagccactacagccattttcactaccatagccaccattctcaccacagccagcaacacaactgaggttaccacccccctcacagatgccttcatcactacagttgacattaccattagtcaccatcctctcactacagtcaccgtcactaccacagtcaccacagctacctttaccaccatagctaataaggccaccacagccagcacccccaccacggccatcttcaccaccatagttaccttcacaagcacagttaccttctccaccacagctaccttcatcaccacccccaccatagtcaccaaaacaaccacagctaccatcctcaccacaatcaccctcacctccagagccaatatcactactgcagtcacctttaccaccatggcaaccatcacctccacagtcccttcatctccagagccaccatcaccaccacccctaacattattatgatcttgattttgacatataacatcagacttaattacatgtgagttttggggaggaattgagtgcaagcttttctctttctctaaaaaaaacgtacttactaagcaactaaatagtttaaacaagattgcagaagacatgctgaacttacccaaggggtcagatgtaatcactatgtttaatttcaaaaatactttcatttattccttagcagatattccaaagtctgactcttacccaacatctgacaaaactaactggggttactttgtattttaggaaagtagtaatgttatatttcttcatcttccataaaattagtctaagtgggtgagattttaacaatgcatacacagaaaatcacacatatgttctactttgagtataaagaaaaaaatgcttgtcacttaatttctaaaatgcttttgatcataatcatcctacttttcccattttttttttcctgatcttcccttgctgaaagttgtcaagacagtggaccaggcctgcaccttactaatgtcaagctaagagtgtgagagagactgctccacatgggccactggcttgctggcctaagacagctggtcttcagactagatttaacactgttcaaaagcatcggcttatttaggaaggagccctttgacataatcatcattagtcatacgcacttttatgatcagcagtttttaatggtatcctgcagttatccaaatatttattagtcctgtcaatatgatttacacaaggcttcaaaaagaattctgatttttaagcggattattaaaaaattatgacatgttgacctatcctcatgaatgaaaataaaaatactgcaaatttgtgtgtaaataaaaccataatgagatatcactataaatttactacagtagtgaaaaaagacaaactgaccatgccagtgctgcctgatgaggatgcagaactggagtttgcagacagtcccgagggaatgcatgatggtacagacgcttgggaaaagagtttggcggtttctctgaaagtaaaacacacttgccatatgacccaacaatcacattcctaggatttactcaagtaaaatgaaaaattatgtctacacaaaaagcctgtaagtgaatgtttatagcagatttattcccatttgtcctaaactggaaactatccatccactaactattgactagacaaacaaaccacagctctttcttacggtggaatactgctcagcatcagaaggaatgaatgcctgatacgtacagcatcatggatcagtcttagattcattatgctaaagaaagaagcccaactcaacaggttgcctactgttcaattccccttatatgatattctggaaaaataaaagctataagggtagaaaacagagcagtggttgctgggagtggggctgactcaaaaggggcaagaggcagcgagtgctggaactgatttatatattgattgtggtagtggtggttacgtgactgtatgcatttgtcaaacttcatagaaggtatgtctaaaaagaatatatttcattgtatgtaaattttacctcaataaacctaacgaaagaattcagtgtggtaacctgaagaaaaataagagtttaaaatatgtatagtctttacttgtacacctaaaagtacaaatgaaagtcaaaagcctcactatccctgtggcagagacaggttaacttcactgccagtttaagatcaggtaaaggctaccgtgttaccatggatacaagctcttattctcttttgtatgaaacctttcatattattaaattgtgactcacatggtgcaggggtaaactcggaaacttccagacaaagtcacccaagagtttttccatgttaggaaccctgcccatagtgttttcttcatgaacacatgcaaaactgtgtgatgtcagtgaacatatccttaaggggttaaagaaagaaaggttagaaaatttttggctaaactgaaggcgattccaaaagctgtctgctagtcctaaggtcattaaggctctttctttttttgttgtttgttacagaaataatttcccaaacatagactggaaatggtgacatatgggaggctgacccctcctctctctgtcatctttcatgtgaaaccatgattttctgatttatacagtggatagtgtggagattgaaggcaggttttaaagtcaggctaattctttgtggtgggattcaaattagcaaattgtggtcatttattcatacaaggtagatcatgatagaaacaagactttaaaaagcacttatattttaaaactctgtaaaagatgttctgccacagagatagccatacaccgcctaacaaccagtaaacattaacatcatagcagccaccggggacccagtgctttctgtaggttaaagaggcacacctctcaggccttggctctcccgctccctgtcttgctcttcatgatccaggatcccacacagcccagagctcccataggcaccatgctaggcttgcctccaggtctttgtctattcattccctcatttgacacagatattttgactgtctactacgtgtctgttatggattgaattgtgccctgccccccagccccaaatccaaatgttgaagtcctagcccctactaccacagaatgtgaccttatctggaaataagtctttgcagatataagtaattaagatgaggtcatcctggagcagagtggacccctaatcctacatgaacagtgtatttataaaaagcagaaatttggacacacacacacggagaatgacaagggatgatgaaggcagagagcagggtgatgtttccacaagtcaaggaaggccaaagatttccagccaacctccagaatctgggagagaggcaggagtcagactcttccttacagcctcagaaggaaccacccctgcttttggaccctagatcttggacttgtagccttcagaactgtgagacaatacatttctgtctcaactacatttttagctatataaagtacatttcctactgacaaggagattctgaaaagttatgagaagctcccttaactgaatccctccatcaggaggatggctcaggtggtgatttggaacactgctcctttgtggaccaggcacgtggctcctcagtgcttctgcaaccctgactgagcagctcaccctcgcctcctctgacttcttttaggtttgaatttgcaataacctaaaagactttatacacttttaaagcaactgggataatcttttctagagggagaaagggagagttgtgtaaagtgtgacatagtggcttttgggctaggtctggcgtcatggtctttggggaaatcgacggcctctcatcttggcgagggtgccaacaaacacccaatgttggggcacatggacaaccccagaagtctcacacagcagctgttacatcgattttcaagtacagagacttgagcaataactgtaatgacattttcctggctggctctgacctctgaatctcactgattagtctaacacacactgtgaacatcaaccagttaggactctaagccaagactcaaaaattgctttaaaatggcagaagatgtttaagatataatttgtacgagttggttattaacttgttcacttcccaatccgtgattcttttttatactctccctctcaattatttttccctgttaggttgatgtatctgtagtagttacctctaatcactaagatacttctgtaggcaatccatgctctggatgttacagagcagtcaatatggatgggggaattaaaaaaaattgactctatatattttaactttccatcattctacttatatttcccttgtttaaataaaaacaatcttttttttttcagaaaatattgattggatttgtatattcagagggataatttaaaaatacccatgatgataatatatgctctgttattctaaggtaactcaaaggcccaaacaccttaagaatatcaggtaccaattgacgttttcagatacaaatctgactgtgaatctttgactctattccctcactgccaacagtcagattttcccctcctgtcgacattttatatcccacagtacctgttccttttccctactccaaagccctcaactttcatttcctttttaacaattgccataaatatacatctttaaattcagtatgccaggatgaggtctggcactcttcaacaaaaacacagctattgccctgtttctaaagttatttatcccccaaaactctgatgcttcatgtattccatcaacaaacacttcttaaacacgtaatgtgctcaaagaacctgactagatcctaagtgtaatacagaaaaagtggaaacaatataatttacatttacactaaccttgaagacagacaaacaaactgcttttgtaaaatcagttgtcgtgctttgaagttaaaagttctaagattacaaaatgcttgtatcatgcagggatctgctaggtatttgccatggggctatatttcacatgcagcctttcaatctcctaaatccaaatcattttcctttatttcctacctccagggtgatttcttcaacatattttattggcttggcttttctccagattctacccttccacaaacagtcattagcacttttctgtcctagtaacatagctttttggttgtcatttcttctccttcaccctttccagcacacggctgcctttccattttcatttaatacacatatctctttctctcaaaaaaaaaaaaaaaatctgggccaggtacctgctgcatgccttgcatggtttgctgcagaaactgcagttgctggtccttggtgaggttttcttctgttcggaaaagctgttctttttcttgtttcagcagctccacctcattcctgtaggcatccagctgccagcggagactgtcattctcctctttcagagcgtaggcctgggcagccagggctgagggacaaacagaacgagttcaggtgagctaccttcttgcttagcttgaggaggccttctgtgggaaagggagtctgtcacccaagttcttaatgtttgtaccagctcagaaataaaagcaaaatgccactccctgggcctctcttttgtagtcggtatgcatcacttctctcggaacttttatctattctgtttgtcctgtcttacatgtgaatgtttcttatgggcacaggattaattcctcccaaattctcatcccttgacctctccctcaatgctagacaccctcacagacattggtatgtggtgctaggtggtgacaacatttagaattccaggcaacaatcatatctactaaatattgtcttccccctttctacgggattgcttagctacttggagggctgcttgctttcaaataatcagcagttccacaggttgagacatgcggcagcatcccaggggagagaggaaattatatgcacaccactccttcctgctctactgctgggacaaattgcacagattgttttcctccaactcctatcagaatgggaagctagttccatctgtttcaccaacagattaaaactcttttcctctacaaggctgagtggttactctaatacctctccctgaaaccccaaattctccacatttagattcagacttcattcatatgtctatcttattaagaaaccaagacagttaactcagggtctcacacatctcaaggcttcagaaatagccgaaactgaaaaagaaacaaatggtaccaaacaaagattgagggtagggaaatccctttccctagtttctaccttattgcttaggggtctctccgaaaatcaacatagcctgctgagcactcataaagcactggatcaagagctttgtatgaactcactcacttcatacccccaccaagcctgtgatgccggtgctggtcttatgctcatctttacagatgagaaaaatgtggcacagagaagttatgtaactcatccaatcccacaaagtaagtagcagaaagccttcacacccaggctgcaggctccagagtctctgctctcgattaccatcggtccatgtgtttagttcttaccaggctgttcaaaaccagtctcacattcccccaccaactctcccaccactctccctttaatcttccccctcacagaaaagccattccccacttgtgtaagcaagagaaaagtgaaagaaaatttgaaacgcttgttaccagaaacttcaaacatgtaacttccagtagataagggcacggtgtggagcccactgcacaccaggtcgtcagtgcatgcgcgtttccagcccccgctccccgtgtcagaggaccaaatcaaggtcgcctcctgagtgttctacctgcacattacagttccatggtgataaagctttactgaggttctctgagaccacagtgaattctctcctcaaatatcaaatgtcaaattatgttaataatagttttatagttgagtgttttacagtactccatcttgcaaaatgataatctctgtgtagtacacactgaactactaatcagacagaacatgcaattacccagaaatttccctacctcaagccagtagggatcaattacttaacacgcatttacttcatatttactgtgctcaggtccgtgagggcatctcagaccacaaaaagaggagacagaatacatctcttctctcaaagagcttaatctagtagaaactgacacatttaaaaagaaactattgctttcaaaggaagaaaggatagtgtgatgtctggaatacagcagacactcaataaatgttggttgaatgaataaatgaataaataaatgagtcgagatgcatgacaaaaaaatgcatcctataggagttcagagaagagaaataaaaattcagactgaaggaataaaagagggctttggaagatgaaaaccccaagaacttggaaaggatgtctctcagtcagaagccagagcataagcaaaagcccagatatgaaaatcaaaggtagaacacttggggcaagaaggagagaaactcgaccaaaagccaagtgtttgcctggaagcagtgagagaaagggaatccacgtcaggtgatgggagaagatggggaaggttaggttcaatggagtggccaattgagaaccactgacagcgcttggagtagtggaaggacatgatgaaattgggatttaggaacattagtttggcaatggtgcatggaatgaactggaggctgaagagaatgaataaaggagatttcatttggtgtatgtgtgtgcaaaaccaaggagcagccacttttacagttttcagagacctactcataaaatcagaaattatccagcacataacccgcagcatgagccagtgctttttaacattgtgcagcccagcttcagatcttgtccacaccctgagataccacctcctgacagctccgtttaccaagccataaggaaatggttatgaggattcatttgtgagagggatgttgtaatagggcaaaatcacagaaaatgcaaatgatgaagaaagtgttggcactgcataggcacattactacatttagtagcattcaaagacacttaagtcatttccttaggaagctctatttggccctttttcaattcagagtggcatttttattatcataactgatagcaggtgtttgtgaagaaatcgattagtacgcagggatggaaattacattttccaaatgaattgcatagtctgcaagatatgctgaaatctgtatagcaaaatgcaagcagctataaagcatgtgccaacagcattatttaaataaattatctgaacataaatacatataggaaagtgtaccatccattattttaggggatctcttacaaacctatggaatggtactgctgagagttcttattcttggctaagccaagtgactacagtgcctgccaagcagtatataatattgtttgcattcccggaataggaatgtgatatcatcatattaaaaaaacccacaacagctgtaattcccccaccaaaaaaaaaaaaaaaatcaataccatagcaaattccatcaacatttttataattggggcacataactgatttacattcctgattaaatgatttcaagcttggtttttacaaaaaaattttcgttactcatgtggcagcaagtagttatcttctaaagggtgagaaattgtatattgactccacttagcttcaggccacctgtttgtaaacaccactcagtgtcatactgcagccctgaatctattcctcagacaaggctgcctggaagaggctatattatgtttcttgggccagagcgctaacagaaaaaaaatcctaataatttctgacttaatataacttctcagtatattaaaaattcagaaattggaaagggaaactttttatttctctctcttctctttctttctttctggaatactgtactaaattaaagagttttgaaaaaatgtgtcatcaagcttccataataaaatttaccttatgagactgcacaatgaatccactatccaaataagtataaggattaaaaaaaaaaaaagtacagtgtgcatctttcggtaggaattcctaaggagtgcaccgagtgccaataaatggaatatgtaagagacaccccatgtggattaccaatttccgataataaaaaaagaatagaattagacaccttaaatgtcaaccggactgaatgtgattaaatattttgttggtgattttaaaggcactgctgaatctagtggtgcctctggattaccatcaattaattcaccagccacccatttatgtatttattaagaaaacatggtgaggagctgtagcattcacaagaagcttaaggccagcacagtcacccatttctagttactcagtaatttagaaaaattctgaatactggaattttctgattggatcaaaaatgaaataataaaattggaaaaattttgctaggcaagattgttatacttcaaaacttagcactagactaaaaaatgaccaaagtgacactaatgtatgaaaatcaatccaaaggttgaacggcactgctgaagaaaaggcttaaaggtattgcggcatcttgttatattctttactagattctatataaaccattattctttatattaattatggtcaaagtgacctcctcttctgtctcctgtcttactgtgtttccatgggaacagataatgccatgcttaacttctttaagtaaataatctggagaaagccttgaaatctcttttaccagcctgagccagcctcagaaaaatagttagcaatatatgaaaaatgtaagttgttttgggttatgtcccagtaagctgacagtctgttaatatctttttcatgctcaggcaagatgtaactaaataataaaacattttaacatatcgtttctaacaatatctgtgtttctccagaactcttagtctttgtgtgtttggggaactctgtgtttaacattccccctccactttgccagatgtcctcctgaaatgctggaaggacgctgctgaactgtagatttccttcccacatgcaaagaaagtctttttcaagaatttcattggctgctacccaggaaggcagttgtaccgatagcccctgaacacaggagggcagaggcaggctggcctggcaaatgtcaccacaatatctgtgtgccttcaacggctgcctcctcagccacgatcctgcctcctgctccactaggaaagggagctgtagttatggcccagtgacagggactctctccagcttctatctgcttctctgcattctgaatcttcttgtgaggtgccttgaggcctttagaagctattctgtggcagagacattatcacgctgtgtactcaaactcatgcttctctttgtatagagcagtgttgctcctgagaggtgactgccctagagggtgccatgtgagcagtctcatcaatggagtgtgagggggagtgaggatgccttctgcacagtccctcagtctctgcctgctgctggaataggcttgggtctctgagtcaccacatggaggaaaggtgcccacaggcccagaatatctgccttggactgttgtgtgcccaaaaagtaacacttttttttttggttaggccatctttatacagcagctggtgttactctaacccagtgttctccaaacattggcctgcattacaagctcctggcgggcatattaaaacacacttttctgggccctaccctcagtttccagttcagtttgtctgggaggaagcccaagaattagcattcttccaagtcccccaggtggtgctgatgctgctggtgcagagaccacactttgagagccactgctcagaccgctgctcattctatcccgattcctaaactggggttgtggttggcttgtttggagaaatgcttctgaaagaaccacatgcttggcttgtcattctggttttattccttgatctccttttgtatgagccccgactccatgttctgcacctgggaaggcagccctgttgcatccctgtgcccaggtcccatgagctcagcttgccccgtgccctggctatctcctatggaagatttgggcaaaaggcacagtcactattctgctttcttcaaataacagtagcagtaatgggaatagcaacagtggtagtgacagctaatgatttttatgtgccaggcactgaggtaagcatattctttacacagtatcctttcaccatcatgaaaacatgatacagtcaatatgattattatttctattttccagatgatggaagtgagtttatgggagacagaggttgctggttggaggtaaaaggtgtggctctaggactatattcctccatgtaatgccaccaggctagcttagctccatgtaagtgccgcccatcccagagaaaggagtaaaccagggaccctactgtagtggctagtttgctcctaacagaagtaaaacattcaatttctggctctatctggggagtgttctgctggagagagactctgctatgaaagcagagaggatgatcctgttttaaaataaacatgcaggtattttctgcaggacaaacttggggatgatttatggagaagttaaactcactcttcaggaaatcttgaggcctggctggaaccacttagggatcctactttctgccctgtgtccctctcctctcaaacggccacactgatacccactaatcccagagctcaagagcctgagttgctaataatgctttattgagagagttttgtccatagacccatgctgatctcaggattcccaaagatccagtatgagactattcaccccatccatctgaactcacctatgtttgatttttaaggtgtctgtgccttcagttagaataaaggtgacagaaactcctctgcgttatgctgacctcccatgaactctgtcccctgagtctactttgcttgggctaatgaaggccaaagacaaggaccagtaccatgtcagaagattaacagaggcttggggtccttcatcattggtagcctcattctcagtggctgctgttgccatcagtgcctcccagtggccaggcacagagctggaaagtatcctaggatgacatctgccaacagccagtctcctgctggagagcctcttatggtaccaacaaagtacaattgatctgcttttcaataatacctgtatcaccactgatcaatcttcctcaaattgctcacggaaatttcttctgctacatttttgcaggattattattattacaacttagcattgacataacatttcatatgtgcagtgtgtattcgaatctgcacattagctattattagggaaagctaaacagaagcacaatgcagtgtctatttccatctttgtgtgaggccagcggaataagggtaatttcgggagtgcagggtaagctagatcctgttacgatgatggcttaaatgtgagtctggaggcacaatgggcagcaggtgactcaggaaaaaaaaattctctgctccttcctccagagagctcttcctgaggaagtactctgcaccagcagcagaactaggaggtgctgctgggctgctgccactatggagacttcacatcatgcctcatcacttttccatttacattactatcctctgctccgacccaaaaccatccccattttcctcagaggaaaataagcaaaggaaagagacatgttcacttcttgcaaaagcaggataagtctgtcatttaaaacactgttgaaggatgctctgtcaggtgaggatgcctttagagtcctccgggaaacacatcagaagtgaacgctgcaagcatgagctgagctccctactctaagccaagccggggacagggcagggaagcagagctctcagcccctgcccagcctggcctgcgcagctcccagcccagccgcaggaagagctacagatatggaacctggtagaaactggttagaagggctccaggaggggccatcctcacactgtgtagtgggagtcaaataagggagagaaggcttctggctggaacataagagctgggggaggctctttatggaaggcagtggttgagctcacacattgaaaagctgaaggaaagcagagtgggactgctgcacagtggacactgctttaccaaaagattcggcgatctccaggaggatgtgccatggctatggagaggcgagcaggctgcttcctactgagccccaaggccaggcaggagcatctcaggagggggcacttttccccactcttccttttcttttaattcgattttagttttctttttcactttcagtccctattttgatttccaagattatagggccatttaaaaaaaatcttctaaaggctttaaagattcttttttaggaaagtcaggcttagctaagccaagctagacaataaaatgacactggctttcaggaattgtaccccctcccctgcagacagtgcacctcccttgggtgtagtactccaccatgggcttggctctgtgtgacttcatcctaactgacagtagttggtcttggccaaagacagaaactttaaacagcaatccttccctccaaaacaactcctctcattttctcaccaatctacagtataaaagcagtgatctctttttcctcccatcttacaaatgtccttcctttttaacaagtggtcatttctaattttcatcaagaaactttccccttaagaagtgtatttcccctctcctgctctaccctctacatagaaacacacacacgcacacacacagttatattagtatttgaattggtgcttctaccatataaaacacatccacactatgaaatgtgaaatgatggccagctcaaacctaaagtatatcttctcagttctatgcattgctctttgcaaggagtagcatctttttttgtaaagtttttattttatagtgccaaatacttgcaataatgggttgaacagaaaactttttttgaaagttacttccgccttaggtaaaccctaactatccagactagtaagtgggcaccaagacttcacttttatgcttgggcaatgactctgcttgggctgtctctgagcctcctcctccccactgttctcattaccaacattgaaattgacttatgaacacttacttgtgtctggcaataggatagaaagtatctgcatcctctctaaatgtataaccaaggtgggaggacccagtatgaacaggtagctggcatcttgaggtatctgtaccactttggtatctcttaaatgagaaacctgggactcatcccagatgttacgaatctgagattctggaatggggcccagggatgtgcctttcagcaagtttctagggtgattctgatgcatgccaacattttagagccacctccctggcctttagggaccaggtccccacttcctaatgctttcttcatgactttcttctagtcttagatttctttcattagtttttcatatttgctttctttcagccttttccaacagctgaaaggaccttctctcctgcttttacaacccaacacagccttctgggcttctctgcctctgccatgtcttctcacattccattaacctatcggcctgctccttgctgaatgctacctcctgcctctccaggaatgacactgtgactgaatgcttgcgtaaatcctacaggcagtgtctccaaaacacattgtcctcaactgctcgatgttgttgtgcattacttttctttgcagccatatgtctggagaaagtttctgctatggcaggcttgtggcttgcacccaggagaggccaggctgaacctctggaactaattgcccttgaccgggccccgggaacagccttttcactgtgggagaggaggcccctcccatgtacacatgcttaccacaccagtctctagattcgcagaggcttttctccttggcgagtggccaggcatgcctgcttccctctctcactgctgacggatgagcaaacagttcctgtctattctcctagaggtagagaaaggcagagactctgtccttggcttgcatcaccactcatatcaggccaccctccacactttgccctcccttttcaagccgcccttttttccagtgaaccagaggatactccaaatgtgcccgacacagacctgtgaggggacttctccacctgggtctcacacgctccacttaaactacctccctctcacttctcctttctttgctcctttatcattgcctatgtcagtcacttcctgtccactacagatttttatactttactccatttttgttttcttctcattcccacattactttacctcacctcaacccgttttgtccttctttcccacctaataggtgggaaaagaggtaacctttctcacatcctcacaaaaaaagtttctgctttgttcattaaaatgatttgttttgcatttctggtgagtataatttttcaggtagcaatattttattcttaccagtgcctccttaaaaagcctttgcaagtgctgaggtgccagttaagcactatatgacagccatcatcctcacattacaggccagtggttttcaatcctttgtgcagcgaatcacctggggactgttttaataacaccgatgcctgggcattaacctgcggccattggtatgtgtataaagtttcccaggtgattctcatgtgcagacggggctgtgaaccacacattcacaccttctgctctacaccagcatcaactctccacattgccacagtgcctggtatttgcaaaatgccacagaatcccttaattgtttatttctcacagtcttattgaggaactctcaggatgagcctcatgtcattgctgagaaagctgaggcttggtgaagggatattatttgccaagccatgccagaaataaaaccaaggtacttcaagggccctctgacctcatctgctcaaagttactttttttttttttttttttccagagtctcgctgtcacccaggctggagtgcagtggtgtgaccttggctcgctgcaacctctgcctcccgggcttacacgattctcctgcctcagcctcccatctagctgggattacaggtgtgtgccaccacacctggctaatttttgtatttttagtagagacagggtttcactatgctggccaggctggtctggaactcttgacctcaaatgatccgcctacctcggcctcccaaagtgctgggattacaggtgtgagtcactgtacccaggctcaaagttacttctttactgtactcactgactctaaactccccctgccaacaacacttgttctcactcatagaggtccctttctcagagccattctaacactcttaccacccagatgagcctctcttccaaagagagtatcatagtgagcttggcagtgcttagtaaggcccgacagtggagaggaaacgcagaaggaagccaaggacttattttcggaattctcaatatttcagtgattcagatggcttcagttcacattcttcaactggacacatcatcacttctttttatccccagagttcgagtgccacaaaatcttgctttgacaaactcagcattagtcttggagtccttgggcagggaaaatgcatgtattttataaactgtctggatggataaattacagcaatttttccctgggaaagagttgttcagacatttaaaccctctatatattgagcatgataacctttctcacatccccacaaaaaaacagtttttgctttgttcattaaaatttgttttgcgtttctggtgagtatagtttttcaggtagcaatgttttattcttaccagagcctccttaaaaatcctctgcaactgggcgtggtggctcacgcctgtaatcccagcactttgggaggctgaggtgggcatatcatgaggtcaggagatcgagaccatcctggctaatacagtgagaccccgtctctactaaaaatacaaaaaattagccaggcgtggtggcacacacctgtagtcctagctgcttgggaggctgaggcaggagaatcgcttgaacccgggagaggttgcaatgagccgagatcacgccattgcactctaccctggtgacagagcgagattccatctcaaaaaaaaaaaaaaaaaaaaaaaaaaagcctctgccagtgctgaggtgccagttaagcactattaatcaaacactaaatgctttttaaacagctctacctttttttctaattgagaaacagagctgtttgggcaagtttatgaggtgaccttgattgaattaaagaggtcagcgatggaacagacttcaaacccatattcaatgatttttttaaaaatgacttccttccaattaagcagaaattagcataaaatattttgtttctgaaaggttaaaagaattcctctgagaaggcagctgtcttgttactagctttttattgaacatgagagggaagggactatgggtagtttcatctaaagtgctttgttaacatgacactgatgatccagcatcaattacaatattccttaggagcctaagtgttacgtagaagggtcaaaaagtccattttaaattttatttcctatttcaaagtccaagaacccaatgactttcaattactaagaaagaaagaaaagaaagaaagaaaaaagaaagagaaaattaaatcaacatatagtttatcatttgcaaaaattgcaacctagttctacagaaaaaagcttcagtcattacctctttaattcaatcaaggtcacctcataaacttgcccaaacagctctgtttctcaattagaaaaaaaggtagagctgtttaaaaagcatttactcatcttcctcttagccccatccttctgcttgccatagtcccccacattttaatgacctgaaagaacatcaccttcttcctaccaaaaagagtaacatacagagtgtctgatatataatgatggaagcagaattccacagaggggagggggcaccacacacaggtgatactttggggactactgggtgtgtctgaggcacagtcaccctgagagacacactcgacataacatagtgctctgcatcccacatatctacccctgccaacctcaaagagtcgagtggacgtggattatatagaggagagaggcacaggagtgctagagaaagagaaggggctctgaagccagataccagctatgaggcttagggcaagaaactaaacctccaagagacctcagggtccttatccaaaaaatgtagtcagtactgtgaggattaaataggtaatagggttttttttttttcttcaaaatgaaaaaaatatcccccaacagattaaaaattagttcttcctagttttaatttcctatccattcatttaacaaaatcttgcccccctaccatgtacaatgtagtgggctgggcattctttatgttcaagtttatgctctcacacttctttatgttagagtttatctactagtttttggctatgacttcggagggcacagtgggcagagactgtgaggacctgtgatctgacactattccaagaaaagccgaactgatgttatgctacgaggatttttcagaggagagaagcaaccctttcagatccaagtcagtgtctcagtctttcaagactttgttagctattctttccccttaatctggcactgtaaagaagacaaaggatatggtcccacacacattgtgagaatttactgaatatttgttgttttaattttatcactgctttgtattatgacattgtttaagacaattcgtggaggcaaaggattaagggtagagaaatggatggctttaggaggctcggtagataaactacactagaaaagtctagtattgcatgtggagacatttcataaacaactgactggtaaatcactacaagaaaaataaaatctctcatggtacttccaaaatatcttctaaatatatgttgtagattaagttgtgcctgaaaacttgtaatcacaaaaaaatcacaagtatcaaatataaacttgtatttattcagcagctcacctgatcattatttgggggtaccaaaattcatttttctcattaatttaggacattgggggaagggagaagacatattacttccaagatcagaatttccctgagtctgtgaatctcaagaagattgatattactgtagatgaggtccctcagactcttattttaaagctatattggaggcacatctcataaagaaaagcctcgggaatagagaaacagggagaggcacttcaataagtcttgaaattagatggtgagtcaataaactggtgatcctcaggtaggctctcccagaccctgggggtgcaaagaaaacatgggatgagatgggaaatcaaagggctgatattgtagctcagatcatttcagatcaaccatcaagcatgtgcctgaggtttgaggaacgtcttcatttttctctttatctttttggggacttatgaaatggaaaacatgggttgtgacagtgtgtatggttaccaaaggaaacacataacacagcagtgaacatccctatgcacttcacctcttcaaagcattttcttttcttctttttcttgtctaaagccatacagcagactctgctttcaggaaataaatgtcactcaattagcaaatgggtggtaccaatttccagaataatttttaagggtggcatttctgttgggatgggcttaaaaagagtttgctgggtgcgttgcctatattgaagcaaatctccttctaggtagtgggaaaatacagaaaatgacgggaagaccaagcagaagccccagtcggctttgtctggattaacattttaaggtaataagcatctccaggctacctttgcctctaaaaggcattatggcaccatgtacactgcaggcactcaaaatccttcgttgattttatttggttactgactcttatggtatcactgaaggcatttgaaagagattctggagtccttttcccataaaattcattggtgccataacagggtcattaacctgaaaaggagaaagctagtattgagctctaggctttccacttacgatcttgggtaaataacataacttctcatcattgccaatctctctgtgggtaagaactcaacatttctgcctggtttagaacttgaattatttcttggatccattatttaatatttataccaatatgattagctcttagaataagaaattataagattatgtggtctgggaaggtaagcatattatggtgagttaaatgtggaaattccctaatttaaagcaaaagaaggcaattcaataaactatcattatctgatactagttactattccttactattcttgactttccagaatgactgaaaatgtctagggagtattcctcaatcaacatggattttttcatagattctcctaggtaatttataaattaatatttattgtagttttaattatttaaataatacatgcatatattgacatttttgaaatgcacagaaaaaaaatcacttgtaattacaccatctggtgataatcagtctgaatattttgacctatatcctcacagattttcccctaacataaattgtgaatataacacatacacacacaattggaattatccatgctggtttgtaactgcttttatcacttcacaacatattgagaactttctttcattccattatatagtctaaaccatggtttctttcaagactgctcatggatatacattaattaatcaataccctagtgttcaatgtttagatgtttctaaattaattctgagaactgataatttaggtaactgctttgagctgcaatgaccagcatgccccaagtagaaagcaagggcctttgggacacagcagctctagaacttaaagggggctcattaaagaccctgcaatgccctgccggaaatgctacaattaatagactctgtcttgtaacttttgctccagaaatgttcttcctacttctctgctagtgatgggagtctaaaataaaattttctttctctagccacttcctagaaggcttcacacattgtgtcctggaactggggagaagagttgctgagctcttgctccctctttgatatcaagagcattcagtcaagtgaaagagaagggtctctaagccatttagatgtgggagagcttactataataataatttcctataaacttcaatttccagggcttctaagtatcatataatggcaagtagaatttccaagaaagggaaggaagtacttactttttaaattagttatgtggctcttaactacctacggttactagaattctacaagacatcatcctgtcttcattttctgtgttcatgcagtatccctagcatcttcaagtcttcgattaacgaagctcatgtgcaacagtgttaggagtcaaggtataatagctttatgtcacctactgtgttttgatgaacaatacagtataaaagcagaggagaattaggacaatgatgttcatcaacagcacatcactgtgctaagaggctggtaacagtgtatgttttaatgtggcctagtactgattcttttggccagtgtcctactttaacaatgttacagtcacacttcaagatttcagatggagaggtagagaagaaaatcaatagatactatttttccactaccaactggcctacatatatatagcttctctgccatactcacattcaagggacctaaaagatgcctttggaaggtctggcccagttaccatgcttttaataacctcaggaatctactctgaccacctcaaagattttagcttcatctctcaaaggtccacaggaaagagcctatgatccaggaagaatacaaacttatttgttctctattttctattccattaatatataaaaagaaaacttttaacaaaggcttgcttgttacacaaggactcttgtctgaaaccaaaatcatgtagaattttattcctgagccttaaaaaatacacggaaaaatacttatgtagttaactgtgcaaaagaaaaaaattagaagccaaaacattcttctgtaatgttataacacaattttgttttcttctttattcattattcttagttgttaggttttcaaaaatgaccaggtattatttttattcaaaaaacaactttcattttttaaaatgttacatgctgctagagcgcaatgaggtgacctactgaaagtgttttctatgagcatctgctagaatcacaggtgagcatttgacaaaattcatcgatgttgtaaagggtaatccgtttttcaaaatcagagattcctgagtattgcttataaatgaaaacggaaaatcaggaataaattctactgaagaattctctcctgtgtttaggaaagaacaacaacaataaaaagcttacaaagttgcccagattctgtcatctaaactccttcaaaaaatatcctgattttttctagaagttgtgcaaaccgcacttaaattccaacaacactgtgttaattttgctcaaacgcaagctgaaaacatattttaacatcctgtcagaatgagatactaagagtgtcgataaaatgacactaaaataaatgtaaatttggattgctgttacaagtggctgcttggctctgctaagacgttaggttgctatagtactttccatagcaactttgcatcttattacataaatattccctcagtgtccttcaagcctgctacagaaacaggattaaatccactctcctatgtaatgatcctgcatcaaaccttaccggaatgaaatgcccagaacacataataaactgtaatgtagataatggtgttcctggcagtcaataagcatcagggcactttgggctgcacacaggcggcggtgcagtgaccctgtactactccctggtcatgcgtcttaacctttcccaggtcaaggcgtcagtggctctccctttgtgaagattggttgctcatgtcctcattctcctcctctccctgccaactgcccatcagctcaagccctccaccaggctcaagggactcatagcactaagcaagaagccagggcctgacaggagctgggaacatgctgggctgtcatgcaggaaactttgtggagaccccacccaggtctaagctaggatcaaacaggtatggattgtttaagaacttcagctaggcctcagctgaatttcaccgaggtgtggcacagttgagtagttaagagtattagggaaagtccttggtcctgtagacaccaatgtcagcaacacagattaatcttacataaaataccagattatggaaagtttgtgcacatatgagagagatgtcaagaatcatggcattgataggtgctacataaaaataggattataaaggggctaagcttaaagacagtttaggctccaagtgtgaatttacaaaacaaacacagtctggttgggcagaaggagtgcttccattgaaatggaatcttctgctacaggatcaatttaaatagcatctgttttcctgcatttaaaaggtgaagcaatttacaaaaaaaaaaaaaattctacacttttcagaagcatatccattacggaaagggaattgtaactgcacatgaaattagggaacttaaaaatccacccaaaataaatatttatttgaattccttgggcaagattagcaagattaaaagaaaaaaaaaaaaaggaaagaaacaggaaagccttggctcctttgcaaatgaaactctgtttagagtttaggaagaaagcaggctactcagcccaccttgcaagatttcttttatcatctttaagccacattagttctgattcatcacatttccttgtttggcccccttgggttcccagaagagaaaatgcttgtctttaattcagtggtcagtgatggacacaccccactggtctatttctctttcaggagatggtgccctcggctgtcattacatgtgaaaacagcttatccttctatgcttccactcaacacagacacccctgcccttggggtctgctggcgcccggagctcagatcctggcatgtggcctcagactgagccatctcactttcagtgtctgaattctcttgtccctctgccaagttctgagccaatctcgggtgagcctgctttcagttacattcagtgcttcctaaaaggaagtttctaccagtgtgaatgacagagccccttgcagttggccccttcagtcagctgctgcaccctggtctggtatttagtaaccctctccttcttctgtgcctggctggtgatggggtaacagtgagcctcttcttaagcttgtgcctgattataatcttcctgatgggcatttttaaggatctttcagaagtactaccacccagaaaatacttaatcagaaaaaataggttgtcctgctattcaaagaaatcaatgggatggtcagagagccctattattattatttttattacttattttttttttaacataaatcttccagctacatatataactattcagataggctgatactgctagttccaaccaaacctaattatgagttcctaatttgatttagtggctgaaagatttggaaagtccttgtttgaattcttagtgaaattaaaaaaaaaaaattccgggccaggcgtggtggctcatgcctgtaatcccaacactttgggaggccgaggtgagcggctcactaagtcaggagatcgagaccatcctggctaacacggtgaaaccccgtctctactaaaaatacaaaaaattagccaggcgtggtggcgggtgcctgtagtcctagctactcgggaggctgaggcaggagaatggcgtgaacccgggaggcagagctcgcagtgagccaagatcatgccactgcactccagcctgggtgacagagcaagactccgtctcaaaaaaaaaaaaaattcctttgtacctatgttatggtgaattttcatgaaaaattgacagctcagaaaaacactcttcataatttagagtgtctgctcctataaggagctcagagtttaaatgaaatgcagttaaaatccaaaaacatttgtttgtgtattatggaaaggcataatgattgtctactgagcaagggactttttagttttactcttctaacatttgtgttcaaagtacactcatcaaatattgggtgaggtacatacactatgtagtgatgttcattttggtttataataaatttaatttaccagctttaggacatccctaatatttttaactgaaaacacttttttcaaatgagtcttacaccctagagaactgggtaccctgtatctaactaactctgtgtgccctgggtccacagcaccttggacatacaaaatgtagataatcaaaacagtgctgggttaaagctctctgggccatggcctgttcgccatgtgacactgaattttgtacgtataaagttctgaacattttgtttgaacatgcctctttaatacttgccatttcaatttaattagagcaaatgttctcagggttatcatcctcctatcaacttctgggacaaaggcatcgaaaacattaagatcagaagaaggggaatatgaattgaagtccacagacttttattgattacgtacttggggaaaggcccagggccacgtgttggaggatgactaagataacaagcagagttaacatttattgagtacttactagatgctcaacactgtaagtaaagtcagaagtgccttgcatgcattgacttattaactctcacaatactaaaacgtatcgggttttgccatctgaggccttacaatctaggacagccttcctctttcctttctcctttttatttcttgcgaacgctatcccgccccacagagtcaacctggagggagagagggaggaagggagtggaaaagggtaagggagaaggagagagggagagagagggagggaggaagagagagagaaagagaaaaaggaagaacagatctggattttaaagtctggcttcatttcagtaggaggcagactaaacaacaataaatttgaatttttatcaaaaattatcttcacaggcttcagagcaggatgccgatcttctagaatgaatgcttcaataaatctgtcattatttttgaatttattaacaaaattgattttcatttttatcagcatcttagttttgctccagtgaactccttttcccctttaagattcaactgatcaagaagagtgaacaccccacccagaattctattgtagatactgcagaattatagccaaagacatattgcaaattattatatatggtaaaaagaaaagtacaatgaaatattcttcataaccaaaaagcagagatatattgaaacattttgattattttttaaaaagtaaacccaaggtatcatataagtccttacacaataaattgtgcctttcctaaaaaccaaacaagtcaattatttccatctcttccctgccccccaaaataaaacccattacagggtactttttgtcttagtatggagatgacaagcaaagctggccctgggggaccacagacagagcgccctgcagtgggtgcagcctcagcacctcctcccggcacaggcaggtgacaactgaaggatattctcttctggaatttccaagaattcctgggtcagctactacccaggaggtctgaagcaaaatcccactgtttaagcagagaggaaattggcaggggattccttacagcatggagaatttcacttccattacagcactggcaattcccctgttagtgaattagagtgctacattttgagaggactgctcctatgtaggtgactggcagatgcaaatgtgtacctaaaaacaagggatgtgtcacccaagaagataccgctggaaggtgtttccctcgggctatggcctccatcctcctgcttcaagcaacagttagcagggatttgtctgaggtttgaacaaaagaccagatgggaattcttgctgtcaggctgtgtccccaaatatgcagggctgaaagaaaaacaactgcctgcctttgggccagatcttcagggccccgtggaataaaaaaggttagttgccttcctttccctttaatcagtcctgtgctttcttcagaaaccacatgccacattctctggtccatctcgttttgaaaagcacgaaaagactttgaactgctcggggcctggcatttgaactccggttctttcatctcttccctcagaacttggcatacaacatgccctgcactttgctcattaattctgctgaccaagtaacaagactggtgaaagttttttttaaaagttcaggctctacttcacgttctcatcagatgcctggggaataaaccgagagaggtgtcgggggatcacatctccgtcgatgcttctgcagcagaggccgggccccgatcctataagcatgtacgtgccgcaagacctcagtgagcatactattcagagtcatcattattctggtcctatcctaagcagactatgaaattatacacaattcttacttgggaaattgacaagttatttaaaaagaaacatcaccaagacaaaacaaaaagccacaggttcaaatgagaatttctgactgatgcagttcttttctcctacacctaccttgtcaggatattaagaatccaagtttcatgtcaacttgcctctcatccagaagcttcacaaaggatgaaagcgcttttgacaaaaaaaaagtttatttctttatttgaagatcttgttgaacttaagaaattcacacaaatccttgcccccttcttttgctatgtgaaggtttgtagaatagaaatcctgtgaggaaggtggtctcctcaaataaacaaacccaagagtaaagcagtcctgaggaatctgatctgggcttagcaggagacatacatcattgacacataagtgctgggttcatttttcagacaagggatatatggcttcagaaaatagtggcatggtgcctacttgtatgttaagcacctgaaagattaaaatgaatgaatttgagggtgaaagggaaagtttctaaggcagtggttctcaaactttggcatgcatcagaatttcctatagggcttaaatcacagattgctggacttcacttccccacaccctgtagccactagacgtttttgattcagcaggtcttgggtggggcctgctaacttacatttctaataagttcctagatgatgctggtgctactggactgagaaccacacttttgagaaccactgctttaaagaaattagagccctttctctatatgcctgtaggcaggagctttttcttatgaccatcactcgcacccctacattctcttctacagccctggagaaacagagcatcctgaccactttgcagtcttggtgacctgatccttttagaatcttgattttggtttcttaataaattagtaaagatcctcgattcctggtcacctgcaatctttctgttaaaaagtctctaacaggtgtatgttttattcacttatacacatgaggagacagatcaaatctataccatctctgtaattttcttttttgggaatgatggcaattatggttcttcctaggtccttcggacaacacccttccaatcagacaagcagtctcccttggtgtctcatgttttgaatgagcttttcccttgcctgtttttacaataccaatggatttatatataattcaatgagagcgttttaaatcagcagctcccattagacagagcacacaaagcaaggttctctctaagtttctcttctttgtacaacctaaggagtgacacccctagcttggtaccaaatggggccagccttttaattacagattaggtgaaagaacatttatgggaaaagaagtctaattctccagcatcttggctcagaagctagaaagcttcttcagggattaaacaattcccatgtaagaagtacactgactaaaaccaaattttatccatatttttagcatcagctgtggctgccgtactctggaaaaggattttcatggaaacaggcaaatatccctgaaaaaagcttaatggccccagatctacgtacggagaaacaactggagcaatttaaatcactctgttcccaagaaggagtttaaagttctattaataaaaagcagagtcactcaaagatgaaagtttagtataattcaaataaaagtgagttatagggccatttacttattccccatctgagatttggaagatcattatgatacctcatgggtctgtggcagttatcggcattacctgattcatcgactctcattttctttgtagggctgtcacagttctcatcatcagacatttccatttcttcttcgcggcggatgcccatgagctgctcactttgagcattccggagctcctgcaagtagaggatacacaaatgtcagagtcacagacacatatggctttccccaatggtctttgggtatatatgactggcatattaacattcagaatccaaagcttttatctcccaaatatagcctcacctaacctaaaggaggttctgaggggtgtggggtacaggggagactgaggtcaggcttagattaatccctgctcacccatgactagggctctttagcaaataatttaatctctcttgagtctcaatttcctcatttgtacaaagcggataataacatccacctaatagggctgcaaagattacatagaaatacctgttacatggctggcacatgtacagtaaggacttagaaattatggttaagaacatgaacagtggaattttaaaatggactgttctaccactgacccacacggtgtgacattaggaaggattcttcatctctattaacctaaattgctcactggaatattatgattaaaaatagttttgaggatgaaatgagttaatgaatgtacagtacttagcatcatgccagacacttggtttgctcagttgataatgctggacattattatttctcatgcaaacatagtgcccctgcatgtgtgtatgtgcccatgtgtgatcacatacacacacaggcacacacacacaccattcagatatccaaaattcaaaattagtaagatgttagggaacaaaacacaaacagatgccctttctttcgtattgcacacggtcatgttggggttactgtttttgttgcaatggttgctttagcatcacataatttagagccacagatcttaagatcacaccttactttctccatttattaggggagtgactacaatcaagttatttatttgagactttgtctagtcactcacaagtgaggaataataatacaaggctgtttacatgtagtagcatatgtgaaaactcattgtaaagattaaagaattacacaggaaatttcttactactgtgcctaaaatctgaacattgtaatacttatgctaagtatttatattattattttgtatcaagctgtatattacatatttgtgaattcttccttattcattctgttctcttacatgtactatcttcagaaatacttaaaacaggggaagcctccattattctttttccctctgtaaagtctctaaataaaaatcaaatagttaaaataatttcatgttatgatcaataaacatatgagtaataataaaactaaattactacaactgatttattaggggcatgacttgtgcccatttgatggacatgcatatatcactccatgttatgggttttctccattcttttctctccttagctcacagattttaactacagcatgatggagaggaaagtatttattgctaacagcatttgaatggtcaactctgtaccctgggaatcacccttgcagaagacagggaagggagaaagcagagagacaaggtccgaggtggggtgcaggggcaccaatcacaggcagccctgagaggccagagggaaggcagacaaggctcctaatttgattatgccacccagaataaacaggtgccaattccatcttaaataacaccatcaggcattggaggtgggtgtcacatgtgattagtgcggaaatttttaggctgtggacagctaatttttctactgacaaagagcccaattcccaaagaggtggcttaacacttgaaacaaggaaaagtcaggtggaaagaataaatgaggctgaaagggactgttgtttagtccctgcgattaatgacaaactgtcatatggtagttgttcttgtgggaaagggtggtggaaaagaaaaaaaaattgaggaaaaagagctgagggtgtttccacagggtgcctctggttcagcattaaatcactagtacactctaataaatctgtagaggtgttgcagataattaacagatgctgtacatgggaatgtgggaaaaaatcaagccaattatcaagcttatacgcaactgagaaatcatccacaatgttaaattaccaactggtatttaatcaattcagcgacatgcaagagaaaatcacagctaatttagaattctgtggcctaatgtatatcaaaagaggtggggaaagtagcaggaaggcaaaaagacccttcgcaggagcacctttgacagctgcactccatctgtccttctggagcatcatttctgtctcctagtaccaaacaaagcaagcaggctccttagacctgcatggaagccttcacacgtcctgctccccaccacacccacgcagaggaggcagggttaagcgaaggtgagaagttgaggcagacatggcaggaagtgtgattcagatcaatatgtgacatttgctgacactcacattctaatgatggcctttttatgctcaggtttattcggcagcaggccaccagcctttctctcaacattccttttaatcatgtttggtttttatgtgaaaaaataaataattcacagactgatcattcccaaatctgaatcatagtttatggactccaatttgtgttttcataaccctcagtttgtctactgcatcacaaacagaggactcttttttttttaatcttgaaaatcagccttgacctcagtcttaagtcagagtcagggagaacatcaggtaagcacccttcatttttctggcccctgaaaaattaaagagaaatcccacctcttccttactcataatcctgaacagaaaaacagaactgtatcagtcaccaaccaccgtaggcattagtgaacaaactaaaaaatgtccttcttaacaataaattgcactagcattttaagtgtcacattattgtgaagtcattcggtattcaccataataacagtgataataaagaattcatttggtattcatgtggatattacatctagtgctattggtattcaactgtaatttagcattagttaatgggcacttaaaatgctacccaaatgattgatatcatagtactttgtgattcctcaaactctatataaaatacttattttacaagtgtaagccaaaatcattaaataaataaaccttaccttccataagtttgggattttgaaagaggggaatgtcatttagagaactttaatattaacatgctagagatggagaggcatccaaatgaaaaacattctttcattaaaaaaaagaagcaaagacagtatacttacttttaaattacaggttcaaagcgtacactactctgtggagttaaaaataacagctggacgaccagtgactaatgacacattttggtccttctaagtggcaaggaggtcaaattctagactgttctcttgggggtagatactcacttcacacatgcatggttgctgatgggtggacccagttggcctagatattcactccccttacaacattggatctggagagaagtgtaataggacttaatggctagcatagggactaagatgttgcttatgataagaaaatatggacggaaaggcgtacttgtccaaagagcaaactgtcatcatcacgtagaacactaaaaaaaaaaaccctctgtatttaaaagccagttttctattgtaagctccatttttcttcaaaataatttgctagggaaagtgtcttggtttatttctgaaatctttactatgaatgggaaaaagtattttctcccattgcaggggagaaaaacactgtgttccctaagtgttaagtcagctgcttttctggacaaggaacaaatctcagctgcatttggagctgacagtgagatcagacaatggcaggcggactgcccactataacagaaaccatcatggctgcagccatgctattctctgccaatccagctgtgtgatggtggttaaaaagtaataataaaatcaccaacctcagaatgctttcgccaaatgtctatgttcttgcgctgggctttcgagaaatggtcccaagctttttgtctggtagaagcgttgaaaacggccacaatctgctcaactttggtgaacaaggaagtcaaacaagacaagtaatttatgttgtgatcactatagggaagcaaagcaaagacactaggagtctatggatgatgtcacaatagaaacaacatcatcaatatccatccaatttgtgcctttcgtacttacattttagcaaggttggggatgtctcccttcaagtctgtctccacaactttaggttaaaacaaattctaagtatgaccgggagaagggcaagggcatctacttccaagcattctttagctgttgtttcaatatgtgatttggtctatctatatacctagatctatagatatatagacactggtgttggcatccagatatacagacaaagtaatgcaagggttgggtgcagagaagtgaagtcagggagaagtggctgaacgaggaagagccaaacatatcattttctcttttggtctttatctcaaggactcaatcacagtcctctcaagacattatcatgtccaagttccaaattgggacaatgaatagccgtgccatgtctcccctcaatctcagggggccatttttcctccttggctcctttttcctccccctgttgcactgactgcagccagccctccagccctctggcagggaacaggaaccatagcctctacctcaagacagaccaaagctcacccaaccagtggcactggcatgcaggtcttatttcaaccaccatatggcaccctccatagctcctcatgatcacattccattatcactttcacaaggctccccgccctctggctcccagaccacttgaagttctaactctattatcttgacttaatttagtacttctgctgctttcaggcctggtgctactggactggtaaatgttgaggggttatgaacaaaactacatagacaaaggcatgggctcttagtagtgggtattatgggtggagccaactaactgtagacttaatcttgcttaaacagttattgatccagtaagcatgagattaaggaaattaaagcactaaattaatcatatgattaaacctgaacttctaaatttttagttaagaaggctcagttaaaattagcttctcaaggattctaacaccccatcaacataaatctttcataagtgattcccaaggctctattataaaaaaggacatcaaagctcttccaaatcttctggtgtccaaagaatgtcaaagagcaatagagtaatccccacagaagaacaacacttggtgccataatttttaaattagcacacaaaataaatgtatgatggagcagaaggaaaaaagcagattccattcacttacaatatcgtgaatacttttctatgctgatgaacaactacttctcaatctatggctgattttcacagagggcttttatctttttgctattaatatttttactattttccacttcaggagaatcccaaccccaaatctccttatttagcaaaacctgtcatcatgtcacatgatgaatttatttgactcaattttaacaggaggatttgccttcaatttgtctcatactctccttgggcacatgtggcttccctcctcgacctcaactggaagaactaaactccagactaaacacctggggctgctctaagtgctggccatcagctgaccactgatccttagtgctctggttggctgtcctgcagcacagctggcagaggagagaacctgttccagtggatcaccggggctttctgcatgttttgtctgtacacaggctgggatcattgggaatttcagctgccttctgtaggggcaacacagaacagtcagccccaaatctaggctggcaggggtggtgatcaagaggttattaaagagtaatgggcttcgttgcttataataacatagctctttggcatcatttagaagaggaagaactatgatgtcctgacaccagtcctaaggggaaaggacaatatgggttgagactgagtgtttggttggtaatagtgaaaattctgacatcaatcagagaaggctgttaataaaaatgaaacactaaagaaaagtatatctgttcataaaaacgtgtaaggggccagagagaatgaaggtaaggaagactagtaatgcacctggaggagtacagaaaagaaagaactaagaagaaggacccaatggcccaatagtgcacaggtttaggggtaaaaggagatcccctaatatctactcaagccatgtgctattagatatttcctgtttgtggctaagtgcctcggttacttagaacatgttattaccatatcccaaggcataagttcagttcattcattcattcaacaaacatctggattcctgttagctaccaggaacttgattaattgctagaaatatatgatcaaggcccagtcttgtctttgatgcaatcatagtctcggaagagaaagaaagacaagcagataattatcctgtgcaagagaggtgcagatgacagctttgaagacacagagaagagaagagagtagctaagtagataggtggcattagaaaacattccacaaatagggcaacatttctgccaagtcttaaatagtgaagcaatgcctgcttggcagagaaggcaggagtggcctgttcaaaggctggtatagagttgtgggaggatgagtgaaagtagctgtggggctggggctggggctagtgttaggtatgaatcaagagagaccatgtatgctaactctgattgggaactttatattgtaggattggcttgggagaaattacaaaggaatgaattaaggcagaggctctggcatggagtgtggcacaggcagtcatttgacagggagacttgataggaggaggcagctgacttgctacatgggaggaggaagaggggtgcgaggtaccacgatgactggagctggtaagtacatcccaaactatgagaacaagcatcggtggagggctgagaaagaagataaggaatttacttttggacgtattgagtttgagatgcctgaagaccatccaaatggagctgaaatatggattaggggttcagaaagaagtcagaattcaaagagatatggccaacattttctgggccattctccatttcttgtattctttttcaatagggtaattaattagatgtaaaactaagtgggatttaattttatacttatgaacttatacactttttttccctataccaatcaaaaagcaaaacaaaaacaaaacaaaataaaatcccacaaaaccccaataactgtgtaactcaggtttggaaaccactctcacagtattcacacggcccagttttacctctctcattgctgcacacactgtccctgaaccagccatttgtcttgcaaatgaaagttcctgggcacacacgaaaaaggactctggaggagtgctttcatcagcattaattcatcatcattagggaaaaagcacctctaagagtatgccctaatgaatgtcattcaaagacagcatacttttaagctcataaatcaggatgactactggtattgatgtaaatacactattcattgcttatagcaggaaacaccagagaggaagtccatgaattagatgaccactgactacctctctggtataattcatactacttactctatctatatacaataaaacctgttaagaagttactatcagaacaggctcttcaaaactttgcttctcagagaaagatataaccagcaaacaagatggcattggcatttgttcaaagcaagtagcttatagaagttgtgctgcaggcagaacaaattgagacctactccctacccaatgccttcaccacctcagtggtccacagagtggtggccagaggccccacacaatcctgtatcagataaaaagcatagattctgtttgattgccacttacttattcaagaaagtatactcaaaagttttgcaggtaaagggaattttttttctttgagggataacattttcccaaatcttctattagcaactgaaagagctctccatcagaaaatttaaatttacccctcacactttgcaaatctttcccccccaattctgtgttttaattgtttgcctaaattaggttatttgaggatcataagaaaattaaaaatgataaattcttcagaagtatgcctgaatgccagttttagatatcacagtagagcccctagtatacccagcagctgtaaatgaccttaagggcaggataaacagagccttgatgaagttgctaatcactccacagagctgcaaaccctcactagtggttattcattagcttacacatatgtatgtgtggagatacatacacgcacctagcatacacacattacacacatatatgtatatattcttccaattttaaacaaacccataagactaatttaacaactttttttgcacttttccccaccccaaaatgtttggacatttgctgagtttagagcacacttcttactgatagagaactttacagactatcatgagaagcgctggtcttcagccttctctgggagggaaagctcagaacagaatatccatttatccaggaacagaccacactgaagcaagctccctgggaaaaagcagccactgggtgcaaaagctcagatttctgggctgcacaagactcctgaatttcaagctctgggcaggaatgcatgggagatgaaagagaaaggttagagtcctctagagaacacgaacacagcccttttcccttcatgtcttgccgactgccttctttctcacaggccctgcacctcttgtattccttgttccagctaaatagcggtgaaagagccttaatccagttagtgtcccaaatatctggagaaactgatttagtccttaaaggcagtaggcttgcctaaataaagcacctcaaacaaatcttccaagcttagtttttgttttttaatgctatctgggctcatgttagagcctcaactctgcagggtacacaggacatttttctttttttaagggataacattttcccaaatcctctatgaatagcccatgagagattttcaaagggatatgacacaaatgaaataggtgacctctcccaccccagcttgtttttgttgttttaaaatactaatagctaggggagaagggacagaagaaaagtgtaaggctttagatgtagtgctggaattggtgagccttggctttagactgaagaattataatggagggaatgcagtaagcgattccagctctcaggatacccagaggagcaagacaaggtccaagggagaagcggtatgtgtcggacagcacataagaggaagctgctgctataaaagagattcccagacagactcctgcacattcactcgggttctgggtcctgagcatgaaggagctggcagtcagcctggcagaaagcccaggaaacagagaatgaatacggtcaaacccatactttaaggagggatggaccggaatttcaaatagaggaagaaaagggcattctggggttttgtcttgagatatgttaaaaaaagcctcacatgacattgtgagtccattacagcccacttaaaactgaggccaagacaccaacagcagacatcatattactgaacttcctggctagatgaggccagatatttgttgcttttagggcagcatccccaacgtttttggcaccaggaaatggttctgtggaagacagtttttccatggacagggggttggggatggtttggggatgaaactgttccatctcagatcatcattagttagattctcatagggagcatgcaacctagatcccttgcatgcacagttcacaatagggttcacgctcctgtaagaatctaatgccgctgctgatctaacaggaggcagagctcaggtggcaatgctcactcacctggtgctcacttcctgctgtgcggcccagttcctaacaggccatggacagtactggcccaggggctggggacctctgttttagggaatggaatttgaatagaataaagagaagcctactgatcacagtatataaaaaaacaggatgttttaagcaaatttcaagcaagcaagaaatgatcaaattgttcaaataaaacagaaagatattaggtatatagtgacttttaaagatttgcatcactccaagtatactccagggaattgtagagccctttattaatgcatatatttaaaaattttggaaagtaaagcaatacatgagattataaatctaatagttcctcaaaatatatagcatttattaagctttttaaatccaataaatctcctgcctagattacccctactgactaaatgaaagtaatgtatatacagaagaaaaaagggacgatataaaaaaaaaagtctaccttcccatcttgacaactctaccaagttctctttttaaaggtaaccagtaaccactattaacagatcctagcacatccatccagaaaataaggttatgcatatagtacaaacagtgtgtatttttctatgagaaaccttttttacttacacaaaggtgctaatattatatacgctattctgtaccttggttttttcacttaatatatcttggaaatctattcatatgtatgttatcaataaggctgctataaacatcttccaacatatcttctgaaatccttacataaatatctttataaaaaattcttagcagtagaaaggctagataaaagagcacctgaatttttaattttgaaaggtactggcaagttgcactctatgtccctgaagtgtttttcagtttgtttctcttaccctttgccaacagtgcataatcaaatttagcttttgccattcctgatagatgacagaaggcatgaattacatggtaaccaattgtctgcaccagtgatatgtatgtttgcagtttccattacaaataacagaaacaagtccagactcattgagcctgccctgtattcagttgttggctcgatgctaagtcatcacatagcagcaggaggagagacctggtttctggggatcttttcttctttgtgaccctcgaaacggcaaccctgatctcctctgagtctctactaactcccttagtggttatgaaaatcatataatggtaataggagatttctttctttttgagacggagtctcactgtcacccagcctgaagtgcagcggcatgatctcggctcactgcaacctcagcctctcgggttcaagtgattcttcagcctcagccttccgagtagctggtattacaggtgcgcaccaccacacccggctaatttttgtatttttagtagagacggggtttcaccccgttggccaggctggtctcgaactcctgacctcaagtgattcacccgcctcggcctcgcaaagtgctgggattacaggcatgagccaccgtgcccagccctgtgataggcaatttctaattacttagcccttactgggctaggcactatgcttgatgatttaaaacagtagttatcaaagtgtggcccctggaccagcatcatcaacatcacttgagaactcactagaaaggcaaacactcagactccagacctaccaaaggtgaaactctagggatggggcccaacagactctgctttaacaagctctctgcatgattccaaggcatgctaaagtttgagaacctctgattatcttacctaagttttgcaacgactgtctgaggtaggtgctagtatgaatgcccatttcattgatgaagaaactgaggttcactgagacgaatatttacttgtccaaggtcatatatttagcagtggtgaagttggcaatggaaattacatctgtccaacttcaaatcatgtatttatacccattatatgatgggccaaagtcttatgagctctgtggtgtgtaatgtgctagactttgtactacacactggggataaaaagggccaaatatgcagctggtccttgagctgctcagagtccctgggggagacaacatatatatgattgaatcgcaagatgagaattgcttaagagagctgcagagggtgccaagggaggccaagaaaggcttaaaggaccccttggctgaaacttgcagctaagttgaattttcaatgcaaacaagccaaacattggaggttatgatggagcaggaagctgcatttacctctctacaaaagtgtattgaggaacatgagccacagtgcagaagaatcaaagtgtctggaaaaaaagtccctactttttttgtgtctaccaggctggaaccaatttctctcagtgtgtgccctcagccttctcattttgtctaaaatccagtctgtcctactttttttgaaataaaagtcattgaataagcctcagcaggggaaacttacagaagtggggccaagggagtgtttttatgaatacaacactgttttgggggttgcatgtagacgggaagagagagttgggaaatctgtgttggtcaagtcttagctccatcgctaactagctgtgtgacctgaagaaagtgtccatctgtttgaatcccaaggcaaagggggctaggctagaccatcctgaatctcctttctggctctgggagcctttagaacagggcttagcaaactttataaggaaaggaacagatagcaattatttttggctttgcaggtcatacatctaccttgctatagaaggtgtctacacacataagtggtttctctccttaaatagaaatcctctcactttgtctgtggctactcttccatgattctccccaggtacaattttctttggttggaaaacaaacactaagttgtacttctctttcagttacgcagagtcaagaacacatcatctctgctttaaagtaactttactgacaccttacttttcctcaatttgaaagtgtcttggctttaaaaaatctttgtaaaaattttttttatgcatggattttgtccagtgtagctcagagactgtttcccagagtaccccaatgctatcaacacacattcccctcgcctgatgtggggcagtggctagagtccagtcctagacctgggctcatatcaaagtgacagagttttcatctttagctcccagaagttatacctttcctgatttgctgaatttcacttaatatgcactccaattctttattgttccagagtgtaagacttgatttctatcttacattttggtattattaaagatttttttaaaaaaacataatgatttgactcagtgtatatattttccacgagactgaaaggaaggataccaaaaaaaaaaaaaaagaaaagaaaaaaaagactcatttcagttctggcaggcatagtgtcctccaccatcacctttggcatcctgtgaaacagaacattctgtgctcatccttgatgctgaagtttttatacatattattttctctggatatttattccctgagaccaaagaggtatttttttaaatggaaataatgtttccagcacttaatgcattggcaaatacagccatcagtacaattttgaggagaaatagaaaacctgtcacattgctaaagcagttatggggaattttttcccatggatgaactacagcaatgactgctacagacatgggcaaacattttaacacttcataaaattcctttttgacagcaggggacatagaagccaaatttcccttggtggaaataaaaaatgtttggctgagatgttcctaagaagtaaatgatttcagaaagagcttttcaggcagaagaaatgtggacgaggacaccaatctgcctaaaagggggatcacagtacacagagatcagaaacccctcacatttcactctagcacttagcacacaacttgacacttgataaatatttgtggaatgaatttaatcattcagacacttgaggcttttacaattttacccaagaagatagatgagggcgtgacagtggagaactgtcagtgccctgcgcagctgtctttgacaataattctgaccaatcttcagcacctgcagaatgcaatgcacataacctcagggttgaaatgtggcttaaaattcacagtgtagcccaggaggagtaaccttcacagcaaggtataggcagaacatttgcacagagtaatatctgattgcctgttctatgatcactttaggagctttgaacctcatggttgggtcctggaagatacctgtatttagatatccagagacgataaaggatccacatggttgacataagaactgtggaatcttaagggtggaaaggaactttaagggattactggttaaacccttttattacagagatgagaaaaaggagactgaagttgcttaaaagactttcccaaagtcacaaggctaattagtggtcaaacttggattagaaccagatctctctgccttgtcaaaagtctttccaccatttgcagcttttaagacctaagatgaggctgatgccattacctatcacaaatgtataaagttgcatgacagttctaacctttccaatctccaggttgaaatgatattgataacggtactctaatactcctactgtaaaattctcaactaaagtatatgccgtatgctccactttaaagagaatggcatattagagctaagatcattgagatcacggtttactaaaaaacacttaggctgtgttctgcaatattaggttctagcccaattttcagcaccacgttcctttccacctgtgattggtcaacaaccaatattttttttcttaggtcttctatgtgcttacaagaattatgccaggtccagaagtggcacagtgaggtagaaaagagaacagtaagtggctcatgtctctatttagcctaaaatcttgctagagggaaaatcaagcaaacaaaccaataaacttgatgcacataaaataattagaaaataagtaagtcctcaagtagatagtattaacaagcgctgcagaaggtaggtgaaagggagatgattatgggttataatggataaacaaggtttcatggaggaaatgtgatagaagtggacttcaattttggcacttggaggaggggaaatagttcaggcaaaggaaacagcacaagcaaatgtgtggaggtaggaaagagggtagtgccagaagcaaatacttcattttttagccagatagcagcatttatactcagtgtgatgacagcacacctcttcaactctacctataagctgtacctttacatttataatattcttaattttcattttacacacacacacatacacacacacacacttagaaagcaaactgtacaaggagccaagagtcttggttctaaactgcccataaactactaaatgaccaaagcctctcacgtctgctctctgagactcagtttcctcctctgtaaaatgacagggtttggcccaaccctttaagatccctcttagctctaacattctataatttctgctttttatccatgctcattatatgtatggcacatattcttaaattaatgttaatcaacccttctgcactgctgctggctttcccatttgccttttctccagtttgttcccttctctcttaccaggaagcatgttgggaaagtagcaaaatggggatatcatggagtgtttaaatttttattagatatgtgtgtgttgtaattgttaaaaggcatgcaaaacttatcatcttggcatgcatattaataactgaatgtggtagtccatgcttcctgaactttataaacagctcctgtacgagctttgaaatgacaagctttgttcataactgagaaactgaaagtgggcaggcctatggggagtttctgtgaagtatgcatttttaaaaagcaaagataaaaactccaacgtctccgagttggaaaacctggggaagtttctggcaaatggacgggttaagaaatgacataaagatgagactaggatgctatcgggataaggtgacatgacaaagatgatttacctgttccgaatttttttttctctttcttctatatctaggaaatgaggtctatccagctggcccagaagggaggagaaagccccaggtgccacagcaggatagacgatgtcctcatctaacatttttcataactggacatccatggtcagaagagaaaaatcgccctacacagaagtgaatggatgccatactccccaaaattcaggttgggtttttttttttttttttttttttttttgagatggagtctcgctctgtcacccaggctggagtgcagtggcgccatctcggctcactgcaagctctgtctcccaggttcacgccattctcctgcctcagcctcccgagtatctgggactacaggcgcccgccactgcccccggctaattttttgtatttttagtagagacggggtttcaccgtgttagccaggatggtctcgatctcctgacctcgtgatccgcccgccttggcctcccaaagtgctgggattacaggcgtgagccaccgtgcccggcctcgggttgggtttaattacagccccctgacactttaagctaagactttgctaaaaacaatgactgtttgatatttaatagctggtcctggggtgaagaccagagatataaaaaaggttagaactttcataaatacgggcagaactaaacaccaacaaagctagagggtaactgatggactttgatggagacctttgaataaatcacaactttttctttatgttattatgaatgacttgtgacgtttttcaaacaacttttgttaagcactgaacttcaggaacggtggctggagagcaatctaggccaaacatttgagcctatggatcctttccaaatgaaagcaagaacaagtacacaagcacagaaaggagataggtgcatctaatccagctcatggatcacatctgaagtttcccttgtcctattcaaccaattggttatttccagccaaatccataaggggacccacatgcttttaccatgctttgaattctgcaatgtacctgatcttccctagaagctgcggagtgagccctccgtgtttggcttgtttgcggcctgctccactagttagccagtttgccaatacacctgcttccaaaccacctcacaacaatttcccaacatgcttggctgtttagtggacaggctaccatggaatgccatgaaggacggcattgacactggggagatctttcggcactgacactaaggagatcctttatgtggagagggagcagttggggctgctatggaataaccaggagatttccagccacctgggagaaggaaagctgaggtgcaattcctgaatactcatgcttaacaattctaatctcattctaagggaagaagccaaaatgtgattcctgtggtatttgccaggaatattaatgcagacaaatggggtgtgactggttctgcttttggaaaatgcagcaagtgtgtcagtcactgaggactttagcagttattgttttacaagcatccccaaagtcctgacatcaaacacatcttaccacactgaacagagctgtggaaagcaagaagtacagttgagacacaaacatagctccactagagagagggaaattcgggacaggaaaggagaggcatttggattaaaggatgaggagatgtgtatgtacctaccatgttagtcaggttactgctaatagtttcacagactgggttcctttttgcagccctttttgtaaaagcacatagaagagaatggaaagttctgaggttgctcaatgagatatgcaatcttctggttctgcctcacaggcttaattctagcccaggctcacatttaaggtatcccccatcttcgagtcatcctgaaagatcttggctgtcaaagactcacaggaaggctcctcagagtctccattgctgggatgtgtacaccgtggccagcactgtaggattttcacaatctcggttgatatctgccaactgctgaaatacttctcagaatcaaattacagggctaagggggactcccaaatagtaacaggcagatggtaaatacagaggttgttggatggttacaattggggatactacaacgtaaatttctgatgattctttcaccccaactctcctaatatttcctagcctctgaccaagaatttggtaaagtgtggcaatttccaataaaaagtacagctattgagctttttctctgatttgcttcattatgcatgcaagttgaaaccttgtttcctgcagatgatgctaatatcaatgccaaactactcaacgaggtcaccagaaatttctgaactcactgtttcagggttccctcctgcctgtcttctgatctactcattcattcactcactcatccaccaaatatttcttgcatatttctatgttataaggcttgatatatattgatgacttgatatatattgatgtctcttcctttgtgatgcctgctataataactaaaagcagacatatcatgaaatcactactcatttggataagtgttacaaaggaccttcataaagattcagtgggctgggcacagtggcttacacctgtaatcccagcactttgggaggccgaggcgggcagatcacgaggtcaggagatcgagaccatcctggctaacatggtgaaaccctgtctctactaaaaatacaaaaaatcagatgggcgtggtggcgggcgcctgtagtcccagctactcgggaggctgaggcaggagaatcatttgaacccggaggcagaggttgcagtgagccgagattgcaccactgtactccagcctgggtgacagagtgagactccatctcaaaaaaaaaaaagagagagatgcagtgatggcaaatctactagaagagggtggaccagaaaaacctctctgaagaggtggctcttgatccaagacctataggataagaagaagtcaagcacacagagtatgggaaagggcaccccaggcagaaggaacagaacgtataaagccgagtggtggaaggtggttttgatgggctcagggggaaaggggccagtggaaatgatgcatggtgagtctgaggataactgaagctaaagaagtgagcacagagagctctgtcagctagggacagtgaatattctctaaatgcaatggggagatactcaaacggtttactggggaagacatgacctgatttgtatcagatggaatgtgaaaataaatcaaactagagtagaagtagaaagggaagcactctgtatggcaaaaactgcaaaattcttcctagtagccattctccactcctgccttattatgagaactccaattttactctggagagcagcaggcccagtcaaaaattatatttctcgcattctttgtagttaggcatggccaggtataataattctgcctaatgaaacctacatggaagttggctggggatggatttttgggcaagtttgctttcttgctataatgacgcaactccttcctgtgtctttccttctcttttcttatgtgatttcagctggaaaaagaagatgtgatggcaggcgaagcagcagcaaccatcgtagacaactatccaggtaaagcgaatagcaccagagagacctcagacctggcagccttgaaccactggaccagtaccaacaaaccccacatctggattttactgtgtccagagagaaacatcttctacttgtttcagataccgtttggcagaattttctgttactcacatgtggatgccgtgtctaactgacacatcaagtaaccaaagcctgacttgggtggtggcggttacaatgaagaagggtgggccgaatcggggtatatttttgaaggaagaaacaatgggacttcttgatgacctagaagtcagttgtggtggtgggagatggcagatatataaaaagtacaagactttggcttgagaatttatgagaatgggaaggaaaaaccagaagaggagcaggtttgaagattaaaagcaaggattccacttttgatatttcaaagttgaggtgcctaagaggcagtctccactcctgtggtttccaggagacaggatcttgctggtcctgccccaccccttcattcactccttctcagggagtgatgagccagcctgcccagggggagtgcctgttctgctcacccactcccttgtttaggcatccaaagtgtagcctccaggtaatgtggctggggccttcagtgctgcctgaggctggatgctcaacacaacgtccaacattcagaagccaattattgctgtaaatctccacgtcattttccaatttggtggtaataccaaaaagtatttgtagtcccacatactacacttttctgtccctctctcagttgcttcaaatatgggccaacttacacctatataatgacaggtagacattttgcgttctttcagccacatcacaggggcattttaataggtgcctctttcaatagttactgccaaagaaaacgaagttctcacctattcatggctgccctcttatctttattgttagagccaagggttgagtcttccttgctcattaggactataaactgcatggaaattagaacttatttaaaattgatgccagtgagcaaaagataaaaacatacagtaatcatttcactgttcaggcatatgacttcttaccataactctgaagaaagtgtattattagaattgttttactatgctctctctcatttttctctaccagttcactcttaccttccctccatccactgatccattctcttcttccctcctttaaaaactgctgtaaatattgctttttaaaaattctatccctaataaccttagagtttctagacatacactcttaagtaaagggccattcctcaaggctggtgaatctaggtaatgtggtctggtatcagtctgtgtgaagacagaagtcttatttttcctattccttttctttaaagacagattggtcttatactggatatttgatcacttatcggaatttacatttgggaatttgttatatcatatgctacgctgctgtaaaacctgtctttgataaagtcatgtaagatacttttacatttaagatctcagttttgccctctcttccatcctatcctgacagatacattattccttgtgtttgcactgatgaaagaggtgataggcattttggcacactatatcacagaaaatagtacttatcttcagaatggaaatatacatcccatatgtcactaccacatagggccctgcacctggtatggaatggagcatggcattgttacagtgtcattcaatggcttttaccaagcaagagaacatcggcagctgtgatgcatgatgccactgtgacattaactacagacacagatagagtgcccataaaaaaaatatacgccctttttttgaatagagccctgggtaattaccctgactattgttctaagagaaagccccacttacaccccttcatcatttagactctggacataaaaaaaaaatcactggcattgagtagttaaggcaatttgctttccaaatgaagaaaggacaaaaaaatctctactcttgagttgcccattttgacagccacagctcccccagataaaagatcctgaggagtttttctgatagtacccttttcctacacagagcccaaggaaaatgtgttcaagtttgctttctactgtcagcactaggaggacataggggtctgtgcggacagcctgcaggtgaacggtggcggccctgcagctatgatatgaaccatggtgggtccagcaggcacagatgcatctagctgccctgccctggtggccaggcttgctgttctgaggaaaagctacagaaacgttgctcaccttgagaagtaaactctcagggcagggtccgtgttcctccaagttgccacagaacatgaaataggttatgaagtttgccattcaatatggagtaaaaatgggaaattattgaactacttacccccaaatgaaaaagtaaaattaataaaaaagaaaaggcaaaatcacaacaaaagagatggcccccaaaattttacttacattgagtgagaatcccagttaaggcatttttaaaattctccttggcttcctccatctcttgctcatgggtggctttttcattcattagccggcggacgtggctgttggccgactgcaccatggaatagaactggtttgcagagcgccgattcacttcccctcgttcaatccaggaaagcagcactgtgatagcctctgaaaacttgctatcatctggaaatggaaaaccaccaagtacaaatcatgccaagatgagaaaatacactttattcttgttcctctcaaaagacagagcatagtccaacctagtggatatattttcagaactcagcaagttagctttcctgagactgactgccatatcatcacttaacttctcttttcccatctaacttcagggcaccacagaaccactcaggaggttcacactctcatctaccaactccatgagctcagctgtaggagatttgttctgggcattcttaggaataaggtacagcctcattcttccaccaaaccttgatttctctttcttaagatggacttgaaaaactgttactaacctacttggcctccacttcatttctttgttcctttatcaaaaatattatacagtgttaccagttttctcatttatagaatcagctgagttagtattaaaatgtggaagaaagattggatttttttaaaagtgtttgtaatgtatggtattgtccctaaggcaggtagtaggaataagtcaattcttgttctactgtagttcaaaactaattccattttagggctaataccatatatttaattaggctgaaaaatagaatatttcctaattttccacaaaagagaacatgtttcctgaagtgttccgtgtttgctttagatggctatggagagcccatctgaacccagtttgagatgtatgtgcatggtgtggcggggggataggaagtgggaaatgaagttccgcctgaaaataagtgataaagtctatttcaaagaaaacagacttgcctatttggggatggttactggaacaaacccgtgttgtatggcttggaggtggagaaaaagaaagtttgtgggtgattaagttaattagaactggaagttgtatgtcagttgttagaacattaaccaatctgactactgctgaaggctcattgcctactttccaggcaaacctgaggggagaagcttttcattgtgttctgcaatccctagaaaatgtgctttagggaaaaataccctacatttttacaagtaaactaggtagactctgaattctaaaaatcaggagcaaaattagattgaaagattcagattctcacccattcatttaaaaaatactgagtgcctactgtgtgccaggtactgtcccctccactggaggggcatcggagacatccttatgttgtttgcatataaacatacatacactccacatgaatagacagggggagatgcatgcttgagaaaaagatttcgtttcactcaccagattttaaaatcaatcattgagttcttattagtattttacacatcatacgaaaccttcccaccgttgagtgctttgtaaatttatagggtgctttacaaacatctttagtatcttttctcccaaagacctcctcccagaccaggagtacagcttccttagcatggctgctgcttgcccaggaggtgtgtgtcctgaatgaaggtggggctgaacctaattcaaggtcctacggctgaactctggaaacctctgccttccccaggaaagaaagcagcttttagggatgtacccatgctcaggcaccattctaagtcctctcctgctgcacagcagccttctagatttggggatcaaaggttttttttctgagcaaacctgcccccctgccctcacactttaaccagaggagataactggcctgggaatgcccacaaaacaccctgtgaatgacagactcaagtttccttgaaaatctcaacccataggcacagaacacacttactgagtatcgtagccacttataccattttgttaactctggaatttcagtctaagttcaaccctcagtgaactccagctgcaatggtttcttatctcatttcatggaccgaagcagcttgtgtaagataaaatctatcacacaacttaacattacgttcagcccatggagaggcccataatttagcatgatgtttgtgagaggcccactgcaaccgttactggcagaataaattgtgcctccctccacactctctacctctcttcccaccaatatatgttaggagaatggacctcagaacagacagcagaaataaacctaatgcttagaagaaatctttttttttttcctctgaaaagataacaacagaaaaagagaacactgacttcatgtactatttttcccctttgctgtgagtttcatgtctacataacacagagaaagaaaaatccttaacatttttgttatgagctttgcagggacagagtgtaatgctgttcacctctttctgtcatatacaggtagtttttccttctcttgcttgtggtcgcttagttcataaatagactaactttactatcaggaaaaaaaacacttcaattttaaaaatgcatgtttgctcaaatgctctgaaagccacattttattgcccttcacacctagacctagagcacaataagttcaccagcagattatagtttcagaaagaggaaacaatattcttaggattaagccactgaaaatacacaatttcaaaagtaagtagccaagagattttctaacatgttaacaagtactaggaagcagaattccattagcctaaaagaggaatatagtttcaaagactcccaatttcatcttcatttctgaactttctgaaactgacaggccgatatatgattgatgtactgacattcaaattaaattaaaaaaacattagttaaggcatgcttgataactccagtcaatatttgttgccatgtaagaagtgactttaatttatattaattaagactaagtcagtaactccctctggatggctacaggaggatattgggagcggtcattttcaatactcaactgtaaattcaattttgtattcagtggaaagatcactgagaaagcagaaaacaatataaactaatttaaacaggatttagattgcagcattattaaagctattcatgtggaaagaaattaacactgcttgtaaaaatcacatcaaacatgcacttataaaaattccaaatactttctgtgaacatgctcaggcataactctgaactggatgcagtttagaagctagaatgtgcagatgtgctttttccactataagaattgagaacgattggtatatgatggagtgaatataaatcatttgctcattagaaattacccaccgttttctaatcaggtcctcacaatgttaatgcacctgagttaatggacaggtccattcacgggtcttgcctttttcccttccatccgtccgtccccgcttcctttgccagagccctctttgttaaacagcacggcgtgcctccctgcatctgctcatgctgtgcacttatccttgggtctctcccactcctggtccccctggtcagctgttattcttccctcaagattcagcgtaagtgccctttaataaagaaatctcttctgcaactctaggatgaattaggtgtctctttgctatgtttccacaattccccgcatatcctgctattaaagcattagtcgcactgtatggtaattgttggtttacagatctgtctccagttttgaggggctaatatgagaataaaatttccaaagacatatttctagacatatttctgtcttctggttactctgagtttttccctttgtattttatattttattgcattctacagtagttcctccttatccacagtttcaccttctgaggtttcagttaccctaggtctcagttaactgtggtcaactgcagaccgaaaatagtaaatgcaaaattgcagatacaagcaattcatacattttaaattgcacactgttctgaatagcataatgaaatgtcacgctgtctcactctgacctgaccgggatatgaatcatccctttgtccagggtatccacgttgtctacactacctccctgtgaatcacttggtagccacctgggttatcagatccactgtaatggtacagcagtgtttgtgttcaagaaacccttatttggcttaataatagccccaaaatgcaagagtagtgatgctggcaatttggaaatgccaaagaaaagccaccaagtgcttcctttacgtgaaaaggtaaaagttcttcacaataaagaaagaaattgtatgctgaggttgctaaaatctaggataagaacaatttatctatgaaattgtgaagaagtaaaaagaagcttgtgcatagtatatatagtgttcagtactatccatggtttcaggcatccactggggatcttggaatgtatcccccaaaggtaaggggagactactgtattcctaatagatttgtagcaattaatactggaaagatacaaatgtaatggttaaaagttaggaaacatcagagttgataataaacatttaaatttcatgtcaaagagtattttcacacatgccattatctacgagagatagatgttctcatgacaattaagctgaatgatcccgttatacttcaggcttcagaagtcattatcactggcaatgaaagttaagagtgatgtcagataatcccacagaagcaaggccctctgcagtgaggcactaaacagtttatcaaataactcaaaaatgtttttgaaagcatttttaattctgggaacgtaattgctctttagctttgtgaggagtaaataatattataatgatactatcagatgtcaccactggaatccacgcccatctcatttcatttctggttatttcagactttgttaacccccttccttctccctctcttccacatttattgagtacttggcacatagtaggcattacaaaactgcatatgggagaactctttgctatattctaagaccaggtgcaggagcagcctttgtgagcttgttaaaaacacagactcagcctttctcacacctccagaattggaatctgcattttactccaggtgatttgtacgcacatggaggtttgagaaacactgaagaaaggactcagtgaaggccaggtaaactggttaggagctgaccaaagtaagagataatgaaatcctgaagtggaaagtagcagctgagatactagagactttcaaaaggaatagatgtgattcttaagagctttgtgagtctctatccctgtccccacgaccaattaaatccctgtccccacagctgtcacttctatccaggaaataaaaagggttcaagacttggaaatgggcatagagattactatagaccctttctatggaatgctgggcatgaattacctaattctacagggggtgggaaactttaattctttggctaatctctgactaggctattttacaactttgtaggagtagaacataaattgtggcaaactgataacaatacaaataattcgtctctgtaacaatgcaaattaatttttgttcagtagaaaatgtaaatctttataaagcgaattctccttcgaaacagttttaacattttcttggtctccttattaattagtgagttaaataaaatcattggcacatgttcattttatatttgtaagacagtcatgatttcaccgccacagtattctttaacaaaagacagggcccatgctacagtcatatctgaaagtccagggcatggcacaaagcgatgggtacctggtgaattttaattaaactgatacatagataatgatggggaaaataaaccaaattggtaagtgttttttgtttttgtttttgagatggagttttgctcttgttgcccaggctggagtgcaatggcatgatctcggctcactgcaacctccacctcctgggttcaagtgattctcctgcctcagcctcctgagtagctgggattacgggcatgcgccaccaggcccggctaattttgtatttttagtagagatggggtttctccatgttggtcaggctggtctcgaactcctgacctcaggtgatccacccatctcggcctcccaaagggctaggattacaggcgtgagccactacgcccggctggtgtttttttcctcccgctttgtgtgcacagggagaagcagccctgaatttcagaacaatagataggataagagccaagccgggagcactgaatacgaaacttaggtgggctatagtatccttatttacagctgggtctataaaggaacaatgaggagacagggattttatgtttgaacggaacgagggaaaacaaggaaggcattctaaaatgcttttctttccaaagaaatggagggacacacacatgtgtacacacatacacacacaaggaaaggtatgtctgtagttatcactgatttctggctccaaagatagctggaaattgctcacagtgtacagtcacagagtcatctaagcagatttggaatttcagtatggtcaaagcattgctgctatcacaatccccaaatttctgtacatgtccctaaagaagtctccttttcctggctgctcaattaaccccgcatcaactaaccagatcacagacagcataaaaggctaaacaaagagttaatgttcccttctacccccaaaacacacatgcaatctccttaactatttagtagctgtaaaaatgagaaaattaagggggcaatatgaaaatgcactgattattcctgctttagggtcgagcaaaatatttctttttattttatttatttattttatttatttatttatttattttttattatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtgatattccccttcatgtgtccatgtgatctcattgttcaattcccacctatgagtgagaatatgcggtgtttgcttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccaagcaaaatatttctaaataaaacggcctatcttgcctctatgaaggtcaataacacataaggaaataatttgcaaacaggctcctatgtttcatatttcccttactctatgaaggaagcctggcttttagctaatgggacatccacttggctcataacattattgatttttactttcatggaaccataaatactgacaaccatctcagcaaaatgctggtaccacatctgccccttcctccctctggcaggctgacatgaggctattctatatgcaaataagagtccagttctctggaaattatgaatgttgatcccaggaggatggtattcttgttgacacatcaggaaatcccaaaggccctgcctgcaaggctttgtcaggacgtcacctaattcagagagaaactcttcatttcatcacaaaatgaaagattatgtgaagctttctaagggggtacaaagtacgtaaaaacttttaaatgctcttgccaagagaaatcccggtgaattagaatataatccttcctcactgtctaatcaatctcttcctcccacagtccaaacacagggttcctccaggggtggatggtctgtgttagacacactgaaattcattatctcatctgcctggttgccactgtttccaataaagtgtaattatggtgttattgagctccttcccactttctcaaagccatgctataaactttgggtttctgagcagttacttcccagtcggtcttcattaagttgaattgtctcggaacaatgtctgtttaaccagcaggatgcttactaattttcttttttagaatttgtattaatgtaacaggcactgggtgactccatgtctcaggcactacacaaatacaacacagtgttacctctggtttcagaaggtcaagtagccagtgaatgggataacctggtcccagaagatcctccctctctcactccagcactgcccatccgggctggctatctcccctgtgacagcactgtgcacttcccacatataacaggaggattattatatttattataatagtgcactattataagtggcaaacgcaaggtgatttgttattgcctgtgtcactcaagacacctaaactctttgaggcaggggcttgttcaccgttgtcctttccaccactggctaggacagcgccagtcatatggtaaaatgctgattaacgaatacttcttgagtgattggaaggatggctgagcacacatcacatcatttccatgtacatctggtcatgcccagtagaaccactggacagaaattcaacgtgctcatagatccaaatagcagaagaagagagaaaataattatttttactgagcacctactatgtgcacagttttagcattggacaggacatggagagggccttgtgggtcataagaaagacttggtttgtacagattttgctaaataaagctgattttcaaagagaaaattgtaagaataaacaagtatgatataaaatagaggaaaagtatctgtaataaatctaagtaagatttctcaggggaggaaaaaaatcaaatccaattaggtattttcagattgcatttccatttcctttctgacacagatttctttaccttaggtattgactgtattttatgtccccacatcaatgaaatcatcttcagggaaacagtgtcctcagctcctcctgtctggctttgcaacattataaggagcatggagtggatttcctctctaaggcagccaatttcctaagcaattaaatgctgtttatattccaaactctatgcttgggttgaaattgtcaagcttgatattacctgactcttgcctaagatgtatccccagctagttcattctactgtaacagccatctattaaaatttccaatctgttctttcctcaagggatcacacagtacttggcaaaggtacagcttctgaattctgtaaattatactcatctatataaatatatacttttgaaatggcaaggcttgcaaattactttaccaaattgacatcccaatctgttatcctctaaaaggagcggcaaatgccacatacttcatacgtgcggagacacttctgtactgggttcttaaaaacaacataactagatgatacgcttttatgaaattcctccaggaggtcacagatcaaggtgcagtttttgtcacttctaggtgtggacaaactgaatacagttagtctgtgtagatcataatctgataccacaatacattggatattaaagaaaaattattgttccagtgaatactccttgttgagaacattgctgctgtatctcattttggccactccttatggtttctaggctggagggaaaagtgagatgatatctgtatctgcactgcatatgccctttattaaaggcacagccatggcctatgtatttacatcagtaagacatgttttctcaaagcagcagacacaccacaagagcatcagcaagaagcattccttggttacggtgcgggtatttcagtggcagctgcagttgattaaggattctcaagccctggatgggggatgaagattggaagcacagcacccccgctgccacctttttttttttttttttaaagcatagaatgtcaacttcctatcttcctaaaataggtgttaggcagcttttcatacattttttttagtgaaaacatccaatccactttatacactgccagcaatacaccagctatgttctaaaacacttgaaggatcaatcacatccctcttctcatcagaaatctgttaatggcttctccactgtttatggaataaaacccaaatccagcaatagccttcagggctctgccatctggcccagactgccattccagctttacctcactctagaaaggcagcttctatgctgaattcctttctgcttctgtgggtttttattcttaggtctccagcctctaactagaatgcctttatgcctctttttatcctggggaaaaaaatcttatttattctgcaaatttcaaattatgcctcctctataaagactttcttgacactttcatcaacattatttgcactggcccctgagtccccaaagcatattgcatttaccttggttgacaatcatgccattgacttggtattacagttaattgtttatctgtagacacctacatgtggccaccaactgtgacttacattctctcatcaaatcctgacagtgctcagtgacctcaggagggtctgaccatcatttgcctgtaaaatgcccatatgttgctcagctcacacaactttggtcagtaatagaactgaattcacatgtcatcctaacttcaaaatctggcatcactgtagttcacgggggcaggtaccagagccttcctatgtctttatttcccacagcataaaacaccagggagggcctcagaaaacattagaagaaataaaacatactctcttctcttgctagtcatcctgtaaatgttgcatgtgtcccttcaactgcatctctgaagacagggatcccattctatgtttcttttctatcctcgatggaccctagtaccatgtctgctgttttgcctgaagaaggctttaggagtctggtaaacatgcacactctatagagctggaggaacactaagaacgccccaccaatggcacaaatagttgctggctcattaaacactgggtcagaagataatagcctgctttggggacctttctgtcccctcattcagtgagttttgttgagtgactgtacatacacttttatggagaacatgggtgagcattctggaaaggggcaggggtctgtcccaggcagaagatgaagcccaggtgtctgcagcttccaggagaccccccagctaaccccaccccagctctgtaaagagtctgtgcttacaccagactcttacagccttcttaaggcatagcagacattgtgctgaagggacaatggtggacgcaggagaaacgcacagggttccgtgtctggggatccctgtggaggaagaaaagccagcgtgggtggcccatacctttcagcttttcagccagcagagcggcttcgtgctccgagtagtgcattatggcaggcggggatgggggcctgagccggtcctcctccagcttgcgccggtgccgctcctcccgggcacgcatcctctgcttgcattcccactcatagaagtcatccctggcctgggcaaagtccacatgaaggcggcctgaatcctttttgtcggtgctagaccctaatcgcatcctataacctgaaaccaatggaaactctggtcacaccataatgtaacaatggccacagttttggtccagaccttcaaggcacgcttaggcaaatgctcacttatttcttggctgtcactacggatacatttcccataggaagcgggaaacaattatccttttccccagcaatcttgaagctctgtaaagttaggcctattacaggtttggggataaacacaccttggagagctgtctcagagggctgcttacccatcttccaaaccagtatccccaagagaagatgatctcaggaactagggtcttatcatgatcattccttcttctccctggcttctaggaagctcagaaacaaatttggcatggagcattttttttctctacctttttatggccttggttttattatattttcagcttactataattctactgtataggtgaaatatgagtaaataaagagcatctatgatatttaaaaagatctacaaagtgaattccagacacctcactcacaggttattgctacattcccccagaaaatgctgctgctcaattctctctcagcagctgcaaaagccacaattaccaaggcaattttgcaatgctgttttatttccacttatcctctggggtgcgcaggagaatattttaccttcgatcaagaggcctcgccgctgcctgcctcacagccctgcagcacctcatctggtatgcagcaccacacaaattgttcatgtaatattttaaggccacagcagccccgtgcaagagcccagagctagacaaagaaaaaaatgggcctggaaatctttgggggattcactgtgagctacccaacttagataaagattatgagcagaaatttgatctgagagatcaacactaacagaactgaaaccagtcagccggcctaacttcaaatgaagaagagttgactttgaggttgctcttcagtttggggtactcagattttcagaacataaatccaggtcccagcagagacacagctgctgggggctgccagaggagagagcaacataagcacttttccagtatgggggctttgcaaatgagatacaactgtaaaatgctaggctgcactgtgctgatgttcaagatctcatggtagatttcaatggattattttagcacttggggataaacctcagctgaaaatctctgtagaggctggctcctccccaggatgccacttcacacctttgaaaagttacaaataagatattgacttcacatctggtttctgtgatgccttggaacccttctcactgctagattttcaagtgttatctgaaaatgggaagacataacaataccaatcaaaaacaaaaacatctaatcacagatgtgcagaattaatgcaaaagcaaaatgtatcttggttgtgggccatgggaacttaacaagtcagcaggccacagtgatacacgcataacagctgagcaggcaggactgtttaaactggccagctatcccaactggccaagcacctttcccctgctcatgtccagagaagcagttttcaaacatttctggctccagaaacaccctcactttcacagaaacatcatcattaaggacttaaaagagaccctgatgaggctgagtctaaaattagctaggccttcaaacgtgaatgtggtcctaaaattagacaggccttccagctgggcttgggcttgggcttgctggagcccacaaacaggaggggccgcctgacttccttcctgcctttccagttaattggccttgcagatcttcctgggactgacgctgcagcctctcaagggcagggaggcagagttaggaggctcctctgcacccaggtagggaagctggaggtgaggcctagctgtcttctcctcctacagtaatggggcagaccaaggagcaatcagagacttgctgagagaagcgggaccagcacccaggctggaaaatcataggatcaaggtataatcaaggagcacctttcatatgcctaaatttgggactgttcatctttgtcagtgtcttatgaggcttctgattgggtgtgaacattgtgttgtattagtgttgaaaagggcctctgatttactctaaccttctcatttaatcaagtagggtaaagaatacagttgacctgtgagcatgggtttaatctgtgcaggtccacttataggtggatttttttccaaccaaatgtgtatccaaaacacagcattcgagggatgtgaaacccacatatttggagggctgacttttcatatacatgagggttctgcaggatatacatggggcgggggcggggggtcctggaaccaatcctccaagtgtactgagggatgactgcagttttcttggtacagctgtgattagaagccaggtccccaggatagggttcttgagatagaaaaatccgtccttctttatcatcatcaggatatttgtgttaaaaacaaccatttcctgaatggtttctatgttgcaggtgccctgctaagcacttaatatccattatttgatttattcctcctcacagtcctacgaggtcatgctgttactatctttattttatagatgagaaaatggaggcaggctctaggccgtgaaacccagtgccacaaactcaccagaacccccgttgtctaacagcggattgtgtgttatgaaatgtcttcattctaggctttgtcttccttctccattttgtattgcttttagtttttattttctactttgtaaggttttactgaaataaggggttttaaagttctccatatcactgtctaccttaggaaagtctctgcagtattggaataacctcaagtcttctggagtttgcacagaatttcgtggcaatagaggtggactgcagaaattaagtaaaacctggcaggaatgctcagataggtccccctgcccctccccacccccacccgctactgttttcccacattcccccatcagctttgcctcaggaatagggaggtgaaatgcagagggacagactgaaaaatggaggtggggagtgtgagggaagggcagtgagttcagtctgagaatgtgtccttccaaagccagcccctaattcttgggtttggcaaaggccttgcggacagactccattcacttggcccaatacccacagatgggaaggcagcactaggcctaatctcagtatctgtaaaaatcgcctataaaaattgacaccagaggacaaggcttaatgaaccaccaacgaggcaatgatactgggccttctcctagggcccctaagctactttcctgcaaggaactgaccttgctttggtaccttggtgtccagaaagtgaatccacttccaaaaacctgaaattattctgagagagtactttactcctcctaaggattacatccagtaagaataatggtccttagtactcataatattgcttctcatctaataagcacttgagaacattaattagaaactcgatggaattcctaaagactggatggtgggaaattgctcctgcagtgaagtaccttcacaggcttagcgcagagcttctggcagccaaggaagaaggcagaattcctccttttccagccccaaactatgaagactttattttgcatgaaggccaaagggaataagctcatattaacatcacaaaacataacaaaatgcctagaaaactccttatgtaatgcaaagtaccagaaaggtaaatggctttatcaaccatgaattcctctgcaaagcgaatgtgacaaaaattcttcttgcttttccgaattgctgtaatatcaccgcactgttcaaagacttcttgaataatttcctcagtagcattttctggtaatcctccgacaaacacggtcttacacccaggaggtcgttctcttgtggaaggaggtggaagatctaataatcacaacaaaacagaaagttttatctttcatttatttgctttctctggttctcctggcaaaactaaagcttgcagagtaactttctccagactgagtgacggtaaatttctatgccaacttaacattgatcccaggctgtcttgtttctaagttcctctcccctcctgctcccaacctttactttctgtgttcattgctacacagagtggctatatgcttgtccatgaacaaagataaagcaaatgtttgcataatttcatttctcctttatactacagaagcccagaaaagggagggaaaaaacttcccaaagtacaaaacatgacgaaatgacaacatgatgaaaaacctcagcgtgttatctgctttgtcttgtttccagataaaggagcggcaaaacagaatacgggaagcataacctacaaaagcacgcacaatacttacttggctgtgaaacaccgggcctgaaaaaaaccactttgttattattcacatttaaatgagcaaactattaaattttgggaaggctgtataaaaagatacaatgtacactctcacaatattttacctagtttatatgtagattactaaagcaatctcctgaaaagtccacttaaaaaaggcaacactgattaatatgaatgacaaaaaaaaaaaaaagtcctagctcttttagcccataaacttagtatctgaggcaaaattaaaaaaataaaattctggcccatttacttcatcaaatgtatgtttccttcaagcaaatacaatttggtccagaaactctgagatgcaggcttccctctccccagcccccaaattgctaactgtcaaattaattccattttccatctagcaaaacatatttcagagtttttcacccacatttgtgaagatggatggaaatgctcacatatttcacactgtgttctccggcaaacactaggcttcactgcatgcaaaaagtcttaacgctggatacacatccctaaatcccacatactggctttatagtgtggattcagcttctggacagacacgtggccacatccctgtatatttattgtaacctagagacaaaaggccttctgtagaacggatccccactctgtgcatttacgtgtgagtcacatctgaaaatgactgcaatgccattttaaaatttaaaaagaaaaacatttaaaatgagcaaatatttctcataggcgttacttacttggattttgaggaaaaagagtacagcttttgcagtggattatttctttgacaacagccacttctgttggtggtgggggaggtaccagtccaaggcctggtatcattgggttaatgggggtgattccagtcatcatgttgaggcttggatcaaagcctgggacacagattgagtctgtaaagtatacaagataacattttgactggagattaaatccatttttgttgttgtttttgccattttcctgtggattatttgactttatactttctatttttcaggaatttctcctggcataagatataatattatagaaagctatgccagaagggtaaagagaaaaaaagtaaaagatgaacattaaactacatgaaaaggaaattatattacttaaaatattaacatggcagaaagaacacagcatattaaaatgtaaaagcatgcaccatgaagcttcactattactgtgaatgcaattttctatttcttaacgttggtgtattgtttataccaccttatgacccagaatatgggaagaatatcatttaacattgaagtgctctgtgaatctaattgtcaacgtggtttcatcaaaagagccttcttacccaagtgacctagatttaggaaagttcaatttatatgtgcatactttataatgatgtattcaggtcccacctaacctatttcccctggaataaaaaaaaaaaaaaaagcaaaacaaagagtgattacaattactatggctgggttagatacatgcaggcataaaattagctatatacatttctggcttctattggataattgcactttcttcctataatttagtcaacaaagaattgacccacccttttgaaatctttatgccctgtattacacacacacacacacacacacacacacacacacttgaaaatagaaagtgtgcaaaacaaatgggttttccagctttttttttttttagtgtgataatgaagcaagtgatttcaaaggtggcatacagacactaataagtaagacctttctaacagcaggggctatgaaaatactatactgagtagccacaaggggatcccgttcatgagggtttccctgttggcagaaaagtctcatgggtggcgtgaaaatgttcccagatagacaggccaggatagatcatggtgccctcctctactctgcaaggatgaaacttccttcttgtctcataccatcctatcttcttctccctcctcatcttacatcacttccagtcttccttcctgcccgccacccctgcccccgacaacccctttgtacagttctcctgtacagcctgtgccttaggcctccgcatggcctcactcttcgcttacctgtgctgaaaggctggaggagcccagaagcagatgtaagaataaccacacgctttgtttactaagaagctccagagaatacagaaggtctagcaaaagcgtttcctttctgggaaaaggtttacagattccgccagctactttggacatttccactcctcctctgggctgaacagaataaacaatgtgattctgatctataaccccaagaggactgctgtcccatttattaaaaactccatttaatttcatagtgtatcagtgtgacttcagtaaaaggaggatttttttttaaaagaaaagaaccctaaatataaatgacaaataagcattttctttcaaagtagtcaccctgacattctaggtacttcctctacaattatggctctcagtttcttcatctgtaatatggtactgtttgactggattatctcttggagtgctagaattccaagactccaggattccatgctgatgttgctcagtacaaactgacacacaaaagacttaaagttttataagtgacagagatgactctgtttattctgtcaatcatcagaaagtttcacaagtatgatttccattttacagaaaagaaagtaaggcttaaagtacttaagtaaaacttctaacattccaaatcaaacagatggcagagtcagaatgagggcccaggtctttgcctcagtatttaaacatgtattaaatgtgactatttcaaagtttccatctagaatgacccaacatgattactcatctaatacatgccactacttcttaaaatgtactttacccttaaaaaaatcaagatgggtcctgccgatcaattctaaagaagttccagaacagaatggttttcaacatcatcatcattaaaataacatattggcctccaaggtgaatatattagaaaaagaaatattggcaatgggaatattggcatgcttgtgcttttatttaatctcattccgtacatcggcttcatctgtttttttcctggcctggccctcgctattatttgccaacacaggatgatttaaggctgaaaccactcaggactgcaaaccctgaaatgagagccctgtgaattataatcagcagatgtttcccacaaatgagaagagaagcccagtgcttgcattctctttagttgttaacagacttctgttttctttctgaaggctaagtaaataaatatatgtccagaaatggggacagaagataccactcttgtacaacgtattttaatatacagcaagagttgctttgcttttttctgagacatcagtatgaggagactatgaggtttaatgaaatctgcatggcaagtgcagtagcttgaaaagagcttagaaaggaattaacacgtaaattatgttggacctgaaaggattggagattcagtatttgagaggagaaagtaaggaaggattagactttaagaaaaaaaaagaacccattacttttttaacaatatatgtaaagatggaaattgttttctctaacagcacaggagcatatgatgtactcgctcattaaagcaaacgcacaaactgaaaatcgaggaagacacaaacacaggaagacaaaggggagaaggcagcgcaacccgaagaatcagttccatgccctgttaggaaaagctgcccctgtgagcttcagagataatgagttgtaattctactcagcgcaaagaggaggactgcttaaatcacagcaagaaagaatccaattacgtatacagtagaactttatcacaactgtactgaaatgacaggaaggaagggttattcatcacagaccgtggccctgtctggctcctctctgtgttgccggctccaagcagagactggccacagccaaggctcggcaaaggtttctttttggttgtctgttcccagttggacgagatgaaaacaaacaaaaaaaaatcctgtttactgattcacaggccagtgttttatcaattggatgagcatttttcagaaggcaggttggggctttgtgttcaggattttagaggcatggcagttgaattaattaaagcactcattcatttgaattaaagatccattcagcatttcctgggcacgtatgactgccaggatctggagttacagaggtaacagtagtaagttccccacttgagtttgaggagaggataaaggatgggaaccaaactcagcaaaagagtcgggacacatgagctgaggctcagaggacacagagagagtccaggaagggaattgctgggagagagcctggtaggcctggggaattccaaacaatttttcatggctctttcatggtgtgcatctggcagtgtggccacaatgtctggagagactgcaggaattagatcagatcagagagaccctgctgttcaagctagtgaatttcaactttgctctccctggaactcagagtcagagatgcaccctgccaggccagggctccggtgcctgggccgcccttcctcacttcttctctctttgtctgctgcccgctagccatgccttgctccttttctgccctttctagtcaatgcctcagttaagagtctcatatttgagatgagaactagatttcatttgaaagaaaggcagttgaggcctcttgccaggcaaggctgggcatactaactaggttaggtgtgggcagggaggagggacagagagaagttgtcagtactaggaacaagtctggtctggaaggaagaacatagcgttttaagaaaataataagagaaagaggcagtaatcaggctaaatggctgcattacaggtgtagtcctgggctgagggtgtcctgacaaagtggctgaacacagagattattagcgcagataaaacacaggtccaggtggggcagctgcccagaggactctgtctacaggtcacagggcctgcaccccctggtccagggttcagacccagcccaggggaaataaagtttgcaggaacatcatggagtcataagttgagaaatactaggccaattggcaggttacctaagccaggattcaggcaggagaagcaagacaggattcagacaacaaaatagaagcctggggtttggggaaggagatagacccctcagttatcagatacggagcacaggtcacagcctgaccagcataaagcctgcttggatgctgagtcttagaatgcagggctccagagcccccttcctcccgcctgacgccagatggaccctcaagtccagggacagagtaagtgtgtggggccaggtcccaggacttgtgcagggcacagagacaggctggaagggctctaacaaacatgcaattgtgctgcttctttttccagaattactgggttaaaattactgacctatcatcactctgcagagaagccacgtgatacctgaagacattctgtttaccagaagtttccagtggagaaactttttcagaagtctcctattgcaattgacaagtcttgttgttctataatgtcattgaatttgtaaactattaaagtaatgctctttttcattccatgttttcttttttcaagcattcttaaaaaactgttttgtgaacagcagaggaaaagtgaacattttaaaaaaggtgatcttaaagtcaagggatctggcacagctggatgacctaaggctgaccagctttttttttttgacatgagtgttgcactgtcatccaggctggagtacaatggcacaatctcagctcactgcaagctccgcctcctgggttcatgccattctcctgcctcagcctcctgagtagctgggactacaggcgcccgccaccatgcctggctaattttttttgtatttttagtagagacggggtttcaccgtgttagccaggatggtctcgatctcctgacctcgtgatctgcctgccttggcctcccaaagtgctgggattacaggcataagccactgcacctggccagctgactggctttttaacctctctgggcttcagtgtcttcaccaggggaaggagaacatgaatactagatagacatactggtcttcatggtcatccaagaagaacacctgggtgaaggcagtatatcaaagtgtggagacctcaagtctgcagtcatgcactggctgtatgactttgggaaatttaactaatcattctaagcctcatttataatatctgtaaaatgaagagaataatatttaccttttaatgttcttgtgaggattaaatgggattaataaaacaaaaccaaagtgttcagcataatgtccagcacatggtaaatactcaataaatggtagcaattacatacagcattaataaacattaatattatatagaatatttacataaccttatataaatatgttagtaacatagcagacacacaatcataatgatgattacaaagtctttcatttgacaaacatatgagtgcctactaggtgttgagtgttttgctaggtactctgcattcaaagacattgcaatgttcttccttcacagatgtggaaatctagtgactgaaacaacttagcagaaaataccaatacagtaatgacacttattttgagacatttaaataaaaggtgctatgaaaacactgaaaaggggacatctaaacccgtctggcatagggtttgtaagagttgacttgtgtccccccaaaagatatgttaattattattatacttttaacataagtcctaatcccccatacctatgaatgtgactttatttagaaatactgtgtttgcagatgtaatcaagataagattaggtcatactggattagggtaggcatgatctaatatgactgctgtccttataagatgaggagaaaagacacagacacacagggagaatgcaatatgatgactggagagatgcacctgcaagtcaaggatcacccaggatagccggcaaacaccagaagctaagagaaagacatgaaactgattcttccctggatccttcagtgagaacaaggccctgccaacagcttaatttcagacttttggcccccagaactgcaagacaatatgtttctgttattttaattcacccagtgtgtggtactttgatacagcagccctacctagaaaacaaatggggttgagggtggggggtggggtgggtgccaggggagtgtcagggaaggaatcctggagggggtgacagctgaccaggttcttgaaaaggatgacatctgtatatgcaatgggcatgtaaaaaggtatccccaaaatacacttattgggatcctaaatacaaagatatttctaaatgttctcttaggagaaatgttcaaaaccagtctcctggaagcagaatagctcttaggttttccctttgtgaaataaacaaactctgaagatggttacatatttgttaagaacaaattaaccacacagattatgttaacataacagaatactttacaaggtgagtgaatgcctacaaaccagatctttaagaaagtgaaactgaaaatgcttttgtaatctttccaaagagtttcaaaggcagtgaggtatgtttttcatttaaacctaagatgtgtatccagagtgagttcctggtgcctgccgtgcacactttataaacaaagacttcattccatcaataaaaccctctgtctcctttgaccaggatgcaacgctggcagaactgaggaatgcagctgtcaacagctattctaagtattgttgacttgggtgaggagatttgtgtccatgtttgaaaatatgacatgacacgaagcaaagagaatttcaaaactcctgaccaaagctggtacagagaaaaactgactgctcaaagaactccatcagatctttccagcaatctgtgcatggagcgtgcacttgaaaagcaagtgtgttttgagtgagcaggaggtaagcgctcatcacaggttctgtaaaattcactcacactgtgggccaggaactcaagggcagagcggtttctgtgcagaggactgggctgacacagtcagagcaagctgctccatgttttctggacctgctgaaacacactcttaagacacagtgggcctcacagctgagccatgaaaaccatgctggcatatgacaaccaggtgtggaggggttcattttgacaagcaggcaatggacactggccctaaccaaagattaggaaatttcaaagcagaaagcaacctgggcattacctagtcctaccatcttgatttagagatgagaaagtggatgcccagagaagtgaagtgatttgcccaaagttacacagctagttaagaggagagctggaattagaatcaagagtcctgctgcatcttcactgtgcacctgagttctctgtctctccagcatgccttcctttggatgcctctagtgacactgcactcactagctcctgacattgcccattcttttttttttaacagttttcaaagtgagaaatttatccctaatatgttgacttcggacttgataacctgtagttaaatccattgtctttattcagtactcctgggttcctgtaacaagtctgattctctttcccactgttcctggtcaaatccataaagaaagcacacaacaatacctgaaccttctcccagtcagcctcagcaccctcttccttcagtccttccatgaactaaaatccaccttttctgacatctaaaaattctaaaaacccaccttttctgaggtccagggttatccacagaaagagaccaggaagaagctgatcaacctattaatggtggtctctatctttcttagttctgaacttgtatgtataaattttagtaagttgttacgttacgattaaaaagtaatggtcatgtttactccttgctttgtgacaggcctgtgctgaaagcttcatgtcatctcatgtcatctttttggcagtcccatcacaaagttgacaaatgctaagtgacctcattctactaaaacacacacgtcttgtctgtctgcagaaggatactctcatgcaactttgaagttgacattttgaaactaaatgaaatttgcattttccgttcagttttccaaaatctgtcttcttagttctcctcctgtcttgaatttctcctcccttgtcctcaatagctataatggctagacaaccctctcttaaagttcctgttccttctaattcaccagcaaatttcttcttgcaggacagattcagccacagagggcaaggagatcctcctgttgccacatttggaaggtgaaccattagctgccttcctggcagatgcctactgggggtctggagcttggaggtgacacatggagcatgtcctcctccacttcctccctctgtccaggtagttgttgttttgctctcaccacagcattatttctgttctttcccctctctaccttcaccccttggtgtgcaccaggttccctgcaccctcaggtttgtgaactgtagcacgtgcttacagaaatatcttcttgggccgggcgcggtggctcatgcctgtaatcccagcactttgggaggctgaggcaggtggatcacgaagtccagagatcgagaccaacctggctaacacggtgaaaccccatctctgctaaaagtacaaaaaattagctgggagtggtggcgggcacctgtagtcccagctactcgggaggctgaggcaggagaatggcatgaacctgggaggcggagcttgtagtgagccgagatcgcgccactgcagtccagcctgggcaacacagcgagactccatctcaagaaaaaaaaaaaatcttcttaagcaaatcttcttagactccctccccaacactgatttcttctgaatcctctgttgtaaatttccagttttacgggccattgccaggtctcagggatgtacacagggttaccgtcaattccttaggctggaagctcatgtgtactaagttattttccctgctccctctcactcatttctccatcttgtctgaatgtactccacagcaaactgcttacaggattctgggcatctggcctactctactcctgttagacacttttgggttaagtaactttagggcttggttgtttcttttaatggcaccactcctctcagtcctggtttaaaacctctataggtaaccacatctagtgacctgccaaaccctttcagatggagccactttagaaaggatttctatatcattgtcttttttgttcccattgctaatttaggtcctcattcgctctcatctggagtactgcaaaggactctttttgtccccacaaactgtagcttctatatcccccctgtccccaccccctcctgcccttcctccctccgcctcctccctgcatgcccttctcacacccctggaactgggatcagccagcgatgcacacgggggaaccatgagaacaggccctaattggggcctctaaattacttctttcagacttcttttcacatccctatctcattagccgatgattaattttctttctgtacgatgttatgtgactttgtacagcaggactgttatataatgatagggagggagaaaaggactgaattggctcttggtgttctctgctttgtcctagctgacaagcttatggtgcgggagcagacagtaggggcaaaaaattattaaatattgagaaatatttttgaacattcagtcaagcccctaagaagtcgctaatttttatacatctacttctatctttctgaggagtggggacactccaaatatatgttgaaagactaaataaattataatttctttctggcattcaatgcctccttgctctatagaacttcctctttatttgaagtcaggtaatagcctggtgacaccatatagatataaagcccactatagtcagtatttataacagcagagatggtaattcacagcatgtaaatgtctttataggaaacttccctttgaaacctgcatctttctgaggcaatatgcaagtgttaaccttttgattttatttatcaaccttcatttctgtttacaaaggcatgtgagagataggtaacgtctcataaattttaaaaagaacaaagaaaaacattcaatatttagtttcaaagaaaacattcacatcatattaaacaatttatgtaggtttcaatttaaacttactgcttgaagggactgaaacaacacagaactggtctgtttaaataatatcagtatatagctgtagactgggagagacaaaaatagagcctgttttaaaggtaaacacatcatgaatattcctaaagagaactgcaaattgtgtgtggtctgtaaatcatagactgatctaatattaatttaatttttctactagactgtgtgggcaaggagaacgggtaacataactatcacttatctcagggtccaacatggctcttggcatatagtatcctcttcaacaagtatcagttaaatgaaagaaagaaattataaaatttacagaatttacagagttcatcctaaagagacaagacaaagtagtatttggttgttgagtccacaatgtcacaacataaattcatatatgattctaagcaaatgacatgtggtattctttctatttgtcttattaagtgaatagtaagagccatgagggttcttgttagttattcctttattatagttggaaaattatggtgatgatgacttacatttcacagataatgaggctaagaggcacaaggaatgaaggtgtgttcacagaataaatggacagaattggtctttgaatgcttgttaatatggcatctggaaggcagacctcatgcttcccttcctttctagctacaagaaaccagacctgaaatcaaaggataacacagaggggcagtagggtaagtatggtctcatctaaatccacacaaggtcatctcataccacttagcttgggagtgcttgaaaaattcaggacaggaacagggacaggagaggacatcataatcccatgcctcaggggaatactacaacctaacaggaacataactgaaaggcaagctaaccaaaacaagtttacaaaagaggcaaaaataaaatttcactcatctgctattaaaattttaaataggaagcataaaccatatgaaataaactcaatcttcacttctatattatggtgaattagtgaattaagggaaaaaggaaatacaggaactgtagattctgagtagagattagaaataaaaggaagaaataaagttgaagatgaaaagaaaggaagtaagtcagagggagagacagcagcagacagatggagggaccgtccgagttctagttcaagggtagactaacagaaactgtgcctcggttcttcatctgcaaaaaaaaaaggactaaaaagagtatttaccctgacagcattgttctgaggattagtgttacgaattaaaatatgtacaaggcttcaaagactacctggtacagagtaagcactcaacacatattactatcactttgataaacattatatcatttgtgtgtgtgagtgtatgcatgtgtatattagagtgtacatgtgctacaagactgctttcatgtccttcctttaaaaaaaaaaagcatatcctacttctcggtggctttttaagttcatgttttattatctgtcctaacttctttgggtggaaaccagaaggccttctaggaaaacaactgaggagacagtgccatacagtttctctacaaaagaaacttctccaagggaaatcagaaacctcctctttcttctcccccaggacctaagatatttttcatgcctggaaatgagagttgcagcattgggacctgtttcctctctgctttttctgccaggaagattaggtgttgtacccgacacaccaactgcacttgttcctatgtttggcatacccactttccccttaaactgagttttccctttgtaattctattttattcatccaaatgattatgtctattttgagcttttttacccacacacatacacatacacacacgtgtgcataaacacacacacacgtgtctttttaataaattaaaactgagcagcaccagacttttaaaaatacttcattacatccgaggccctggccagatttacttatttacatgttgttttgcattttaatttagaaagcaccaatgccaacccatactcccccatagcttgtcatttctgacaacatcctgagtaattccaggggcgaatttttcagagggaataatttaactaacaaattgccatttaaaactaatttatccttttgagctgagtgcaatatacttggaggagcattccttaatgacttgtttggataatgtttttctccacagtgttgatccctcaacattagaaactcagagagttaattcctcacatgaaaaacataccccaaacttttcttctggaaaggtcaagatcaaaagcagagactatcccccagatttttcattttctcccttcccttcccctcccttgccttcccttcccttctctcccctcccttcccctcccttcccctcctttcctttcctttctttcgcagagactatcccccagatttttcattttctttccttccttcctccctccctccctttctttccttccttccttccttcttaatctttcttttatcttttcttttctttttttttttttggaaacagggtctcattctgtcacccaggctggagtgcagcagctccatcacagctcattgcagcctcaacctcctgggctggagtgattttcctgcctcagcctcccaaatagctgggactacaggtgtgtgccaccacacctggctaatctgtatattttttgtagagatggggtttcaccatgttgcccaggttggtctcaaactcctgggctcaagtgatcctcccgcctcagcctcccaaatgttgggattacaggcatgagccactgtgcccagaaaggatttttcattttcaattaagtattttctgcccagttataacttcaaagaacgttaggtacttcattcaggggtctatatttcattcttattcacagaagcatctagttttgaattgttactatgcttttatgcagtgctatgttttcaaaatccttttttagtcatttaaaaagctggtcctcattatatctccaccagattcttcctcctccacagatgaaaaaggaagttgaggtttggcagactgaagacatctgcccacagtgtcactggaatcacagggaaataggctgtggtttacactatcctgctggggatgaaaatctacttgtttgtagtctccagggtggtaaagagcagagggggaaaagcaggatgcacagtattcagggtttagctgaatgtcaagttcagcttcctcatctcagatgtgaggctgcaacctgcctatttacttcacgttgttattatgagtgccaaactgtatgatggacgtttatgtgccagcaatttacaaacaagcaatcaatacacaaatgtaaattatagtcagcattttttcctattttggtggcttctgagactctacaatggtgctaagtgcccaccttgtccagaaagagaattcaatatattcagtgtattactgtgttttaacaagtatacagaagtgtgacaggtgagagggacagagggagaaaaagaacggggcggggggtgagtgagagagagagagatagtgtctatgtatgtgtctatcctcgatgcttgcaatccatggttctcagcagaactatgccattctccatgttagggtcagccagtttttatagttggaaaaactgagaagcagagtggcatactgccctaggtccttctgagatatttgctcattcaacatgtattaattacgtacaagtttgctaggcaagacgctgggggcatagaggtaagtcaggatccctggccctaaggtgcccccagtccgtggtgatgcagatacctgggcacatagctgtgttagaaagtggcagtgttattagcaaggcacacaaagtacctatatcatcatcctgaaaaaagcctgaccatactctgaatagtatgtggacttcctcagtgaaagtatctatctagctaagccactgtatccccaaagccaagcacagagcattttgtaaatacatacccaggtcagagagtggctaccccatgggccccagccacactttcaatagcagtcatttttcctgcatttatcaaaagacattttggaggcagaggattgtttggtgttgtattatttatctttatctatattattatttacctttctcctcttcctaacacaggaacattccagatcggtaggcctcttgcaagctgagtctataccaaaagtgcacacgttgtggaagactgaggttataaaggataaatctgtcacagagacagagtacaagggctggctaatctatatttgcttgttgtaactgaacagggaatttacatttgccagaatagcagaaaagaaatattagcttggacattcatgcccttattcaattatttttttttactataaccaaaacagatcttcatgttttttcaaatacatttggtcagtcagtcaaaagaatttgaaaagcatatcacaagtatttaacttccttctatcagagagtgatgggacagagacatgagggaagtgaatcatttcagcataaagcttttgttaaacagagctaagttaaactgaactaaaatagaataaattggatgtatgaagtgtgtattatgggaacttatcctgagacctcttctgttcagtgtcttttcttgatgtcttgaacaaagattgctataatacactcactaaatactcaccatcatcaagttacttgtgttgaaggcatgtcaggtgctaagaacacagaaaggttgaagacaagtgtttaggcttcacgcttcaagagggacaggaactttcagagtaaattaaagtgacaaaaaagtactttaagttattgaaaaccttgctaaaatgaaattaaagagctgaaactctacccagagttatatgactgacacagtcacagcagattataacagaaagtcatacatgtaagaggtaaatcctaattccacaggataatgtcagagaaatcaggtcctatgaagcatccctcacactgttccccttggccaccatctgtcaagaagtggtaccaggccagctcttgttattaccataagaagcagagagatatgagttgggaggatccaggtcagatggactcctaccaacctcttccaattgaaatccgggcacttctaccctggcctcacccctccacaccttgcttggctggcctgccttgcactggcctcacctgtgaccatgcactccagctacctcttggacagactttataccagcctgaccagaaggttttcttagctatgatgttcactgcccaatttttccttttgtccctgctatagtctgtattataaatttcatggttagaaatttaatgttgccaagcattaagaggtgaggcttttcaaaggtgactaggctatgagggaggttatgccctcatgaagggattaatgcttttaccatgggagtggattagttattgtaggattgggttagttattgtgagagcgggctcctgataaaaagataaggtcagtccccactctctctctgtctcacatgcttacttgcttttctgctttctaccatggaatgatgcaacaagaaggccctcaccagatggctgagcagatgctggcaccatgcccttggacttcccaatctctagaaccatgagccaaataaatctcttttctttataaattacccagtctgtggtactctgttatagcagcataaatgaactaagatactccccacctcacatttgtgattgttttggatcgttttcccacgaacaaaactcctagatatgatccttttttttcttgagtgaattaccctctgagtaaaaatctagcctttgggactccagatgaattgtggaagaaggtatgggaaaaggtagagtaattattttaaccaagtattataggcgccaggcaaggtgctaggcatttttgcataccttatttaattttatcttcagtacaacaaagcaagggaagttaagatatggagaaagtcaagtgtcagctagaagcagaagagtaggaactcacactcaggtcagttctattgcaaagctttttttgtctcaccagagctgtcaatgataaaaccctaaattggatggattatagggtctggccagaacacaggacaagatggatctttagctggtaaacaccagtatggccatatcactgttttaggccagcatctgttctgcttggtcagtgcccaagacctatcatttgttaaatatttaggcatcattgttgcccatctcaaaatgaaatgtttgccaaataccaaatgtttgacttttactctggcaaggagagagtaacagtgactggatatggtctcccacctgaaacaactaaaaagccagataaagtatatgaaacatggttttcagatactgggcatgaggtaatgcaagacaatgattcatgaaagaagtaaaacaaagtgagccatatgattgccccagcttattgccaggagagtttccgggctacagcacagggaagaggaactctggaaaagtctgacagtctctctgagtaaagaaatagttggtagtttaggatggcagcttagagttcatagggtaaagtaccagagagaagagaatagcacacatgtgtgcacacaaacacatctctccctggagatataaagcaagtcttgagttgagaactaatcagtgtatgtgtgtgataaaactacactaagctaaagaaagaaacacccaaaaggtttagaaggaataatccataaagattacaaaagactattctcatcagttagagtagaaaagcctcataattcatgatgttattgggtagaatactcagaatggtatcacctttgtagtaggacaaaactagccctagacaaaaagctgctgtgatctctcataacaaaacttaaaagcaagcctcaaaaggttcaactgcttcccagtaacttaaatgggtcctaaaataaacttcacggatatgagaatacaaaaatacccagcacctagcaaggtaaaattcacaatgtctggtaaccaattaaaaattaccaggtatgacaggataattccaaaacctctgaatatattattttacatgtcaaaggaattaaggatacagatgacattaagattgctaatcagctaactttatgacagattattctggattattgatgggggcacaatataatcacaagagtcctaaaaaggggaagagggaggcagaagagaaggttggagtaatttgatgtatgaagaattcaaccctccattaccagttttgaagatggaagacagcaatgagccaaaaaacataggcaacatctagaggatggaaaaggcaaaaaaacagattctcctctggagcctccagaaagaaatgcagccccgatgacatattgattttagcccagtgagatttgcatgagatttccaaccacagtactacaagataataaatttgtgttgtttttaagccactaagtttgtggctacctgttatagcaatagtaaaaaatgaataaaaagagaaattacataccaggcatacaaagaagcaggaaaatgtgaccaataataatgagaaaaataaaacagtagaacaaaaaaataaataacacatagatgacagaattcgtagacaaaaatattaaatattcataactgtgttccatgtgttcaagaaggcagaagggagatttaacatattaaatagagagatggaagattaaaaacagactcagaatgtacttgtagggatgagaagtacaatgtatgagataaaaaatatactgtatgaaattaacagcagatttgatgatttatttaaaaagttagtaaactcaaagaaaagcaatagaaactattcaaatgaaacgtggagaaaaaagacaacaacaaaatgaacagaacataaaagggctgtgggacaactgcaaggagtctaagatatttgtaattaaattacttgatgagggtggggcaagaacaaatatttgaacaaataatggctgaagattatccaaatttgatagaaactataagctcacagatctaagaaactcgagaatagaaggcacaagaaacatgataaaagtatatgagggaacatcataatgaagttacttaaaatcaatgataaagacaaactcttaagagcatccaggaaaaaaagacatattacatacagaggaactaagataaaaataagagtatatttcttgttggaaacaatgtaagccagaagacactagaatagcacctttaaagaactgaaattaaaaaaaaatcttttctttaactttttctttacccagtaaaaatacctttcaaaatgaaagtgacagaaaaactttttctgacataataagctgaaacaatccatcaccagcagatctatactataagaaatattaaaaaggaattcctctaggcagagaaaaatgatgagctgtaaatcttgatctacacaatggaataaagaatatcggaaatggcaaatatatggttgaatagaaaaaaaaaatttttacttatttttgaactctttaaaaaataattgcctgaaaagagcaaaaatactcacaatgtattctgggtttatgatatatatagaagtaaaatataagacagcaaacataatacaaaagtatatagttcttacaatatatatgaagagataagccaacaaaggagataaaattgaaatcataaagatactaagtccaaaaggtggcagacaaatagaaaattggaataaaaaacagaataaataaaatcaattattaagattgattttaacccaatcacactgataatcatattaaatataaacagtctaaataaatatccaaaggcagagatcaatccaatatatcagattggatataaaaactatatgctacttataagaaactcacttttaatacgaagtcataaataagttaaaaataaaaggactgaaaaaaatacaccatgctaacattaatgaaaagaaagctggaaagggggcatgctaatattaggaaaagtgaatttcagataaaaaatataattatggataaatgagtcatttcataatgataaagaggtcaatttaacaagaaaatataacaatcccaaatatttattcactgaataacagaacttcaacatatatgaaataaaaactaataaaatggaaagctgaagtagatgaatccacaattaacagtcagaaatttcaacaaccctctcttaataattgctagaacaagtacatagaaaatcagtaaggatataaaaatctaaataatatcaaccaatttgacctaactgacatctatggagtacttcacccaacaaaaccagaaaacacattcttctcaagattacatgggtatatttatcaagattggccatattctgggcataaaccaaaccttaataaaattacaaaaacacaaatcatataaagtgtattctgagaccacaatagtattaaattataaaatagtgatgaaaaatatctagagagtcaccaaataattagaaaataaataacacatttctgaatagcctgtaggtcaaacaagaaaccaaaagggaaatttagaagtactgtgaattaaaataaaatttcatgatatgcagctaaaacagtactttaaaaatgtttaaggcactaaatgcttatattagaaaagaagaaaggtcttacatcaatgaccatggcttctatcttataaaaaaaaaaaaccttaaaaaaaaaagagcaaattgagcctgaaataagcagaaaaaaaaattaagaacaggaattagtgacatagaaaaactatagagaaaatcaatgaaaccaaatgctagttctttgtgaagatcaatgaaattgataaaactccagccagccttaggcaggaaagcagagaagatacaaactgctaatattagacataaggaatgtaacataactacagttcccatacataaatatcaaggcatattacaaaaattgtatgtcaataaatttaacaacttggaatagatttcttgaaaaacacaaattaccaaagctcattgaaagaaaaacaaataatctatatagctctgtatctattaaagaagtagactttgtagttacaattattcccacaaggaaacttcatgcctagatgactttgctagagaatcctactctagtagaggttaaatcttaaggaaaaaataatactaattctacacaaactcttccagaaaattaaagggtataccttccaatttgctttatgattccagcattacttttgttacttaaatcagataaaaacattagaagaaagaaaaactatagacaatattcagcatgaactttgatgcaaattctaaacaaaattttagcaaattgaatatagtataatgaataatacatcatgactgagtagtttatcccagagatacaaggttggtttaacattaaaaagtaattcacgtaatttaccaaagtagtagactaaaaaagagaaacacacacacacgatcatctcaatagatgcagaaaaagcgtctgatgaaaatctgacatccattctctcagtaaactaaaaatcaaaggaaatttcctcagtaaaggttatgtactttaaaactacacatatgatcatacttaaaatggtatttcttcataaggtcagaaacaaggcaaggatatccactctatttctattcagccatcaggatatatgacaacatgcgtgactttcagaataactatattgagtgaaagaaaccagaaactgagtacattctataggtttcatttacataaaattctggaaaatgcaaaataatttgtagagacagaagatcagtggttgtctcaggatggggatgagtaagaaagggggtctgagtaggtaggaggaagagataacaaagggaacaggaaatgttttggtgtggctgatatgtccattattttgattgtgatgatttcacaagtatatacatatgtcaaaacttatgaaattgtagaatttaaatatgtacaatttattgtatgtcaattcattaaagctataaaatataacagatactttaggtcataggtaaaaacgaaaacactgccacagtgaaccaagctatatccagccaaggtcttggtttcaactagggaatgcatgataggagggcatggttgtcctccctggcagcaacttaaaagcatcagatatgcatatataaagctttttagtttcctaacaagagatacttaatagatctcaaattaaacaaacacagccagttatatgccaattctatagttttagaagtcagcaagcagcatattggggattatggatgaactgaacaaaatctagcataaaacatggtaccagacctcaaagggttttgaagactgtcgatgatttggtagagtgatgctaattctcactctcaacacaatccaagcgaggaaatttctccaaaataagataaaaacttgcagggttttaggtgtcattgtatatctgaatttactccacagaaattcttctcccaacttgttaaatttcaagacttctccttggagccatgagcagaataagaaaaacacagatggctcaacttcacggtaataatgattcaaggcaagcaaaccttcagctgtttatatttcagattaaaatagaattgaggagagaaacatcattctgggtgctaaaatgaatattaagataaagctagtgtaagtattattaatattgcactattattattttgggtttgcaatccataggaaatccatgtatgcttctgtttgcttcccttacaactggtattttaaataaattctgcatgctcaataaatagggtctatttactcaaaggcgacagaccccatggtactctccacaaagacttccctcatggcctcctgctgctgttgtttatagggctgcaattacagaaaggattctcagcagaacgagcaatgacaccattaccatcaacaggaattctcctggcactgtggagattctttattgaaagaaatacaaagccagtatgttgctagtagaatgcatgaatttgttgggcaatggctttctccttctggacaccaccctgcaggttaatgactctcaattctgagcatccttcttctctccttccagcaggtgttttcacacctttctaagttaagtgtcccagaatgtaaaggctgccactacagggaggcagcaggacacaatgcatgagactgatcggcagtgaagccggactgcctgtgttcacatcccggctgcaccactcactaacagtgtgacttcaaacagattacttagcttctctgtgccctggtgtgcttattcctaaaaatgaagtaataacagcactgatttcactgggtgaggattagataaggactgagatgcttagaaaaatgcctggcacatacacaataaatgcaagcaattattattattaacacagctttgttgacacaataacatttgtagagaatgaatgacagcagctactctaagctgcctccttatggcaagcacagtaggaacaagaaatagaaatacttcctctaacaatgcagcaaaatcttctgggagagagaaccatacaagaccagcctattaaataacaataattatattaataccacccattactgagtaccttctacacactgcagtgtgtaaaatgcatctatatattatcttattcattcccataaccccatgaattagatgatataacttccattttccagataacaaaactgggactcagagaaattaaataatttccctcagttcacgtggctgagacaaacatttctgaatagaactacctggctcttagccaggtttttccgctatgccatgcaccttttcaacccaaaaggtagtggtgtgttctgagcaaaggcattcaggagaaaacaaacctgtcaggaggcagagtttccaacagcacactgtctttgaaactattaaaagaatagtcttaagtgctgctgggtgaaacaattaaaaggatagtcttaagtactgctgggtgaaacttgtcacacctgaacacagagatagcaatcctcattgctgggtcatctctcagtggcaggataatatacttgaaaggatgatcagttgtttcctggttttttccttggcccctactaggtaccctgattcaaacaaggctgttcattggttagtttctcagagaaggatattgtgtagaaagctcagggaaaaaaaagtgtgtggtatgttggcatcatggcactactggaactggaaggactgtggcactgggatctagtggtgggtgccccgctttctggatggcagggaaaggttctctgatgcttaaatgagtccttttttctgtacatttgggatatttcataattaaaaattaaaaagtaattatctataagcaggagaaaattttatcttataatatcaataaataactcttagaatactctcaagattaattttgagaggaaacttataatcattaacttttatattgagcaacaattctataaaaacacaacagcctaaatcaattcaaaccttaaagtaaaaatgtttgcaacatatatgacctattttgtaaaggggcagaatccacaacaaagaaccctagtaaatcaacaagaaaaaaaaatgtttcaacagataataagtaaaaaacaaaagggaaatttaaaagagaagaaatagatatggtaaattaagatttggaaaagttcaaataaaaacaagatatttttcacacattagcaaacatttaaagaaacaataatagtagttttggtgagaatttgagggctgggctaacaatatgtgtagctagcattcaaaaggtatttatttacatgagaaaattttgccattttttcttcactggtaagaaaaaatgataaacaaccatatatttggaatgatatcaactttttaggattaaacacattcgtttatacatttgtagaaaaagaaattggaaggaaatacatcaagacacatgtagtggttatttctgcatcttcaaatgacaatttttgctcatttatacctttgtgtattcaaatttttataataaaattacattattaaaactttccttggggccgggcaccgtggcccatacctgtaatcccagcactttgggaggccgaggcaggcagatcacttgaggtcaggagtttgagacgagcctggccaacatggtgaaaccccatctctactaaaaatacaaaaattagctgagtgtgggagccggtgcctgtaatcccagctactctggagcctgaggcaggagaatcaattgagccttggagatggaggatgcagtgagctgagactgttccactgcattccagcctgggcgacagaacaagattctgtctcaaaaacaaaacaaacaaacaaaactttccttggtacattctaggttctttaaacaacaacaacaaaaactctttgatggcaaatggaagagacaggattcatgttacacatccctctgtgtccttacagggatgtgctgaggatgtatgaaatttctttgtaataatgtcgttgttttcccaagagcattatttaaggagaatggacaggtctatgggaaaatttaactttgtatagaatgatttttaggtctaaaaagtctagttcagcctgggaacactcttctatgataaaggaatgaaaacaacacaaatcacaatatcatattaaggtgattttcctaaggaaataatgtgtttgacagctgctccccattcagtgtatctgtaagtgaagagagtcaattgaaactaatgttcaccaaagaccacttttagccacccattgttgacttggatgtaaaatggtaagcattgtgtttgaacgattaaaaaatcagaaataaaattactttttgatattagaatctaaatggtccaagaatatgattgtcttggggattctttttgagaaattaattttgacacttcactcactttataaatagaaatttctccttggttgttttcttaacatgtttagaattgatgctaacacactttagtttattcattgcagccaacttttgacaacaagctttcaaattctggagtttaaatatcaaaacttgacgtggtaacattatagaaaaaagctagtggaacacctttaaaaaaatggaatgttgaaaaacaactccaatgaatttagaaatggcagaggaaaattatatgagaagatttagagtcctctaaagcaaatgatttattgaaatattttttcccccagcaagtattaataagtaccttccatatgccaggcattgttttaggaactggagacgcaactttgaacaggacagacttgcttcttactttctggaagcttacctcccagtgaggattgatagacataatcaaaaggtaaagaaagaagttactttcagattgtgctaagtgccatttacagggatgtaggagagttacctggggtgagagaggagggaggaagccgtttgattggttaagatggtctgtctggaaaagaacttttgagttcagttcctaaaaacaaggagctggcctgtggtgggaagatatggaggacgagattataggcagagggaagagagggagcaaaggcctgaaggcaagagcaaacctagcatgtttcagaagtaaaaggaggccagtgtggacagagcctggtgggtaaggggtacagtgacagatatgagattcaacaggggattcccaagggcctcctcatccccactactcaactggataactactgtcttttatgcctattgactttctgcttgaacagtcatttaaaagtgttgaaaggtgaaaaagaaaggtttaaaaatctctgtagttttaattttattctgattgctagaggagatatataaacatacacatgcacacacacacatatataaacatatatacacatatatgcataaacatataaatatgtaaatgcacacatatatacatatgtaaatacatatatatacatatataaacatttatagatacatatgcaaaaacatagacagacatatacataactggtgttttcgaacatttgacaaggattcatactagagaatcagtggcatagaaattgcagtataggaggtaaaattggatattaatgtttggaagtacttcagactgctcaggaaaagttaaccataggtgggtggaagcttttccccagctggagaagctcagtatgtcaatgaaaccggaggttactaataaaaacacatgaatgacatgaacaggtctattctgaaaatagcagagttggaaaatgctaacgttagagacagagtcagtaacaacaatgaagcctgccagattggtgtcacttaagagacatgatctaaatagaaagaaactcaacccattgcatgaggatgcttaagttattttgtttgaagagaaatttatcttgctcagtggaataagccagaagactaaacaggaaaagaccattagggaaagatacccaacgagcaaatcagaacaatatgaaaaaagtaatatcttaaagccacctatattaataaatttggtttgcctgttcagagttctaaaaatgacttgtgaggggagagtacagtgtttctttgtactccattactctttggggtaaaacctgtttgacaactcagttcaacatgactgacagtattaatcatgcacctatatgtggctagcactgcactaggaagtgtctctgctcataaacagtgaaacctactaaagagaaaaggcatgatgttaacaccacctgggatgtggagtgtatccatttcacaaaatcctatcagcagagcaaataatgggaacaaattgactacaggccagggtcaaatcctaaggtaaaagcagtaactgccctcgggtgggtaggagagagcatctctgaaattggccagagctaccagggaaggctattagaatgaagtgggacttgaggctgcccttggaggagctggtaaaattttgataggtggagaggcagaggaaggtgtctctgaatcattaacagctgaacaagagctgttcaatcttatccaactgtgagtctggaaacactgcctaattattaactagcaggtgaaaagaacagaaaaaaaaccactggtgccactgccaggcttccatctggctgtggtatcatcaggaggcccttaaagttatagttcttgggcaataagaaggcagcatcttttactaaattaacaaaattaacttactaaataacaaaagtaattttaattacacccagatttagcagggaaactaaatagcaaacattcaagtaagtgtctctgttgataagcatataactagaaacactcttttggaagtaattttgtgatgtctcaacagtaactaaacgaccatgtcatctgttgacctggcaattgaccttaaagaaatagtccaaatgggaaataagaagtcaaagatactaactgcagagttattgatactattgaaaaactggaaacagctcaaagactaccaacagagtagtcaaagtaatggaagcagatgtgtgatatcattcacccatggagttagtaaaagttaaaattattttaaatagcccctgttggtgtgagtgtaaaatgggtttaaattttatacagggcaattttggaaatatcaaaatttaaaatatgcattcctctgaatcagctccagaaacgctgagaagggatcaacagttaaaatacttaatccacgtagagggctttactgactccaaaacatctccttatttccttttttaaaaatgacattatccacaatacatatgatctttgaaagaaaaggaagaaagaaagatagatattattgatagtcccattttctaatgaggaaactgaaggtcaaagaggtaaaggaatttaactttctctagccctaagttcatatgcctgaaaaatcatgatgcaactggttggaatttcacaaggctaaatacagtcatcttgtttaagtgaaaatatctcttgatttagatatagaaccccatttcatggagccaagacagtagggtctacggaaacaatggctgtcctattcttccctggagatgataacactgcttctactacacttgacagagggggagaaggggagaacaaaaaaaattttttggtcttctgacctagcctgtatgaaagaacaaataacttatgtgcaaatataagatacagtgtgagtgctgaaaacgaggtaaggattatgagaggtctattatctacatgtgttgtatatacttggagaacacgtttgaatgggggaggtgcggcattatttcacagcaggagaaataatcattctcatcatttctaaaagccaagcagccttcagtcagtttcacaataatcaattaattagctaaagtaaatatttagaatgagttacggcacaaagatatgaaatcatggcatataaatgagctttagacatgtaaactgactctttaggaggagaaattactcaagagggagaagtggtattgcaccagatggctgtgtctaataataacttcaatggacacatatgatacttgtttaattatttatcaaggagaatgcctgcaaaaatttagtaagtttataaaatttttggcaagtacaagactgtgtcagccaataatgcattttgagtttaaaatgctccctcttggtggcttatgataatacttaatcctagaccaaggattcaccatttttctgtctcagtttcaccatctgtattaagaactgaaaaacctttacccaaatcagggagtttgggactctttaggactttactttttatattatcccctgaatcaaatacttcttcctacttaaaccatttccaaaagtgtactgtcatatcctaattgtcttaattctgtctcattgccatttcccccttaagttgcctcacaatctatctgcctgacttctagacaaataacttcaaagagttgtctatagaaggtttctagttttctttttcatttctcattattctctttcatttctttctccctgcctcccttccctttttcggttttgtttttgcttttcgaaggagggccaatttaaaaacaaaatgaaaaaagcacatccattactatctgaaggcactggctactacgaatcccttttctttgtgcagcccttttggctttttgcaagacctccctatgtaccatctcacccgtttcttatgatattgttcaacctttaacccactgacctgacttctatccccacagctcccccagaacggcccttgtgaaggtcaccaatgaacccggcccccattgcagtcttttaactttgcccctcagaagaaatcaatcatgccggctactacttggctgaatatgtgacttggatcccgtaacgttgcacacttctctttttcttctaattttctgactactcatttcctctcaaccccctttgctggcttatcaccttcttcctaaactataactgctggaagttttcaaagcctactgctgttccctctattctctttatgccatttccctcatgcccatggtgccagtcatgctgatgaacacagatctctctggatgtgattatcactggcccacccatctcttactccagacccatatatccctgtgtctactcaatatcaccacttaagatatcccacaggagctccaacccgggaagtaccaatctgagtgcatgatttctccctctatttgttcctcctgtgtttctcacttcataaacccatttacccagttgcttaagctagaaacttggcattcatcttgattctctctctctcactcccctgtcatctaatccatcacaaaatcctaaggcttctaccacaaaagcttattccaatttgtccttatctctccaacttcactatcatgccccaagtcaaagccctactcacctgggacctggacatgtgtggcctcttaactgattctcttgcttctattcctaccccacttcccaaatccattctcttttaacattaaattcaatcatagaatccctctgtttcagggaatgaataaataaatcaccttcaatcaattaattttagaattaagatcaaaccctttcccaggacctgcagggcctctaacaaccactttgagctcttcacataaccagttccacctcaaccaccaagctggttgtccaggacttctccaagcgagtcaagctccttctgcctctggggtcctcttctatgctcttccttctccactttccagagctggctccttctcatacctcagaatctcagtttaaatttagtctccacaaagacactgttcgtggttacctgaagattcatggtaagttcccccttatggtctattattgcagcattgtattatttcctttatagtaatcattaccatttctaatgatacgttcatcaatcagtttacttgtttactacctgtctccacaatcagaatatgagctccatgacagcaggaataactttaggtattcacaataaaacatggttaataaatatgggagtgaaggagggatactactaaactatgacattaaaactagtatgaggccgggtgcactggctcacgcctgtaatcccagcactttgggagggcgaggcgggtggatcccctgaggtcaggagttcaagaccagcctggccaatgtggtgaaacactgtctctactaaaaatacaaaaaatataaataaaaaaaattagccaggcgcagtggcaggtgcctgtagtcccagctactcaggaggctgaggcaggagaatcatttgaacccaggaggtggaggttgcagtgagccaagatcacgccattgcactccagcctgggcaacaagagctaaactctggagggggaatgtaatattaattcaaacacccattttttttcttgagaataaaattttagtttcaatattttctatatattttggtttcatgtttacaaacacatttaaaatcattaatatgtttttctttaaaagctactgatttccttatgaatttgtttttttcattcaaagtgtaaaatgaatgactctcattagatgtgttttgaagaaatatctttgctgtgttcttttctctgtgttcagccacgagaaattggtgtgaggctgctggagtgggatgggtccctatcctgacaattataagtcagtataaaaaagtctgaggcaaaagcaggcatagctctgtgggcatttctgatattttacgttagtcattagaaataattcatataaaaaaggaagatgaccaataataagagaaaataatgtgaagcattgtattttttaattgctgcttgaagagagttcattttcagccaaaacacaatagtactttgctcctttggctagaagtacaagtgattccaagaaacttaagtattctcagagctacctgctatgggtatttaggcctaagtcctgataaaaggtaatcacaagcttttaagaaaggtattttttaatttcttcttttcaaattggaaagaaagtgggcaaatggtttgtagtgttctaataaaatagattagataaaaggggcaagaaatcacaggctgaagtttttttattcaatacatatttattgaatatcaatgcataacaagaatggttccaggaggcataagaaacacaaagatgaataaaatatagttcttcccattaagaggctcatcattaggcagaacatacagattagatagatggatggatggatggactaacgacaggtgggtggatggatggatggatggatgggtgaaaggacaaatagatacagcataaagagaggatgaatgattaagcatggtcttctagcacaaagaaagttacaagaattatacatgaaacaaggaataattgagactctatgaatgtaaagaaatgaatgtagttcattaatttgatccatatctcagttgccttactgatatggtttggatgtgtgtcccctccaaatctcatgtcgaaatatgatctccagtgttggaggtggggcctggtgggaggtgtttgggtcatgggagttgatccctcatggatagccccttcctgtggtaatgaatgagttctcactgttattcacaggagagttggttgtttaaaagatcttggcaccacctcctctctctcttgttccctctcttgctatgtgggcatacctactgctttctaccatgattgtaagcttcctgagacctcatcacaagcctagaagatgcaggtgctgtgcttgtatagcctgaagaactgagacaaatgaacatcttttctttataaactgcctagtctcagggattcttttacagcaatacataatgaactaatacacttgtgcaatatcaataggcttttcctttaatatctacaaaattcttacagagaatgaatgaaaaatgaagtctcctcttgaacagcccaaggttaggctgctcctgtatgactagccaatttcattgagtgaaaattcaatggcatcccgaacttggcatgttcttcattaggcaaggaaaggaataagcaagagtgcctggagtatttctctcaaatctatcaaaagcagagaaaccagtcaagacacactgttctgtagaactaaacaagataatctccagacctctgtctccttgtccataatatgaaagtgctgtggcagccaatgatgagcagcagccatggctctgcattactccggggccctgggcctcaaacaagggccacgaggtgaccaagaacacaagcaagccgaggcatagccgctggcacgaacatcccaccaagcacaccaagttcatgggagatgtgatctgagaggtatgtggctttgccccacgcaacatgccatggagctgccacaggtctccaaagacaaacaggccctcaaattcatcaagaaaaggccaaggaggaggaagagagaggagctgagcaacattctggtcatggcttccatgaggaaagtggctgccaagaaggacgaattcctcccctccccacataataaaacctttacaggaaaaaaaaaaaaatgcaagggctggaccagatcagtgttagcagaaagattagcagatagatttcttcacatatgaattggtgttggctccttggagtgctatgttgcaatggaagcacacattctacctcagtagcaagaaggccctctgatggactagcaacatctgccatgagcatgggaatagcgtgacacattcactactgtggggcagatcactaaggtttaacatttaaaccttaatctacctcagtagcaagaaggccctctgatggactagcaacatctgccatgagcatgggaatagcgtgacacattcactactgtggggcagatcactaacatttaaatgaaatgttatctccagggccgggtgcagtggctcacacctataatcctggaactttgggaggccaaggcgggcagaccacttaagctcaggagttcaagaccagcctggcaacatggtggaaccccatctctactaaaaatataaaaattagtcaagtgtggtcgtgtgtgtttgtagtcccagttactcaggagactgaggtaggaggatcacttggatagcttgagcctgggaggtcaagactgcagtgagccgagattgcaccactgcactccagcctgggcaccagagtaagactttgcctccaaacaaaacaaaaccagcgtgagatattattatctaaagtcctttcaaactctcaaatcttatgatttccactaacattgagttggtgtgattatcttcctatatagtggacaacatatcacaataaattcttaattatccatactttcgttatttttgccccaatgttgctttcattctcatgaatgtgatccgaagaaacacagccttatccacaagcatggagcccagcaggaagctgtttaaagcagaatacttcgtttactcattcaaagaagcccatgccacgtaggctgcgatgggctcaggaatagcaagaggtttgccaaggtgatgcaggtgagaaaatacgcatttcttgttctttcctgctcatatttccacaaagtttctttacagaactgtaaattcagaaatcagatagagccatgatgaaaacaattacaaataaaaacaaacgatggccacttatttgagatttcagatagcatgtaccccggttacctcttactgataagaaaatctctacttgtgctgctcttttccaaagattgcttgaactgagaccatctaatcgctagcatctaaattactattcattttcgtgtttatcctctggtactggttactcagcagatgccactgctacgtcaaaagcccggaaactggcaggagaatgtccttccttttcttgctccttgtttcttcaaagtctagcaagatttgagttccttacaatgattctcctgcatcactcacatggctgtatgtgtgactgactcggtaggagctctctgcatccattaaagaccagatatacaaacaaacaacatcatctccaccaaaaagattaccttaatttttttcttttttgagacagttttgctcttgtagcccaggctggagggcagtggcaccatctcggctcactgcaacctccgccttccgggttcaagtgattctcctgtgtcagcctcctgagtagctgggattacagacacgcaccaccatgcctggctaattttttgtatttttagtagagacacggtttcaccatgttggccaggctggtctcgaactcctgacctcaggggatctgcccacctcagcctcccaaagtgctgggattacaggcatgagccaccagtcccggccaagattaccttaaccacaggagatactcttcctgtggttcctgtcaaaagttaccatgttgctttattccttccagatattaaccagatgttagtcattttagcattgtgcatattaatgtcttatgttcttgatttttaagattttccctctaagtcttagaaagtcagagctttaagggagcctgaatacctgcctttgacagctaggcaccacaagggcctcgaaatctgtgcaacttgcccatggccactttgccaccgtgtgatagagcagggtaggagcaataccacctctccagggcccatggccctgtgctttcctcttgccatactgagtggcttttcctgcactttcatgcccttcccagtcttctccggtgggtgaggcctgcggcacactgggctcttctggtgcccctgcagaatctctggcatgcccctctcttggcgaagccccagcaaggatgacatagaaaattcagacaaggatgaaatcatcgttttcctctattatttttctaaattgcctttttcctacccatgactaggcagtatttcctcacagctggggatgaacaaattcaaaaagatgttctcaaatacatggtttccaagagaggccactaagtgttgaaagtataaaatgaacatttttgagtgattgcacagttcatgaaaatgtctctggttagaacctcatcagcagtgattcactctgtgcatagggtccccatggagactggagtcacctcacattagggtattgaggctcatttttcctgctgagatggaataaatggctaggatgcattaactgatggcggtcacaatggtcccatccagtgaagtgaggaatatttctttaaagatgcccttgtggtcagaaagacttactgaactttaagactaccatatttctccttccctttaaagaaaaagagtacttttgccctataggcataaacattcagaagtaaagcctcaaggtcaaaattatatcttctatgatagatagcaagataatgtccctgttaaagaggaaaatatagtttattacagttcaatcatgtttttcttgatgcccaaaacatctttttcaagataataaccaattaaatgagattatatactgtgtgtcttagtctatggggagcttctgtaacaaatactacagactaggtagcttataaacaacagaagcttatgttttggaggctaagaagtccaagaccaaggcacttggaagatgtgccatctggtgaggacccactttctggttcaaagacagcctcttctcatttcgtctttacatggtggaagcagtgagggggctctcttgggtctcatttaaaagggcactgatctcactcatgaaggctctgcctttatgacttaattaccacccaaagtccccatgtcctaatatcatcaccttgggggttaggatttcaacatatgaatttgggggtatgcaaacattcagaccacagcacagtgctggagcatagcagatactcaatacacgagttttaatttgtatatgcaactatgttttaggtactttacagctcagctacttttatttaaaaatttttcagttttaaaactgcatcgtaagtaagaccacagaaatgtagcatcagacaagcttccctacccattccaaggccaaatgaggatttttttgtttgtttctccaccagccaagaacctggggtgcttcagggactcaaactttagttgcagtttccaggcctcatggtttagaaggtctaaaataggcccagaaatctactttccagaggatgctgaaacagatgacctgcagcaaatactctaatgtaattgactcttgaagaacatgtgtttgaattttgaaggtccacttatcaccaattttcttcaataaaagttatactaagtatgcctgcctctcctgcctccccttccatctccttcatttcttccacctctgacacccctgagacagcaagatcaactttgccttttcctcctcctcccagcctacccaacgtgaagacgaggagcatggagacctttatgatgatccacttctgcttgatgaatagtaaatgtattttcccttatcatttcttcttcttttttttttttttgagacagggtctctgtcacccaggctggagtacactagcacgatcatggttcactgtagcctcaatctcccaggctcaagtgattcacctgcctcagcctcctgagtagctgggactacaggtgcatgccaccatgcccccactaattttttttttcagaggtaggttttaccaccatgttggttagactgatttcaaactcctggactcaagcaatccacctgtctcggcctcccaaagtgctgggattgtaggcactgggcccagccccttccttatcatttcttaataacatttatttttcttctagcttactttactgtgagaatatagcatataatacacataaatataaaatatatgttaatcaactgtttacgctattataaggcttttggataacatcaggctactggtagttaagtcttgggggagtcaaaacttatatgtaagttttttactgtgtgggggtgagcagctctaatcctggctttgtccaagggtcagctatagtgtcacagagctatgatttgtgggtgtgcattgggtacatgtgggtgcttccacgtggcttgcagagaatggttgtcacttctcctccaataggagatgtcaggacaaggggatcattttctacaggggccaagtcttctcttttcattcccttaaaatagaaagtcatccaaggtcactcttctccccttccccgtgccttcctaaactgctctccaatgagggtaacacaaactaacacatttgatccctataatatgtaccacacttcaccgattctagaaaaggtaacaattctctgatgatgattattccctccttctttacagacaaactcagagaagttaactaacttgcccaagtttacgcagctaagggaacaagcctggattcaaacctaagacctcaggctctaaagccaccatctgtctcttgcagagacagttcctcaatgttgaaggaaaaattttttctcctgaaagaccacagaaaggatccccacatactgctgtaataggctaacgcccctctgtccttgcactttcccatctttccaaccctctgcttgccatcctcagctctgcccatccagccacccctccactttcttgcctcatcagcccaccccttttttcatggctccactgccactcttgtaggagtgtgtagtccagctctgaaattactctcctgaaaatgctcatgccttctttgtgcccttgtcctttcattctcaccacctgttaaaatccaaccttggataaacccacagagaacttccttctctgtgcctgcctactgggaggacacaacagtgctggagaaaaccacgcagggctctcaaagagtgtccagacattttaccatatttttctggtcagcttcctgtctctcccccagtgaaaccttcaagggttctcccttctcttccaaccttccattcctcatcagcccacttatcctcagcagatgcctgtccttttctgagaaatggaatccattagccaggaactccctccacctgagttaccaaatcagcaatcccacctgctctgcattctggacttcccatgcaggatgtacataggttgactcaagtccatctcatttgtgttaaactttaaaaattccaagtttctgttttctttgagagagtgttacttgctttcagactgcaatgtatatattctctcccatactgatgatcactttttggttattgtcataaacctgagtgcatgaccaccatagtgttattcatagaagtctacttgatgttactaagttgttcctggttcaactttagtacaatatctagatcacaggacccaggttcgaaaatggaaatctgcagcattcaaggacaacaaaaagtgatgtgcataataattacataattgaaatctttaaatttcaatgtaatacaaataaatctctatgattctcccctacccccaccacgaatgatgtctttccacccaaggtatttatttttaaaaacaaaagtgtaaagatagagctggccttaggcaaaaaacgtaggagactttgctttaatcatttgcccccaaatcctaatacagtagaaacactttaggcagatagacctggttatcaattccagcactgtttccttccagctgagtaaccttgggtgagttaactcacatcacctaaactcagttccctcatctataaaatggggttaataatatttagctagcagaggattcaatgatgcaagatattagagtatttggcacatattaggtgccaaataattataggttttattattattctttttagtgttcctagtaaagtcactcatatcatagccccagatctttaacttcttatatccctaggcaatacatacattcactttaaaaagactttgtctgtaaacttctgcttccagccaccagaaagtaacaaggatagaatttattctcctactttaaacaactcaaaaatcaaacaaaatatatgaaatgacggttttcagatactgtacaacaaaaagtacaggatagtgatcattgagagacgggaaataaatgaagtgaaacttatgatagtcccagccactgtctagaaggtttccagggcttaatgcaaggaagagaaaccagaacagagcctgaggtctgtctgaattagacatctggggaaaccaatgcccctggaaatttcagggcagagtacaagagaggaaggagccaatcagagagagagagctttggagatcttcagaggtcccctcagagtctgtggctgcatgttgattaggagagacggagagggaagtgcaaaggctggggcaaaagccacagatggaacctttctgaagctcacaaaggacagggagtagctcaagttctcgagatccagagagaagcaacctcgcaatatgccaggaaagagttcccagaagtgttttgcctcagaaaccggatgaaattatctccagtctaaaggctgcttagatccattaacccaagtataaaatcaaagccttgagagaatcaaactgtttccaaggaacttgactgcatctcaaaacaaacaaacaaacaaacaaaaacttaaaaatattttaaagaagacaaaaaaggaaagaaaaaaaaatccagcacctgacaacataaaattcacaacgtctggcaaccaataataaattagtaggcatgcaaagaaacagaaaaataagacctatcataaagataaaaatcaatcaagacagagattcagaaatgtcacagataatagaatcagtagataagcacactaaaacagctattataaatatactccatctgtgcaagaaggtagatgaaagcataaccatgataaagaaagacagggaagatacatttttaaaaaagaaggaatctgaaaatataatgctcaattatgagaaaaataaatcatggatgtcaaataagggggctggaggtcatagttactcttcatatctaactgattgaagacagaaaatctatagtttagacagtctaaggaccaagtataaaagtgacttttccaggtattatgcattttatgtaattatttatataaatgaaccaaattacatattcattcaactatatagttaccaagcacccagctttaatgatagaggaaatacaaagatgattagctacagttctttcccatagaagaagtccagcacagtctgttagacagatgatagaataattatattagcacataaatgacatgtgcttacaattcaagaatgcagtatgtaacacactgtaaactagaaggcaggctgcagaataataaaaggaaataaaagcaaacagtggatctggagcagaagtcccctacgcaattaatccatagttacaaataaaagactttgacattaacccaatgcaaaaatccaatatacaataattcacatgcatgcacacacatatatacacacacttatatcagtatagaaacactcaaactcattctaatatgggaatttaattgtctggcttttctttctactctctgctgaattagaatgtccactctgagcagaggatgcatttcctagtgtggaatgcaaatattttccctcagcttattgggctgttaaagatactgaagcttctctactccagaggaaatcaagaaaattagggaatgtatgtatttgtgatatatacacatacaaaaattatatattatagattatatatttaatacatgtacatatgtcaatatgcatgcaattatttaaaaatatttctctagttttagtctagtgagtaagaatgtggccaccatagttctaaaggctaatgagtggtacatataccagagtacaacagagcaaataaagattaagctaatcaagaggtgcaaactggaataaaatttaaatatatatgtatttgttgtagtatacataggatgaaaaaatttttatattaataattcagaagaggtcgatctaatgctaagcaagtaaatttatcttattcattccatggaatagaaaagtgactatattatattaagcatttaacaaaagtttgtaacatctctagctaacaaggatataggcttttgtcatttgtggagaacaatctttgatttgctttaagtgatgtcagttaccttatatagtacatgggataggccaaagcaaatcttttttggaaacagattttacacattctcttatctctagaaatactgtagacaggctgggtgcagtggctcacacctgtaatcctaccactttgggaggctgaggcgggcagattgcttgatcaagcccaggagttagagcccagcctgggcaacatggtgtgaattcccatctttcctaaacatacaaaaaattagctggcacacatctgtggtcccagctactcgagaagctgaggtggagaatcacctgagcccgggaagttgaagctgtagtgagctgtgatcaggccattgcactctggcctggatgacagagtaaaatcttgtctcaaaaaaaaaaataaataaataaaaagaaagaaaaagaaacaaaagaaatattgtagacacacacacatcagcttagcactaggatgcaagttgcaggacagcatgtgtagcgtctatggcagtgcctgcacatggcaggtgctccatattccagtcccattggatgtatctaggccatctacctctgccccatctacctctgccatccctttttggacagcagccttctagatacaaacccagcctccctcccctcttgccattcttcaatgcagtctctataaaacaagtcagatgcttttttgttagcagaaataaagaaacaaaacacacgagtcacaggtcacttatctccttaaaacttcagtagtttgcacttcaaataaagtctgtactccaagctttggaaggcatggtctggccccagcctatcctaccagacttgagttaagcaccaacctgccaatcccactccatcccaaccaccacctctggcccacatacacccacttttctcttctttgaagaggataagctcctttcatctcaggtctttgaacaggacattttctgcttttagaactttctcatcttttcaaattctccatttctttctgctcttccttcctgctaactagataagtctaatttatcctttaggtcttagtttgaatattactactttaggggaaccttttctgaagcttctccaatacctccaaacaaagttagcctcccaattcctctttgtaacatcccacaattataattagtcatttgtataattatttgataacatcttctttagagatacgtgttctccataagagcatcactggtcggtcaggccaattgctgttcctctagtgccttgtaaaaaatgctgtaatactgtggtgagtaaataaatataccaatgtaatgtcctaatgtcctggggaagaaagggtaagtaaatgcatagagtgtaacagaactgtcacaagtacatgaaatcaggtacataaattgtgaaacataagtcaagggcctatttgttttctgacacttgatagtgagaaatctttcaacaagatggaaaataaaaacaaaagagaactctgagcatcatcctttagagacccccactggtacccgccaggctgtctgtatccccttcatcatggctgtgtcagagaatgccaccattaatatctgaagggactaaagaaagaaactttgctggtataagtatgattttcattttaaaaacaagcatgtggggtggtttatcaacagacagtcctgagtgtatttgtaagctgaagagacagtttcaggcaggatttccagattctatttttttatctctgaccacttctctcatttcaaatcttggagccctgaaatagtaggaatgtagtgggacacaagagagggatctggagacctggctgcagggtaggctgaaacttgaaggagcatctgagagcttcttcctaatttcacagcagaggtgcgtctgggcgttacggtccccagggcgtcaacaaccatccctatgttgtggccaccaaagccatacctccatcaggccttccttcctgcttgccaggcccataaatctccctgctcaacacaggttttctttcaacaggttcctcaaactcaacatatccaaaaggaaatgagccatcttacccatccttctctttcagccttccccaccttctaagcaaatggctctatggttaaccccacttgcaagtctagaagcctaggagtcactgttgattcttcactctccttatgttccatgtggtcttagtcatccattcctgtggtttctacaatgaaatgtctcatgaatcccttcaggttactccatctgtactgctcaggataatcgctggcattactgccatcactgtctcttatctgggtaactcctgtctggttgccaacctttccacacccccatcagtcctctataggggttacaaacatgctctgtaaaaatataattctgatcctgctactcccctgcttaactttcttcagtgacatcctatagcaccctttatctattagtagcataaccacttatcatgttaatttgtttttgtgtatttactcttttctgtttctcccgccactctaaagcatgacagtaaggtctatgtcctgtattcccagtatttagcataacatctggctcaataaatctcagttaaaagagtgatgcttgaggagatgaaaggatttaacaaatccctcttcatatctgggcatattaaagaggataaaggtgttcctgtgaggattaaacaacccaagaaggaaattagaaaaaagtactctgaggaagcagagaagaatgaaaataagtggaaacaccagtgaatgggagagggtagtgaaggggacggagaaggacttgcaacctatcttggcgttccatgagatagaaagctaagttcttctcagaatggcaggaaacagaagcagtgacagtgaacccagagcttctgaaaaagaaacagcaaggtatgagccaaggaacacttaagggtgctgatagacccttacaagtgtgaagaagtcttttgttggctccaaattagtcactgataaaggatgtggctctatgtagttaattgggaagtatgttgtcttttttttttttttttttgagacagagtctcactctgtcacccaggctggagtgcagtggcgccatctcggctcactgcaagctccgcctcccgggttcacgccattctcctgcctcagcctcccgagtagctgggactacaggtgcccgccaccatgccctgctaatttttttgtatttttagtagagatggggtttcaccgtgttagccaggatagtctcaatctcctgacctcttgatccgcctgcctcagcctcccaaagtgctgggattacaggagtgagccaccgcgcccggccaagtatgatgtctttttggaacatgtgtttaaaatagcacaaatggcatgctaagaagcttggagtaaaagatgtgcatcaccccagagtcaataatggctaaagaaatattgttgacaataggaaaggagatttcaaaaagtttatagaaaagcaaggtattatctcacggccagagaatatccagaaagcactattagttcccatgcaggcctgggcaagaaacttaaaacctgggtactcagctcctgcttttcagctctccttccagttgatgattataactttggaaaagaaattaagttatacaggaagagagcagctggtcacacaagaggtgccaaagcttgggatttgatattctagatttcaacttgtgacaccagaggtggggccttctgaaaagggacaacgtgtgccacagaaaactgagaagaaggtttcaggcaacacctgacccaaattttgaaatttgagattagggagtgacactgttcagcacaaacataaacaaaattgtgaactagatcatgcagaggatatcatatgaggcatagaaggatggatggtagtggagaaggatctccacagtgaatattctagcgtctcacgagaggctcacaggtttgttttttaattaatttttaaattttactttaagttctgggatacagaatgtacaggtttgttacataggtatacatgtgcgatggtggtttgctgtacctatcaacccatcatctaggttttaagccccgcatgcattaggtatttgtcctaatgcaggcattttttaaaggctaaattaagttaggaattgtacgtagtagatcccactctttgagaactacttattgcacattagcatagtaaaggccttgggaaaacctacaaagaaagcaatttatctacgtttaacccagagtttgccaccattgttaggccacctaagtataatacttatgtgacctccactctaccttacaacagtggaacacgaatgttccaacagattggtttaaaaaacctagatctacaccaatgcacaaagtattgacaacaaacacaaatcaaaggcaacaaaaaaacttcacaaaaccaaaacaaagtatggggaataaaacaaacaagaaacaataatggaggtaagtatcatctcacagaacagccaggactttggagtatgggatttaggattggggtataactgtgtaatggtatatttgggataaaaggaacaaattcaatgtaatgatctcaagtagcacttcctgtgaagaaggtaaacagagaagttcataaaggtgggagcagaatcacggtgagaggaacatttggtgatgatgaaaggggagggaagtggaagaggcgtcactgtggaagtgcacgacagcacatctgaaaggtgtgctaccacagtaatgagggatttgatttcctgggaaatccttttgataaaatcagaggatataaaaatcttacgccttgctttactgataattttaatctctcaataaattgaagaagcagtgaggaaagggatttagtgtcagtttaatttcaacaaatatgggaagagtggttggtcatttagaaatatcagaaactttgggagaaagccaagtactcataaaatccagcctctccataatcctgtcagaaatgttttaaagaggatttcttggaaggaaggttacactaaataatctttaagtcccttctgaaacattaaaggctgcctctaacattctgcattcacagttgaagaactccagaggtggccagcatgacacctgagcaagcagtggcatccgtggctctatggctacgtggaaaagaaacatagtgctgcacaccaggtacagtaaaaagggcatcagatatgtcatgtaaacataccatagaaccataagaactgaaacaatgtggtcttggaataaaaatagataaatcagtagtaaagaatagatatttcagaaatagacaaaaatatgcataagaatttaatttccaataaaaggcagaattaagtcactgggggcatggaaaatagggaatataacaacttccagagtgggcaaacctttctgcatttagaaatggaataaagaactcataaatgaaaaattaaatataaaaaccataaaaaagaaccaacattaagaggcaaaacatggagtagataaatatttttaggaaatatgaagtccaaggattaaaatgtttaacaaatgcccaaatataaaccaaaaaaaaaaaaaaaaaattaccaggaaccctatttgataaatggatacagtgtgagaataattatttacaaaagagaaaatgtgaatagaaaatgaaggagaataaggaaataaacaagggtagttatagaataatttaagataaaataataggatgccatttttgcatatcaaattagtaaatattaagtccatatgtatagtttgggaattaattgaccagtacttaacaagaaacttgaaaatgctcatttcttttgatgtactagttccacatgtaggagtctatccaatggaaataattctaacagctaaaaagccccatgcataaaaatgtccactgcaatgttttaaagcaaaatattatttgctttaaaaaaagcagaaaggagaaagaaagaaataagaacaaaggagtaagaagaatatttaatgtatgcttaccatatggaggttatataaattatcccatttaaatctcacagcagttccatgaagtagatatgatcaccattttatagaaaaggtaagatgtttttgcatgctcagggagactaagttctttaaagaaacttggctagtaacagtgaaaaaatggaaacagcctaaatgtaaatagtagaatggttaagtaatctagagatttgatgaattatttttaaatttttaatataaaagaatacaatggaaaaatagtttaggataagatgttaaaaatgcataatagaaaatgttatattcagtatgattgaaatacacagaaaaaagactggaataaaataaataagcactaaccaaacacaacagaacctgaccctgagattgtatcaaggaatgtagtcggctggtggccctgagaacaaagcaaagtgcagttaaattatcaggccgtgtaaatgatgaagggaagcccagaaagaccctgaaaggctcaaaaacagtttaagcaatttggctaacacaggagatagaaaaagtaatttggggcagatacggtaaatcttctataacgcgtagggctgtaattcttttcatggcaagttgctgggaaaatcataaattggtcatggttaaaacgtcagaagactcaaaattacaagaaaaaataatgaattatgaaggttttggcttactctagaagtcgtactacattttctgagagaagtaggaggtgagacgagagtaagtaacttctgctctctgaatatttcaattaggcagctggggaaatgtgggtggaaaaatagaaatctttactttcaagttattagaagaaagtatctgtctatgtaagctttagggaaaaggggcctgggataaacacatgttcaagccatagaaaatgtcatttatgtacacctacctccctagagcagactaatcttcaattgtatgaatttgatagcattttgaagaacttaataaatatcctaaatataatgttttaaaactcagcctttgtatttcctttgtctcctactttccctggtctcttatccattttcatattctttcttattatattaaaaaagaaaccatatatattatatatatgtgtatacacatatacacatacacacatgtacacacacacacacacacacacacacatattactacagttaatttggaatttttcatttatggccactattgaccaaaaagaaacacaacaaaaaacaaatgcttggtcaactcagcatgaagtgcacaggtatgtgggagtagaacttagcacattccaaatgcgattggtttctatttaatgaacaccatctaccctcacctactttgatggccaaaaagtgaatttttcttctgccactgtaacaatgactactgcataatacctggttgtcacctctccactataaattctgagagggcagaccatacttgtcttgtttactgcgggagcccctgcaccagacagcggctcaatgagtatttgttgaatgaatgaatgagtgagtgaatatacaaatcctactcatctctccagacttagctcaagccccaccttcctgataacatctttcctcaaagccccagtgaccgatctgattattatattaccagtgtgcaccactacttaacacacctgactctacacatcatttttatcattgtttttcaggtgttggtgttttgttttgtttttttcaatttagagagaaaggctcttcaaagacacttatatacatatatatttattctatttctcaaagcactttttacaggacacatgtaaaatcctcagcaaacacctgttaaattcaatggttaaatcttttagatgacttttgactttgtggtatttctaaacattttctctgctgaatgcatgcattgtattaggatttcaccacgtggtggacagaaaacagggaatttagtgtcagctgagctgagtttatagctctgccatttcaatgctggaaaagtcaccgaaactctgctcttctgtttctctatttgtaaaatggaaacattaacaagagcaataacaaaaagaaatatctacctatcataaagggaagacagtgcaatcaaatgggataatgtaggtgaatgagttttgcaaattggaaagcaaatattagccattctatttaccaattttaaaaaacgcaattgatgttgcaagactgtgtatagcaataacagttagtgtggctttttctgagaacaaggctattaggcagaagagaaaggtgatgaggaaaagaatctcaagtacaacttgccaaacatgccccagtcataaataaaagactgtgtccaacactcgcggtacagagagattaccaggcacctgtcacctacacccttcggcactgctgcaagcatctctgaaaccaggagaaagcttaccagacacgagctgctgtccaggcaaccctacgggaaccatgcccaggttattcatggctgtagcccaggctgtgggatctgtcacggacatgttgagctgggtcgtgtctatcgctatactccccaaaccatcggctgctgtggggaaaaacaaaccatgatttagagtccataggcaagggtgtttgttttaaagaaaatcacatttctagatatgtgaggcttcatttagcacattcccaaactacaaaaaaaaaataaagaactataatctgcagcaatgttttctctagacataaacacaaagtgtttccaaatactttctgggagaaaacttaatgacatgtagtttatattatacacagcatgctattaaggaggtacccctggaaaaaaatcgaagaattgtttccttctcccagtgaaacaacgttagttaagtcacaaggctgagaggcaaagcagtaatactctcttggtaaaacaagttaattggcttactgtttctaggtgtaattcttgagcaggcaggccttctatctaataagaaaatagttgtcaagcagtagaactggtcctgactgaatttattaagtgttacctcgtaatctattccttcctttacaaacttttacattattacactaagaaaatacaggtgtctacctaacgtgacttttctgaaggatttctaaataaataaatcaaatttaaaaacaggtagcacaaagcttaagaaaacacaaaacaaaacagaagaatgtgtcaaatttgacttagtgctctttcattttcactagttctacagactgatttctttatgggcccaggctcctggttcaatgcatatttttcaaggtggggcaagcttttccactaagaactcaaaaaatccttgtttgtgtcctgtgctggccactggcatttacctgcagccatcatctgaggaagctcctggggaagctgggtgatgttctcaactccacctgcatctaccattgaattatgagtgtccagaggggcaggaacactttgatggctgagtgcagggtcccctcggaggtcatcagattctgcaaaacgggacagaagtgtggtgagaaaccttaatagttaactgagataaaacgtcaaggaacaaactgttatctattcaaaatcaaaaacaaagaccgatttccagtctcaggcacagaagaaatgctgcttcccatcgctcagcggctgtcttgtggctcagttaaaaccttagagccctgtgagatgtgtgggtcaactcatcgactcaccaggagcctgggctggctgaataaacagccccatttgtgagtacctcaaaggccttgcttcctactgaagcaccttcacaaatgggggcttatcagtccctgcacagccttttccacacacactacacatcaatggagagggcagagtcagggctaaagaagatttttttaagttaaaaaattaattgatgctgttactttggaagatggtcgtctgtggaatgtattcagagagggaaaaaagttgggaggaggaaggaaaaaggaagaacccattcaccatgcagctggaaaaggagggtacctaaattacaatagtcaggaaaggcagaagagaagaatggcatgctgtccataaaggaagatctagagggtgttagggaggcaaaggaagagcatttggttttttcagctcattggaaagataatttaactggccacaactttttggtttgaattttccttagaattgcccagcttatatatatatatatttttatatatttatatatatttatatatatatatttatatatagtcttttaatgcacttatctaataaatataacaattaaacattaaagttacaaagttcttctcaatctcacactatttataaaatgctatgccttctctccacccttagaaatgcaaaaacagagctttcacatgtattttaagtgcactttcaccatttcaaaactcagatgagtggcatgacaagtttgatcttaagtagattagatataacaactaagtctaaatatttatttttattttagtataaatttagaagtttttctaaaccatgttcctgttaatgatgattttagaattagatcttatggtttgacagtgtatctaatgtgaagttcgaaccttttatggcatgtctttttgtttctttcattcttaggtataagaatcagtaattccttgagcactgcactgtcaaaaagaacttctgatcagttgagcagaagtttaattcaaatggaagctaagggttcaattctcaacaacaggtgaataatgagcaaatagtttttatggtctcaacaaatccctagccctcaactagaggggtatgtaagatagtgtggaatttttttccaattgtctgtcaggaagatgaatcatcatcatcatccaacagtgaatgattctaactttggaagcaaattgtactgagaataaatattttattccttcccactatactatccaaatgaactcagaacctgcatgtgtattgtgcatcaattatcttaggctatgggtgccatcagacaaagagattctcaccatagaaaataaattcaacagcataagaaatgcatagctaacctaaatgtctggtctattcaccaacgatctttctacgatgaaatctcaaagcacttctctctccacttccaaccatttcagagtagcaaggcagagtcaggctagaatgtgttcattcttttgttcaaatggccctgtagcagagctgtttcagatctttgcaacgtcactatttgtcttacttatctccccaaatgaagtttagtggctagcctccttctacctcagattcttcccaaatgggcattaatcacacatttttttctcgagtctgcagttctggaacactatatcagagaacatccctctactttgtaggctcatgacttgtgcctgacccaccacatttcaccttgactttttgctacactgttttagggatggctttagttttccttggctctgtaacagtctgctccaatggcagttctcactttagtggttacagtcgtataaaggggcatcaagtgtcctggagacccatcgtttctacctaatactttcatggccatcttaacagactgcaagtgtttcattgaaaacagtaagcaactgctactgttccactgaaaaaaagcattgttctgttggcaagatgtggtgtataaacctagatttatcccccaatgaaactcttgtgacattcaatgtattacatctcttcagtctcccaatccaatgtttttttttttttttttttttttttttagtatttattgatcattcttgggtgtttctcggagagggggatgtggcagggtcacaggataatagtggagagaaggtcagcagataaacacatgaacaaaggtctctggttttcctaggcagaggtccctgcggccttccgcagtgtttgtgtccctgggtacttgagattagggagtggtgatgactcttaacgaacatgctgccttcaagcatctgtttaacaaagcacatcttgcaccacccttaatccatttaaccctgagttgacacagcacatgtttcagagagcacagggttgggggtaaggttatagattaacagcatcccaaggcagaagaatttttcttagttcagaacaaaatggagcctcctatgtctaattctttctacacagacatagtaacaatctgatctctctttcttttcctcacatttcccccttttctttttgacaaaaccgccattgtcatcatggcccattctcgatggtcgctatctcttcggagctgttgggtacacctcccagatggggcggccgggcagaagcgctcctcacttcccagacggggtggccgggcagagacgctccccacttcccagacggggcggccgggcagagatgctccccacttcccagacggggcggccgggcagaggcgctcctcagttcccagatggggtggccggacagaagcgctcctcacaccccagacagggcggccaggcagaggcgctccccatctcccagacggggcagccgggcagaggcgctcctcacttcccagatgatgggtggccgggcagaggcgctccccatctcccagacggggcggatgggcagagatgctccccacttcccagacggggtggccaggcagaggcgctcctcagttcccagatggggcagccggacagaagcgctcctcacatcccagacggggcggctgggcagaggcgctcctcacttcccagatgatgggtggccgggcagaggtgctccccatctcccagacggggcggccgggcagagatgctccccacttcccagacggggcggccgggcagaggcgctcctcagttcccagatggggcggccggacagaagcgctcctcacatcccagacggggcggccggacagaagcgctcctcacatcccagacggggcggccgggcagaggcgctcctcacatcccagatggggtggccgggcagaggcgctcctcacttcccagatgatgggtggccgggcagaggcgctcctcacttcccagacagggcggccaggtagcagcgatcctcacttcccagacagggcagccgggcagaggcgctcctcacttcctagacggggtggccaggcagagacgctcctcacatcccagaccgggtggtggcggggcagaggcactcctcacttcccagatggggtggcggccaggcagaggcgctcctcacttcccagacagggcggccgggcagaggggctcctcacatcccagacaatgggcagccaggcagagacgctccccacttcctagatggggtggcggccgggcagaggctgtaatcttagcacttttggaggccaaggcaggccgctgggaggtggaggttgtagcaagccgagatcacgccactgcactccagcctgggcaacattgagcattgagtgagtgagactccgtcttcaatcccagcacctcgggaggccggggcgggcagatcactcgaggtcaagagctggagaccagcccggtcaacagggtgaaaccctgtctccaccaaaaatacaaaaaccagtcaggcgtggtggcgtgcgcctgcaatcccaggcactcggcaggccgaggcaggagaatcaggggagcccgaggcagggaggttgcagcgagctgagatcacagcagtacagtccagcctcagcaacagagggagacgggagacgggagacgggagacgggagacgggagacgggagacgggagagggagagggagagggagagggccaatctaatggttttaatgacatacaacttactgtggctaccatgtgcctgggatggtgattctaaagtaagctctgtcacatcttaggaatttccaatagtctcaaggctgccgtgacattgttcacaaaatttaagttgattcggtcactcattttggaagaaaggtaatacttttaattaattaccaactagtaatttatgaatagttgcaagaatgattttggtactttgttagcatctattgttcctattgaatacctgcctctttaaatgattcaagaccataatgcctaatttatcattcacatcaatttctctgccttagttttattatttctaaactatagaaaagattaatcttcttagcgatgtttatttacacacagagatgtggggagttaaaaattatagctaataaagcactctgaatacagtaggtgataattattactattttatttggaaatgtagtgtttccattaagataccctgggatctttgtgttctggtagataattatgtaattaattctaaaacagtgagtaacacttgatatttctaaaagtaagtgttgccctagttttctgtgccacacctcagttggagcacaatatttcattttccaccattcctttataaaattatatgaggtaggccaggtgcggtgactcacacctgtaatcccagcactttgggaggccgaggcgggtggatcatctgaggtcaggaatttgagaccagcctgaccaaaatggtgaaaccctgtctctactaaaaatacaaaaattagccagcaatggtggcgcatgcctgtagtcccagctactcaggaggctacgacaggagaattgcttgaacccgggaggcagaggttgtagagccgagatcacaccactgcactccagcctagttgccagagtgagactccatctctaaaaaagtaaatacataaaataatataatgtaatttaaggctgggcgcagtggctcaagcctgtaatcccagcactttgggaggtggaggcgggccaatcacctgaggtcaggtgttcgagactggcctggccaacgtggtgaaaccctatctctactaaaaatataaaaattagctgggtgtggtggtgcatgcttgtaatcccagctacttgggaagctgaggcaggagaatcgcttgaacccagaaggcagaggttgcagtgagctgagattgtgccactgcactccagcctgggcaacagcaagactctgtctcaaaaaaataaaaataaataaaaataaataatacgatgtaacttaaaagatgtataaatattttctctctaggttttttctgcctatgcaactacaaaaactttcaagagattcatgaccaattatgaaattggcagtttctacttacagctttaatgaagtatgagcaccacaaaacaatctgatacacaaaatgccaaggataaaagtacagctttgtttggccttaacagatatctaacttgtttcctgttaagatatattcaagtataaaatctcataccaatttcataactgttcaacaaaatatatttatgttcagtatttcattgggctagataatggggcaaatattttttgaaacttatcaagtctatgaaaatactatttggcttaaaaaatggcacaggtttgggaggctgaggtggcaggatcacaagatcaggaatttgagaccagcctggccaatatagtgaaaccccgtctctactaaaaatacaaaacttagctgggtatggtggcgggtgcctgtagtcccagctacacgggaggctgaggcaggagaatcgcttgaacaatttctataggtatcagcgatgcacacatcatgaataataaaacctacctgtaattgtccacaaaacacagattcctgttaaaggagggtagagatcagctaggtattgaaaaatccttcttattgaaaaaaagaaaaaggctgggtgtggtggctcatatctacaaccccagataggagctaatatctataatccactttgggagaccaaggtgggaggattggttgaacccaggagtttgagaccaggctgggcaacatagggcgatttcatctctacaataaccttaaacagttagtcaagcatggtagtgccctcctgtcgtcccagctgctcaggacgctggggtgggaggattgcttgagctggggagtgaggggtgcagaggttccagtgagctgagattgtgccactgcactctagcctgggcaacagattgagtccctgtcttaaaaaaagacaaaacaaaaccaaaaaaaagcatgattttgtttggtctaagtccttaggtttatacctacttcaataacaaaataattgtggtgaaagaatcagatttcttaatgtcttgtaaacagttgataccaggccaggcacggtggctcatgcctgtaatgccagcactttgggaggccgaggtgggtggatcacttgaggccaggatttgagaccaacctggccaacatggtaaaacctcatctctactgaaaatacaagaattagccgggcgtggtgacgtgcacctgtagtcccagctacctgggaggctgaggcaggagaatggcttgaacctgggaggcaaaggttgcagtgagccaagaccaagccactgcactacagcctaggcaacagagtgaaactccatctcaaaaagaaaagagctgataccaaaggaagcttatttcatatggtatcagcaaatttcttattttataagaactctccattagcattatcatggtatatatttacagtaaaaagaaagatacatttccttccaaagttcactctccttttccatcactaaggaaatacctaacttcgatcttcacatagtcagtgccatactctcgaggttatggaaatgttccacggtttaaaacaatatagataattgtgaagtaggtatgcttatgtattaactctttgattctttaagcaattatgaatagtaggggagatacttctgcttcctgtaatgataaactatgtaactgtagatcaatcttcccactgaggaacaactaaaaatcttaatatcttccatcagttttgtaaaattctcactatcatcttttcatatacaaaagcagttcaaaggacattctctgattattgtagtgggttactaatctggcttctaaggagaatgggtcctgttaactactgggtgtttcatcttattgttaagggaggtgagtggaatctgcaagtttaggggcagagtaggaattgctctgtaaagtgtggtaaaagaaaacataaaagctgaatgttctgaggggaaagaaaggagggatctttggtgcccacccatgaagaaaagatgactacagagaagatcaatgacttaagcagaatttcaggtggtttcactgggaagcatacagtgtaaatctctcctcagcccctccccagaaatgtcagctaaatctgttactccttatttcttagataggagtaagttttggggtattggggagcacttagaggagagtttcaagaaaagaatgaaaaggtagctaatgggattatataacatcctacatgataacgcatgataaagactcaaatctgttaaatatagaggatggtgattatttgttaatgatcaatgtcagctgattaatgggaaataataggattaaggttttgaggaatagatttagattaggcatatcatggggaatttctgatgagatgactgtaaagtaggagtattatatcaaataacacttaaaagctctttctcagtgatggagagaaaagccatttcttggaaacagtatgggcagaaaatggagttggacaaagatcaattcagataggggagaaccctatagcacttagtgtcaaacccatgaaatcaaaaggtcttctttagtatctaactagttattcatatacagatgctcctcaatttatgataaggttacattctgataaatccattaagttgaaaaaatagtaagatgaaaatgtatttaatgctggcaatacaacagacagtcctcaaatgacgatggtttaatttacaattttttaactttacgatggtgagaaagcactgtgcattcagtagaaaccataaccccatcacaagttgtaaggagcttcttgacttggagttacatcccaatggagttatgtcccaaaagcataagttgaaccatcctaaatcagggaccatctgtgtttataaaatcactgaactttttcctgaagtgtcacatcacactacattgcacctaaggagagatgccactcctactctttttccagttttctgttaaggcagaaagataaaggagatatatactctttctcccatgctctcatagcactctgtaccttgctctatcccagcactttcactcatattctagttagtttatctctatcatgtctctaataaactataagcttaggatgatcaaggaaactagtcatctgtgcataccctgcagctagcaagcaaagtacctgaaatgtggtaggtgttaaatatatatataatatagttataaatttataaaatatattttacgttttatataaaatataaatattttacatgtaatttcaaatgaattcatgcaaggaggaaagaagagaggaaagtaaaaaatgaagaaaaaaaaggaaaagaaggaaataataaaggaaccaagaaaaaaaaaaatctcagttccagaatttagtcccaaagcttggaagtttaaagctaaagaacacaatgagggtggagggatttttcttgtatactagaatacagatgaattcaaagtgtcaaagaatgacaattaaaaaaaaatctgtcagatctttcaagataagctttagatgcacttaacaagtcaccctctaagctttaagattccacacctccctggcaaccaatgtaggatcacaagcaggttacagtgatgttctccttttgtgagacttcttgcagctgctctttgaatgagctgaaatctataaataactgcatctccagacccattaagcagtacattagtgtaacaaaggcatatatgtacagtactaaagaagtgaaattgttggaagaaaggaaaagtttccatttggcatgcaccacagaggatgaaaagcagacccaaccatttctcaaacatgaaattccattattggtttgtgattacatcctccacttttctactttgtatagcagccaattttaaactacaaatcatcatctttccatcttagagaggacatggtttctaaatgggtaaggttttacccacagcatgtctatctttgaagaactctatattgagagaaagagacagaaagagagatgacctgaaggcccccctctaaaaacatgcaatcaaacaaaatgaccaaatttgccaaggagacaactcaactagcatgtgcaggacagcagagaagaacaattttcttttggcacaaagaaaaatatcactcggcattacaaatataagtgtagagacatgacaagtaaaattatttttctcaggaaaactttgcttttggaaaaaaatatgctttatatatctaaattgaacaaataacaaaaaaaatcttgagaccttatgtataaagtgcccctctttccattaaaaacagaaaagaaaagaaaacaggccttgatgctactatggtaatatgtagggattggtaccatcggaggtttccagaagccactggagatcttgccacatatcctctgtggggaagggaggctactgtatgcagttttaaagtctttgtataggcaggttttaaagtgtaggacctttcacatttagacttctagagattttctgaaaagggcaacattagacttgaagacagtttatgaaatacgtaatggctcaactccttcccctcattcatggatatcaatcaaccacatacacaacctgctgtcatatgttgttgttttctactttccaaaatacacagaccataaaaaaaaaagtgatcaccgctagactttgctggtgagtaaattattcaagaaagcaatattatcagtaaacataagcctggatccattaaagctagaagagtcccattttacgcaaagcttttctaagcccctgggattcagggcaaacacatacaggttcatagagtaattcatcaaggtttgaagaatcaggtaaaacctgagtttatcaattcctacttctcccagataaacatgtctccaaaatgtttctgacaggcaactatccagcctcagctagtgatgggtgtggcagctcactgtgccagatagtcctaagagttcaccgttctctctcctgagcacctatctgaagaacaggagatctaaatctaaattctgtcctcaaaccctacctctgcagtgatatgtggtcttggaaagtgactcttctatccctggaatagggatactgaggcttaactaccatcttacctagccacagataaatttatgaaagtaactaaggacatatcagataattcttgcctccccctggtcaaattttttctgtgtttgcactcttgtgttcttttcacattcacattctaaaagttctaaagagtagacaatgtaaacagaatgttgtaactaaataaaagcctcaattaaaatggcaaagctatggactcctgagacagagcaagagagacaggaaagagtcgtcttgaggaagggataaggcctctgggacaagatttcaggtggatgtcaggcttcaaagatatagccatcaaaagaggtgaattctataaaccatacacatggcaacaaatcaaagcataattttgtatgcatacacagtacagaaaggcaatgttggtcacatcccggcctcttcagctgcactgatacacagaaagcaatttctgtaaacattattgtcttcttacataaaggaaatcagacaatatataattctataatttgtgctgttttgtgctcagctttttcattatgtactcattttacaccttgacccaaccgtggaaaacatattaagctagaaagtggaacattttaattgtagtggataaataactgacccttaaatggtggcaaactggcaaattagttatctattttccaaaaagccctggttagagccctttaatttatggaaatctacctgcaataaaacccagatcagaccaagaccagcctgagccagttgctcatcctgtttaacatttctcccagtagggtgacaaataacatattagttactctttaaacaaatgtgctcttaatgatgccactgccgcatgatgaataaagcattagccctgcagtcatgatcgccctgggacagggagcgttagcagaacacacccaccttgcatggattgccctgggtgagagactttgctttatctttctctaaatgaccacccatagcccttgctcatgctctgtaaccagtgagcaagaacagtggagccttgggtcccctgtgatggtcctttttgcttctcagggcctcataaatggtatggctatatcactgggagtaacccagaaggcatgatggggtagttaggggagggctatgggggcacaggagcctgatgcaaatgactgcacagcagcacatccagttggaaagttccagttcagcagtgagcattctgaggaaatgggtcaaacctttagtgctgctggttatatccagcaagatttaaatgaaggtgctcagaagagaaaaaggcctgagtgtccaaaaggtattcaggctcctgaggctagaggcagattagggggcacagaaaggtggttccaacctccaggaacatacatgattcagaagctgaatcctggttatttcttggtaaaaggtctttatgttctagctgcttttggaggtcaggcatcatcaaaagcaggaattggctacacctggttatctcagcaggccctcataacccagaaaacctccatggaggctcccacccccatcaaaagagatgagagaataaatgctgatggaaaggctccagctctgaaggcaaagttgaagggcactacaaaacactgttgctacagacccaaggcctttaccctctgtctgtcttggtcacagatttgcattaaaatgtcctccacccctaccgtcccccattaacacattctccttttcaataggaggagatatttgcctcttaagaatgccacataaaaatccttccttacaaggagatggcatttggaggactatgttcctcaaatagtctctttttctactacagtcttacagaccaaaggacccatctgcctctgagcaactagtctatttttttaactagggctgtgttctcaactaggcactagaggcataaggtctacaataatgatgaagacctgaaaatattttgtgtcaacatgcaatgaaaagcacactatctaaaacaaatatttaactaaatgtttataaattccatattatgacaattctaattatcaaatttagtattcacatgaaagtcattatagttgaaaaccatttgtaactgggctatctcactttgcagaaattactgagtgtgcaccattatggagaaattagagctggttttaaatgaaagaaataacttgcaggcaaataatttcaaaagcaaaatgatttaaaaaatcatctccaaagttcctataaacaaacttatactaaacatcagatgtgaacacacttgttatgtttgatctgatatggagtaagtaaatctgctgctgcctagaaaggttttaaatggttgtgttctgaggcactgtctccttcctgcctactgtgtgtaagataaagctatacttcctctcaaatttgccaaactcagttcaggatcgaatgccattccgttatttattcatggattacataaataattgtggaaaagaagaaggaggcatgagcaaaaattgaccttaaagaatacagatgagagagaaaaatatctggctcatggtaccgaatgcaatttcatgttagcttagagtcatcgtatgtatttaggttttattatttataaaaaagaaatcgtgctgaatgttctttgtgggaactgcaatatattgctattgctacgatggtttactattttcacagctagatggcttaaacccaaactaaacaaatattttaaaagaattcccaccagcattattacttttttttcgtttctagtgttaatgaaaaagatcttctgcttttcaagtcctctgatatctttactcttgagcaattctcaattttatggcttatgatgagataatgtttattgaaaaataacaacttaagaaaataaccagcaactagtggtggttaagcagtgcagtgtctgaagtgagggcatttgagaactgcagtggctgtcaactccaaatattcaccaggtcttgactattacggcaattaggatgatgattttattacttgcacactgaagtagacatatttttgtgtactcatccaagatatcaacttgacagtgtctactacacacagaattttgctaataagataaaaataaggtagatgtgacagtgagacacataatcaacataaaacaaaatgcaccatcatgtccagacttctcactgtatgaccaaacccttactttaataggggtcaccaccttcattcaaatgcactccccaaactcttgctatcattcttaactactggctaattcaccatccttttctctagggataaaatttgcacagaaatgcaatgacacagttctcttcaatctgagagtaaatatcaatatacactagagaggtggggatttttttgttttaaaaatattattgctgatacatgtaatgagttcaaacaaagctaaagtctataaagtaaaaggggaatgccattccgttactccttatctgccagccaacacactccccagatggaaccgctgggaaaatagctccctatacagcagtcactgtggcaagaaactcacatcctcgatctcatgaaaaagactcacaacaacctatgagatagatgttattccaactttttacaaaagaaaataaactaaggtccagaaggctattcctttggatttttacccaaggtcagaaagccaatgaatggcagagcccaggactcaatgtaccctagcctggatgtctgttgttacagatttggggaactccaactttctcccacaaagagtcagactagaaggttcctctgggtttaactggctctaaagagagaaagaagtctagggtaaaggttagttccatccctgggggtagatttatttatgcaacatatctttataagatgttgactgtatgtagcactgtgcttgataccaagaacgtaatagtgaacaagacatagaccctgtcttcaaaaagtttgcaataatacagtcaggtaactaaacaaactaaaaagtaccagcagacatgaacttgctatagcatggcaaattagatattcttaggaacatgcctcttataagaaaacaacaactagattctggataagaccacttatttatgtattactaggctttctactaggcttggtaaaggaaaccctgctagacatctgcttctaaaaagaaagaaaacaaaaaaagttggctgaaaccagaaggatgagccaggagtagtaagttgcttggagggaaagtgccaacatcagcaatgcaccaggagatagcctgtcatggcaaggtcaagccctggtctgaggtttccatggcaatcaggacctgaagatttgttgcacctttacatggcccttaccccagtcagccttctcaaactctcgacttcagttttagaagtaggcaagtgaaagaatctgggcaaaccagcagaaatcactgctgaaagacaactcaagacccatgctttattgagaggcacatttttcttaaataagtcagaataataattgtgtacttagagaaagagagagagagaacaaacatataaagtttctacctagggttgatctgtaatccaaattgggcttaactcagtccaaatatatatattgagggcaaactgatggtttaagctgagagcttgggataaagaaggtataaacatcatcattatcaaggactgtccaggtccattctccccatgtcaacagcttctatttgcaatctctaaatcatccacaccctcaccacaactgtactgcctgatagaatgcactagtgagtgaggcggatggcaaagtagaaaggctggtcccagctttatatatagaaaggctgggaggtggagtcaggttactattactttttcttacctcatcccctttctgccagaaccttcttctgttctacttctcttacttgtaccaaatacactctctctaacacgagctatctcatcatgttggcagctagctacaaggaagaggcctggaatgcagttctcctttctacctgtcattgggaataggagctacagaaactagggttggtgaggcgggtggggggtactgtggaggtgggtaaagccacaagctggataaaccagaaaacccaacttctaactcctattccaagggatagctgacattctagaggtgctgaaagagtgaggatctatgtcagttatcatgtgggacactgaaatcaaagtccctctgcatgctgattagaatcatcacccattgtggcggctattttttcattctcagtagagacaaactgaaaccctgagaactgatctgggcaagtcgctttctctgactctcctaagaaacgtgcacagcagtttggcagcacaatttgcataccagaggagagctcctgtcacaagtaccctgtgggccagtttcctgagcttttccacttgatgctttcaagcctcatctcacgagtcattggagaggctaacgtataatgccttttggaggagctgaaaggaataaaacattactagcaaaacggtcatatattttgagagttaaaatctagatccctttagataggccctctgaaagaaatgctttcgactacgatggcagcagcaaaaactctgttaaggacagcttcatgagcacaacttcccagccactattcccacctgaaaagtacatattctggtctgcatttttttttctacaagtattttgctttgattcattgttgatacacatgacagcagaataataaactaggtagtttgagcctgtgtgtgactgggattcggcataagcatcacaattttggtttgtaaattcctttggttcagtagatcaaatggggaaagacttgtgtaatgtgaaattcaatgaccagcaatggcagggatcttttggatatgtaatctgctgttggagccatgcttggggaccaaatagatgagcaggccatgttaggaagggcagcaaggaaaagagaaaacatgaattaatattaaaaatgtgatgcaaaataaaatggaggttatagtcatatccttccaattgtattgagctgaaattgtttctggatttggaagctccttgctaagctaaattgcaaaaataagattatatgaggagaaaaggtaatttccaaaatataataaacataatacaattactgcacacttatatatgaaatccagaaaggtatatttctttcacgccatgtgatcacagttttgttacagttttatgttcttattttatgctttccactagttttcttgactttgcatattcttgatgcaaatcagtgaatgcatataaagtgtaaacaataggctctcaacatggagcctacccaaatgatttaactgtgtagcattgattatcttgtccactgtgtgagcaacgtgcacaaaatatgcattttgtatgttacggaggtcttgctgatgtggatgaagaagtgtgagaactaggatggagaagaagctaacttcaacagtctactctttagtgtcctccctttacataaaacaaaacaaacaactgatcagctactagtaatcaacaaacttaaatttgctgagaggaagtagttaaatagcaataccaagatgtagaggttagggaaggttgttttgcccctgcctattgacctacatatactgaagcaaaattggaaaactgcagcatatttggtcacaaggtctttctatttccattcataatttcttttctttattccctctttttttttgttcttcagagaacacctttcttgatatgggtgttttaaaattctgatcagaactggcagtgggaaaagagctgaggaaataacggagactcatacttatgtgacacattcacaaaccctatgaatttttaatgaaggcacaatgtccacaattagatttgaaatgaggttttctttgtaggcgctcttacagtaagtggagtgcaagcgaattttactttatattcagtaaatgataccaagtgcaaaaaacactacaatttaatagaaaataaaaacaaattgttgattgttcatagctcctttttcatctcttagatttacaaaagtgtagcagttaaaaaaattgcatttcgttttatttaaataccacatggatgccaaggcaactcaaaggtatagaaagtcattttcagtcatgacctgaagctgtccttttgcattgtgtggagaagtttttgtttgttttaaactgtaaaaatgacttctaaatgtagatctttggggagaaagatattaagcttccctatttgcaaactaagccatttcaaatgaacataaaaaaaaaatctaatagtgtagaaaataaggaaatagagtgggctgatggctacttcgtttgcattttgattttaaagcttaactcttgtcttcatagggcttaggttttcagcttcgcagaaacagacacagtttcccatccttcttaggtggtttccaaagtccttcagtttctggctcctggtcaccttggcaacatcatttcctaaagctgcttcttctcttggagctcccgcaacacagatgcttttactcttccttgagcctagcaagtgtgatcttctcttagtgactctgcacttgtggttcctccaggtaactgcgcaaccaccctgctccctcacctgggcccttctctgacgaaatgtcatccctgacctctacctaaaatagcaactgcgtcaccttctgtccttctactagccttattttctttctctctaggatttcttggcatctgaggttatattacatagttatttctttgataaattagtcatccatgagggcacacttatttttaaccttttaaaaatgtttttcttggtaaattgccatcagccaaaacagtgcctagtacttagtagacacacacccttccctcccacatacgcaaattcattgattaaatattatgagtgggtgtatatatacatacacacataaatatgtataaacacaccgtattaatcattactgtttgattttctatattcctgatgctttgacatatgggtccttgctgacattggagggatctcccctcccagggctagccaatccaagagagcaaacgcctcacctgggagcacacacgtcataggcaaaccaaccaatccagatcccagaccctcgaacacctcctttactggctctcagatgctgaaccactattcctctggcctaatcaccccggagccaagtataggccttataccccagagcttaaattattcaaactagcccatcctacgcctgtttattccaccttgccttgcctcctgttttgcagaaatcacaataaaggcgctctcacttcctctcccttctgactgaccctggcgcctccctgtgtggctcctcgttgtgtggtgtggcaagcttccttctctttggaactgtgaataacaaactatcttttctatggcagtcgtctcctgatctgttggccttaccacaccctataataataaaaactgcattttcaaatgcaaacaaataaacactcaaataaaattcactgtattttcaaggacaatgaaatatagtaatcgccagaagttatgatttttctggactcataagaaataaaatcaggcagggtacagtggctaacacctgtaatcccagcactttgggaggccgaggcaggtggatcaatttgacgccagttcgagaccagcctggccaacatggtgaaaccccatctctactaaaaatagaaaaaaaaatgaggtgggcgtggtggcgcatgtttgtaatcccagctccttgggaggctgaggcacgagaattgcttgagcctgggaggcagaggttgcagtgagctgagattgtaccactgcactccagcctgggcaacagagtgagactctgtctcaaaaaatgaataaatacataaataaaaatagaaagaaagaaaatgactttgacattttaaagatctgtgtacagtttcaactccgtctcagccctgagattcatttatgaattgcttttgtggttattattgttgctttctactttcgccctttaagtttttttgtttatttatttcttttttttaagggggattcagacactattacctcaaaggagcagcgctgccttattctttttgctagatacaaatcgttaaccctattcaccaaacagcaattaattgtcaataaaacacatccacactgtgaactctggtgtcaacgtaggcttatcaattgtaacaactctgagggggatgttgatatgggggagaccatgcatgtctgaggtctggggctatctcttagtctgtttagggttgctataacagaatacccgaggccaagtactttataaagatttagctcatggttctgcaggctgtacaaaaggcatggtgccaacatctgcttggcttctggtgaggccgtttcatgctgcatcatagcatggcagagaaaatcaagggggaagtgaacatgtgtgaagaggcaaaacctcaggggcatcctttttataataacccactctcatgagaacattcctcagtgaactaatccagtcttccttgagcgagaactcactcgctacttcaagaacaacaccaagccattcatgagggatctaatcccatgacccaaacacctcctattagacccacctcccaacactgtcacactggggatcaagtttcaacatgagtgttggtggggacaaactcaaaccatagcagatatatgggaaatttctgtaccttctgctcaaaattgctgtgaatctaatagtgctctaaaagaattgtcttaaaaaaatacatacacatatatgtttattctctttaaatataagaaaataataaatcctatccataatttcctaaattatagttagctctaaatgtaataagaacacatttctatgacgtgatgcactctgagttttttcaacacatttgttccttttttattccaaaaactatggttcatgttgttccatggccaatttgccagatgcttcaacattccctgctggaacgcacctcagacagggctaagtcagggccttccaggggcatggcaaccatgaaaactgatcctgggaaactgacctttaatatattttcatagtaagctcagaggaatgtgctgggtgattacccattacttgtacctggtaaggacacaggcctgaagctagagtctttgcacagtagagatgggccagcaagatataaagatgtccacagaagtggccaaggaaaccactagaatgcactggagggagcctcaatccagtcagttgctaacactggcagtagggccttccctgggatttgatagcctatgcagctgtcttcatgcagttcagattcatgcctcctttacttaccttacagagctcttgccaacatggtcaccctggtgacaaccatgtgctctctaacagaaatacctgaccctgctcaaggtattagaaacaataagagaataatttttaggagacttgagagaggtcttaaaactgtgctcatatgctttttttgaaaacatggttttcaaataaaagcaagggttgagacatccaaggagctagtcgctctccctctagtccttcggccttcctttctgcctggtgttgcacattgcctcccacacgccagtgctcacagctgctccactgtgggtgtggctgttccttctcttctctatgcttctctctttttaggctcatataaaggcccacctcctccaagacaccatgtaagatcaattttctacaaccacttgctcctctgaaccccagagttccccaagggtggtatgtcagaggatttaatgtgggacccaacaccattattttaatttttaatagctatatttgctttgagtcatgtgaaattgatgtttctgtggatttaaaaaatggtcaaatattggcagtttcatgtagttcaacctaatatgtgtcagggaaaaaatattaaaagaaaaccagacatcattgtttaggatgaggctaaaatgagtactttattgaactgtgtaaaaatgaataagtaaataaacgttttgatggtacagatacagcaaaaattattaagcttgtatccactactgaaccactgaccaaatgtattttgacaatcactgttctacgtgtccttttaacgtgtcttattattgtgtgtgtgtggtttttttttttttttttttttttttgtatatctatgtatttgtgttttctcttccattagtttcctggatatttgtacacaagaggcaaggagagattacaaacctcttagcataatacccggcacgcagaagacggacttgacatagggatttgtctggtcacttatgatgagatcttaccaggaaacaccatttgttttccttatggtcattctaaaactggaaactgatgggccacgcaatggagtatgccattccagccaggaaacctacaacctggagcaaatgaaaacacaggactcctatggagcactccacgctgggagctaacctcaccactgggaagcattaaggggtagtgtggcctgttggtcagaacatgaccatctggactcattctcagcagtgtgattgtacattacatcctccacttctccattccaactgacaatgccaccaatagctgagaaagtggaggccatgggaagctggtacctactaggatatcctattggctcctgtcctctctgcccagttactgaccacggcaccaagcttcagattctgtttaatactgtcctttacacaatggtgcctgggtcttttgaaatggatagggataattatgattcatatgcttcaagaaataaaccacggtactcacacaacctacatatttcatttctattttaaaaacacaaaatacttacatgctgttggtgttttgaaagcttttgccacttatgcttttttaaatataatggttcagaaacaaaattctgcctgctaatcagtctttatttccattcataaaaaattatgtctccataatacctaagaggtcaataactagatgttgaaacaaataatattaaagaaaaatatttattgtagaagtctgtggttgaggcagaagaaaggtgttattttcatctggggtatcaagaaaacaccatgaatggagaagaatatggtctgagtctcaaaggattaaaaaaaaaaaaaaaccaacctatgtgggaagagagacagagagaaagtgcgcaggcagctcaggcaggaaatggtaaactcaaatgtgtgaaatcgggagcgttggaggctgctgaaaggacatagctgcctctttactattttacatttaagtcaagttattcagattatattggtctctgtatgtatataatgacaatagtagttttattctctaaaaagttgctttgagaaaaatgtcaagggatttaaatgcatgcttccaaagtacaatgttttcctacataaagatgctggtttatcaactagaaaactaaagtgggcttctttataaaagatagactgaaaagattaggaaagtcttgacaatataaacatacatttactcaccaactcatgaaatactaaaactaggttttactgctcaaagaaagcataaaatagatcatttcagtagaaagaaaataaagcacattttttacaacatagaaagtaatctcagaattcattaaccaagagaccaaaaacaatacctaaaatattatatatgttaagggagctttaaataaagtcatggagagcagatttacaatgctttaattgaaccaggataggaatggcaggagtctgttcacaacctttcatggcagagaagagttatataacagccttgatattggccagctgcaaaaaaagtcaataacaatatgaagatgacaggacttttggaagaaagttactatacagcttggagttcataatattatgtgaggatagagaacattaattctaatcagatccacatcattatttacagaaaacttttttttttaaggttcagagaaaatacaagtgtgatataaacacacaggtatcagggctaataagtgtaagagagatttagaaaaataaaattttgattctataactggatagtcataatcctagtgaaacaaaaagagatgccactgtagaaatcactatggcttacaataatttctctgatgaattttgattctaaaatgacaagtaataaatggaaccaaggacacgagggtaaagacaaacaccagtgtgtgggaataattcctagaagaatgctgaagaggcctaaatacaggactgggatcgaacattttgaaaaaacataccaaagggatgtttatagaacatattttttaaagtcttcaaaagaagaacaaggaaaaatagcaatacttttggggaaggccattaacaataaatagcaaagatgacagaactgttcaactcccattttgtgaatccacccctgcaagcaaaataatccgcacattgggaagggtagaataaacaaaatacgcatggaatttcagcctgacgtggtgatggggggatttactcaccaacccagagctagcatcagacattcacagaacaagccagtaagacccaatcctgcaaccaacataatatgacactaggttaaatgcttccactttcctttcccgaaaatctgagcttgtggcaactttatcgggattcaatcatttgaccttgagaacttagtgcaactatggaaatgacccataatgactaccggaattccaaagagttggtgccagttttagaatgacaacttactaggtttgtgacctggggcaaaagatacaggatgagactgattttcacatattagaagtaaagcggatatagaaggtgaactagattagttaagcaatacgccaaagaatggacttagtgccaatggttagggtttatggcggaccgatttcagggtcatccattctttttcccattcattcagtgaatatttagtaacttccactgtgtgcagcaccattttaaattctaggtgaacaagaaactcactccaaagaagggagacctggaaaaataggtcagtataaagcagataaatgggtaaatgcattaaaacgcaggttaacagaaacaacacagaagaaaaaacaattaactttgaaggtaattttagattttctccaaggttaaatagaggaaaaaattggtggggagggataataaaacaccttaaaatgtgtttcaggcatgacaacactatgatcaaaaatacttctgtgtgaaaagtatgtggcatgatacagaaaatgagtatttttgtttggctgtagtttaaagggaacatggtgaaaaagtggagaacgatgctaacaatgtaggcaggggtcatgctaaggagtttaattcctacaggcaatggagaccaaatggaatattttaaatggggagtgacagggtcaaatttgtaatttagagcaataattcttagagaagtacagagtaagctctacaggaagacaagcctgaggagggtaaatctatttggaggtaattatgggagaccagacaagatgaggcagtggcagcggagatgaagagagggaacagatttaagaggtacttctggagacagaagagatagcaattggaatgtggaagtgagagggagtgagtgacatgtgtgagggcccaagaaggtaacattcaaaaatgaatcccaggtttccacctcaaaggaattgttggataaaaatagggatttccatggcacaagaacacttaaaggattagtttagttcaggaggaaaatgtaagttttccacagagcaatcaaatgcttcaatattaaacttacaaaccatacaaaaatgtatctgtcccctggatggctatttgcttccctcagtagccacaaagctatgttgtatgcctggcacacagtggctctcaacctctgatgggcattggacttgaatcaaattgcctgaggagacttttccaaatgcatatgcttggtcttcacccccaggagattctgatttagtggatctgatgtgaggtgcaggcattttttaaaacagctccaaaggagattctgatatgcatccaaatctgacagccactgtagtatacagtcgatccatagctctttgagtgattagttaaaaggaggaagggaaggagagggcttcttgaaatttttgaagaagcagctggttgactttctatgctcaacagtgtattattgtgtgagaaatttactaaatgaactttcctgtcttttaatctttttttttttttttttttgagcggagtttcatgcttattgcccaagctggagtgcagtggtgcaatctcggctcattgcaacctctgcctcccacctcccgggttcaagcaattctcctgcctcagcctcccgagtagctgggattacaggcacccgtgggtcacacctggctaatttttttgtattttttttttcacttttttttttgagacggagtctcactctgtcacccaggctggagtgcaatggtgagatcttggctcactgcaacctctgcctcccaggttcaagtgattctctgacctcagccaccacgcctggctaatttttgtatttttaatagagacagggtttcaccatgctcgtcaggctggtctcgagctcctgacctcgtgatctgcccacctcagcctcgcaaagtgctgggattacaggcgtgagccaccgtccctggccttcctatcttctaatcttaagggtccacaaatgtgatgttatagtgttcctggcttcaacttgcagacagaacactggctgagagattactggactcactcaaattcaatcttttcttatatttttttacattattgatgaacatcccttcttatagcaactcgttctttaacattttttgtgtgcttttacatatttttcatttacttttttctcaatgtctattcctcctactagactgatgttctatgaaagcaagcattctgtttcttttgttcactatcgtgtatgtaagcactgacctagcaaaacacacacgttcagtcaataaatgagcaacgagccagatttttctggtgaaacatttgaagccacaatgcattattttcaatatgcctataggtacatccatgagtgtattatagattcagaaaatggtttcagaaataatcaaaagcatacagctataggcaaaacatgtttatatatatgtatattttttacctcgaggaaacctttgactcccaaaatttttatgttatgtaagacagccccttacatcagcaaataaaattaaaaatagggaataaatatctaaaagggtgaattaggcacagaggtgtagcctgagaaatagaagctaaacctcgttcctgttccttatctattaatagatctcagaagcctgaaccttgaagtctgataaatctagagctttcctgtcatttatatctaatgatcaattctaacagttagacaaaaaaccactaaatgaatgaaaagatgaattattgagaaacttagagggtcttttagcatggcaattaaagaagtagaaacaagtggctaacttgaagagccagaaatgttaaaaatctctgtattaatagtgattactgaagtgtttttaggttccaagttaaacatttgctgacactgcttactacaatatgtaggtaactcacgacatttttaaagacattttactgccctgagattgaatgtgagtttttttaacaaaaaaattatcaaaatcagaattctactttacctaaaatttgccaagcaactactatctgctactactttcgcatgtatcatctcatgtagtttccataaaaactgtactttaccaatcagaaaactaaaaataagagcaaccttagatgaatgcctaaaactagaatgctataaaaagtgttaattataatacaaatcactgaagtatcattttatccaggtaaatttatacatatgtataaaagtgtatttttaaaaatactaaatatgaacctcaatcataagaatgatacaagaatactatgttttgattaatgataaatttggctaactggagaaaacattgtttcaactgatgttatcaaacaggttttgaaagcagtaataagacacattgacatgatatgcttgatacacttgagaaggttacaccacctctgtggtattcttgccaaaattttataacctcaatttaatcatgaaagaacatcacacaaacccaaatcaaggatattctataagataaccagtacgcttcaaaaatttcacagccatgaaagacaaaaaaagactgaagatctgtcctactgatttctgatatttctaatgtaagatcagtagtcattacatactattggttgtataaatataggcctaagaaattggaatgattccatgttgcatccagcgtattaactaagtgttatgatgcaaagttgtttgtatattagctgcaatttcccccatgacttataagaaaaaaaattccttattaactaatgactccagttaactgattgaaattacattctactaagctaaatatacatgtcatttcttacaagggctgtatgtttttataaatcagtatctcagctcgaattgttggaattatcatggttacttccattgttcagacaggaaaaaagacaggagtagtaaaacaaagggagaggggccatttgcagcaaggagaaaggaaacacgattctaaaacacattcattaacccagggctactactagatgctctaggctagaaatgaccaggctgcttctaaacagattttaatttttaattcagtagaataggtcagatacagctctcccacctggaggtcctgccctagaacctacctgcccgaaggcggcactgcgggtctgctggtaatcatcatctttgggcaaatgaaatctccagtcagctacacccgctctgtatgttgtgatcccaagaaccagtaataaaagttggacaagatctcacaatgaagtggaggttttctccttcgattttttttttttaggagcaagaaagaacacttttttttttaagccattagaaatgtttttaaaggtagaggtagaaggagggatgttggtgtttgaaataaaattctaataaataaagatcagttttactacttaattaaaattgggtagaggcatatatgtgggtccaaatttgatgctcaccatacaaatgcccagacacgagagagatctcctgggaaattaaaacgcctacacgtagggagaattgaacagaccagggccccagagcctccgcacatggagctaaaacaagcatagaggagccgagtcggactgattccccagctcttcacagcccccagattagctgggtattagtgcaggctggtctcagctgcccatgaaaatgagaacacattttaaaacctgcatttgaattttaaaggtactcaacatttctagtattgtttactgaaaaaggtcaacactcaagtgttttatttatgcacggcagaacctcagtctaaaagcactaggctttccatatggcatagcctgagaatgtgttaaatatgtagttccagagccaagaatattatttttcaacttagcgaatgcattattaaaagacctctgctgtgcccaccactgggagatagggcaagaggcagcagtgaccctgcattctgaatgcacagagacactgacagtcactcactctaaataccaatgacaatatccccaaacccacaccaccctaacccatgccttgctctgaatttgggcagtctggaaaaaatgaaaatggaaacctttaaataaaactcataaaacttcagttccaagcacaatatttttggttctttggacaataagtgtttcactgagatttatgcctagggtccttttccatatcccggctctgtgtcagcgttcacatcagccctcagttcttcttgcaaatcaagggtataatatactgattccttcaaataatatttgtgttaaaatcattaaatgcccatgcaagtaattttttattaatgggatgagaaataatacataatacataccaattttatgacagcgagaggagttattaactttagaatatctgttgtataaattaaaaatcttaagaataagtccagtgttttaaatatactatggaaaaacaaaattaatgccaggagaattttgactggaatatagaaatgcctttatcattctgggaaaaatactaccctataaaagccacatcctctgataagttcagaaattatcctttttatataaatattattcacttggaaaaatgttttctataaacagctcccttagtgcattttaacacatacttttatttacagacattagatttacacatgtttccagtataaatctttcgtatatagcaaagagaatctgtgaccaaaaattctgttcaattcggatgtggggagcaaataaatgaccaatgttcccatatacatagtaatatatggctaattttatataacatgttcacattaaaaataagaacataaaaatttttaaatcttcaggaactgtcttcaggaaatttcagaagactatgacttttaaattacgcttttacttgatccaccttccaaaagctcagaatccttatattaaaagagctggcactgacataatttgatttaatcctgtaaatatgcatggaagtcccgatgtacatcatctactatgctctgcctgcgtgatgcaaggtgaatcaggcaccatccactgtccctcttgttaaggagtccacaactgtgctggcaggacagacacgtatataactgattataatgtacttgagataactggtatatcccggtggtgggaataagaggctttggcagcacacggagtaaagagcgaggatcctggaaggcaacctgcatgtagggagagtggaagctcacccgaggaggtgacatttgagctggttgtaaaggaagaataggatcagaccaggcgaaggagaggcattccaagtgaagaaaaaacaattatccacacatgccaagtttttcagatttgacttttagaagcgttttacttcaaaaaggtttaagtgtgcaatgtctaacaagaagcaaaaattacaatctagattgtttctttatgactagcctgctcttctcccacggatcctagctgtttaggaagtacaggtagtaagaagaggatgtgaagtactttggtagccacagagaaagtgagaacgctgcagtaactgaactaaagattagaattagcactgtaggcctgtgagtggggtcgggggagctaccagtgaattgaggaaaagcaaaagtgttttaagcagactgcaatagcaccccttttcagtctgcttaaaacataagccttaaccttcttaagaaagagtctgctaaaacacagtctgccaggcctatcaactacagggtctgcgaggaatttgctctgagctgggacctgttagtcatcagcaaggagagcaaggagagcggatcattttctttcaataatttaatcacactggtgtgagtggaggtgaaggctgagctgcaggcttcatattctacttctttcacagacggcaaaggaagagtagaaaagcaaggtcccctgggtggacctggagagagaaaaaagttctgggacatcccttgtcttcagctgggttctaggaaaaggccaggggtgacaatagctcaaatgaagatggccggtaaatggctgagaagaccaagaagacagactgtgacccgtttcacagtgcctaactaaaccagaatttcaaattcttaagttagctagaaacatatttcatttattcacattttaaaaaaatcaagttaattcattcatattggcatttaaaaaacgtgtataagagaggtacaaaaactgaattgtgttcattgttcacctttctttgagttctacatacagagtcaagttgtaggagggatgtattcaggaggacaagccttggggatttcactcttttattattctctgtataaaagaagatggtttgttggatccacgtgccacccgtacctcttccctgggcatgtggccacgaggcagggggcagaagctgccctgggctagggagacctgggttctggcttccagttctgggtctgccactgacccactatgtgaactcgggctggtcacagttttctcaagtaagaatgagaagcaaggactggactggactcttttcctggctgttttctgctccagtgctttctgattctatagaacaatactatgttctagagaaatgtttccttctttctgggttttttttttttttttgatacggagtcttgctttgttgcccaggctggggcacagtggcacgatctcggctcactgcaagctccacctcctgggttcacaccattctcctgcctcagcctcccaagtagctgggactacaggcacccaccaccacgcctggctaattttttgtatttttagtagagatggggtttcaccgtgttagccaggatggtcttgatctcctgacctcgtgatctgcccgccttggcctcccaaagtgctgggattacaggtgtgagccactgcccccggcccactttctgggtcttatacatttcttttttttaaaaaagccactgcaataacaacaatgtcccatctagtgttaaaacagggaacatggtccaggactgcagaatgaggaatggcgctcaggtctttcctggcttgggggttctgaatggcgattgaagggcatggatcctgctcaggtggtttttgttggatctcaatgacccaactttttcaaagagggcattttttaaaagactgtgttttacaacttttatgtgtgatgtacaacaccagcataataggaccattaccaagggcacatggaacaatctttcctattatttttactggcagctatcaccaaaagcaaaagagcctcctgggatgcaggtcatcaggcagccccttcctgggagataagaagagattctgggtgtgacgcaagcaattcagctaagctctggctcctcactgaaatcttcacagacataaacctgggagttctgcagggtttaatcagttcagccttcccttttcattgctttctttctgaaagctcccacgaggaaaacatctccaatctgggtaatagctaaccacacactcagaactttccaggttccacagtagtctgtctcccttcttcctaaatgccaacccacaagaaaagaaatcaagggagggaacaaatgtaaatactgagacaatgcaggtatctttgaaacaaatgatcatcttccttcttgtgggtttgtcctgtgccttgttttttttttttcattaagtgccaagacaatttaatttgtaaactgccatataaaaatggcctcattttggaatctgcctcccttttggaacccaggtcagttccgtggaatatttgtggagtgactacagcatgccagacactgtcttaatgatgtctgggctgagagaacaaaatgagcctggactcagaaattctccatctcactgcctattgctcagagctttgtggcccagattaccagaattttcagtggcaaggatttcctttttttttttcttcttaaacctgagtttcttgatggttgaatacatcccagtggctccttatcttctagaatgcttaaatgcctactgggctgatggctctaactcacccgcttgttaacctgcgttgatctctcctaactggctacctctctatgccctccatggctattctgccttctgggcttaccttctagtcaaatacttggaattctcctgtttataagccccatctaacttctgcccaaccttcagccttggcttgccagtttaatctgtctctactgtgatccacatccccaaatcagcttggttctcatgtgccccaaattgtccttaactccctcatccaacaatcccatattcctattccacagtctccatgcccatcctgggggcacagtactctttgactaaagtttagaatgatagtctctggtcagtcctgtcctaccagtcaaaccctaatctcaatccaggtctggaagctgcgataatcttgagtacaatacgaactggtaatcagcaagtggggtagctcaaacagaatactggcaaatgaaatttgccttagagggccatgagaacatagtggcctctgattaataccaaagaaagaaaacatctagaatatttcttgaacacctagagtaatgcctggtacaaaataggagctcaaaaaattggcaaattatagaaagatgtcttttaaataacacattgcaaatgttgaggatatgactgtctattgtaagattcttctggataaactgtctgattcgtgtgtatatcccaagggcccagcacagtgcctgacatatagtaggcttgataaatatttgctgaactgaaatgactttgttgagaaaagtatgtcgatgtcacttggtggaggatatctacttttccagcagtgtggatgagcaggacatcttaggatgtctaaactaaaggatcagcttggttgggcccctaaatttacatgccaaggtgttcttaaggcactagagtatggaagtctatcagatggacagggaccacaataggagaggggtaggaaccctgcaagatagtctgtgccctgacttacattccctgtctactggaattctctggacctttgggttttatccagaatgcaggagatctttttgacacctttttcactcattcatatgcaaaagcagaaatctgggtctggccaagcatctctgatgcatacatgaaatgtacatgagcataaaacagccagctatagcccttctaatggagaccttcatagctgccataacagctgatggattggtgtaaggctagtagttttgaagttatattttgtatttattgttgaagctatcagaaatgtagagaacactgaggtcaatcaagagtatatgattttccaagtatattaaaatgtgtttgtgttcctttcatacaaaacataaagcatccatctttaaaatgttcacagcaatcaatgcctttaattgagcagaaaagcatatacagatatagaaatgtttagtcctagccgtggttcctgacaatcatcttcagagataaatttccacaatggatgtttcaattaagacagtaatatttattgaaaggtaaaccataaatgtatagccactggaaacattattgaacagaagtaatttatgctgcagctggtgcactgcatttttgcactgctttgattttatcagcatttgtcaattaatcaacatgaaccttgtaaaacatgttctcttattagttggaacaggcaattgcttgcaaactttgcaggagaggtcatttaataatttgctaattgtgcaaagacagatttaaaataaaaataaaaaaggttaactctcattaccattgtacctaaataggactttgtttaagcttaggcttgccaatttaaatattgtcaatggtttaatttttaaaaaaacttcaaacggcaaataaagattaagatgaagatcaacttagctctaggtttttaaaatttaagagcattttttgtttgcatctttgccatttcaaagagttactagccttgaggctatagttataagacaaattgactatattttattgggagaaaagtgaagagaaaaaagaaaaagcaaaagaaacaggaaatgcagcagcacaaagagcaatccagtagtacagttcttttttttctcccccttttttgcctcaactcattcttcattgatctagatgagatgtcacctccctacttttgactgctggttcattttcagttcagtaagtgagaaagaagctgagtcaagccctctctttgggtaattcatgcatcagcacactcgccaactctcctggcaaccaagaaagcactttaactcagagcggcatcgccaccaacaagcattctgcagccatctaaaaggacgcaactgagtttaaaacgggtaacataccttggagagcaatttctacactggggtctgcagggctgaatcgagaaatccgcaccatcttagaagtgtaagtgaaacttaaaatgaaatggcatgccttaaggcatttataagagtaagaattttgcacagagttcacagagacaatgtttgttgaatgaagatgggccttgccagatacagtctaggcaaagtgctttgctgcagagctccttttataagagtttagaggcccaagttgctctctgcctgttcaaactggcttatcaatccattccattccattctgttctcagttctaaataagtcattatttcacgcacatttccctaagcagacgcaaacactgttttccagtgtgagactcccttgggcaaattaggtttcttggaaaagggtcaaggagcgatcaaacaaaatacctcctagaaacaagtggtttcaggggacattgtgatttatgcaggctacaagtcaaattttagacactggttgggcagtaatgttgaatctgatagggctagttatggggagcaaaatcctgctacctgcagtttctttttaaggtaataataaatgggcgtatttcttatggaaacaaaactgatgatcataaaacaatcaatagaaagtttccttttctaatattttgaattaaaaggtgttaaacaaattttaatttcttaataaaattgtagtaaagtaactttcataaggcaaaagttcatatcttctattctcacagtcttacctaacaaacatgaaatacttctaaaatagatacttcttattgttttttttttgtttgtttgagtcacagggagaaaagtcccttttatgttcttttaatacttgcttttattaacctcagcttcagttagctcacttccatatatcaagattctttctacaaccgaagagacaagaggtaaatgcaaatgtgggaagggaagctgcttggtaacacactagctgctccctggcagcagttatttctatctaaagcatatataccatattaagaggccatagtgaaaaatgaaaggatggaacggcaggttttcatttgtttttaacattttagaatgctgtaaataagtttgtgtgtttcaattcaaatggttccattacctcggaggccttaatcatttgtaatagcaatttcggaagcgtccaaagcttgtgcttaaggagtattattggcattcaatatagtcatatgatattaagcagatttacaacgttctatgtggttatccctgatcatctttatttaaaagtaagttctggctgatgaggtggcttagtatcctcatggattttggcttgttagccgtcccctgccagaaaatctggctctgctggacaccctcacacctctccaaataaaccttaaatttgcaaggtgaagtggggggcagcagatggcaggaagagttcaactaagaaagaagtttacaaaggcagctttttaagaaaatgtacctggggttttggttttattcaagtacgacgaggccaacagatcaggaggtgactgtcattgagaggatagtttgtcacagttccaagaagagcaggcatgccagaccacactgggctacctggggaggcaccagggtcagtaggaggcagaggaaatacggggaaaatgtggggaagggcctttattatggtttccatggaaagaacaggcaagacagagtaagcagctttaggatagctaatttaaataatttcagcaggctctgtggtatagggacggttcctagttatgcagtacctggccctggagtgattcagggcaggtaaatagtgttctggattgcaggagcctgataaaaggaagcaggtagtggcgtggactcaggattggttggtttgaatatcaaaggcgagctcatgggcaagatgtttgctatctctaggtatcagctgacccaggaaggtttagcatcccaagtccacaaggccccaagatgtcaaagcactgtaaaatacagaaaatttttaaaaacaacaacataattaatagaagcctgtctgaaacactgctataagaaacatgaaaacagagcttctgaaacttcactgtccacagggatcacccgggtattttgttaaactgcagattttgattcattaaatcaggtaaacgttgagaccttgcatttctcataaacttcttggtgatgttgggaccacattttgagtagttagaagtaaaaatatcatgaagggtcttctctctggctcatcttcggtcaggaaaggggaaggaccttacataccgagtcttaccttggaccagacgctgcaaggcactgaatatatatacttggtcttattttgctttaagagcaaactttgctagtgggaaaattatcccaattttataggtaagggaactcaggctggttaagtaacctgctctaggtcatttagttaaaaggtagtagatataaatgtatctggcctaaaaatccatttttctcccaccacaatgtaagtacacagggcactcctctgatggaaaatgaaaagtctgttggtaaaggcttcataaaatataaagcccatgaacttcaatagtggcccatttacaacttgacttatggaaagaagagaaatcagaatggtacttattgtctcacaattagaaataaatggtgtttattaataagtgattattttatcatagccttcacaaaacactttaaatgggagtccctataaaactagtgtttttattaaaaaagatacgtacatgtacatggtaagatatatacaataaaaagttagtcttgctcctagtctcctacttctactgctcacaggtaactactgtgaagtttgtatagccttgcagtactgtttctatgcaaataataaacctttctcatataaattcattcatttggttattctaggtacttggggaaaagcagtaaataaaacagacaaaatcccttatgtaggttatattccagtatgaagatagatcacaaataaacaaataagttatagattatatcagatggggataaatgctaacagagaaaaaggggagagcagacaaaacgttttcaagtacgaattcagtggttaaggaaggcctcattggaaaggtgacagttgagtagagacctgaaggaggtaatcttattccacacttactttttcctttaacagtacgtattaaatgcttcaccacagcagggcttacagatctacctctttctttcttttttttattatactttaagttctggggtacatgtgcagaatgtgcaggtttgttacacaggtatacacgtgccacggtggtttgctgcatccatcatcccatcatctacattaggtatttctcctaatgctatccctcctcctgccccacaccccttgacgggccctggtgtgtgatattcccctccctgtgtccatgtgttctcattgttcaactcccacttatgagtaaaaacatgcagtgtttggttttctgttcttgtgttagttcactgagaatgatactttccagcttcatccatgtccctgcaaagaacatgaactcatcctttttatggctgcattgtattccatggtgtatatgtgccacattttctttatcctgtccatcattgtatctaactatttattttgagacggagtctctctctgtcacccaggatggtgtgcagtggcatgatctcagctcactgcaacctctgtctcctgggttcaagccatttttctgcctcagcctcccaagtagctgggattacaggtgcccgccaccacacctggctaatttttgtattcttagtagagattgggtttccctatgttgaccaggctggtctcaaactcctgacctcaagtgatccgcctgcctaattctcccaaagtgctgggattacaggcatgagccaccaacctggcctaccttattctttttaaagactccattgtaccccattgtttgcatgtatcataatattgctgggcttttgttattgccacaggtggatgttttagattaatcctgttatagtctgttagatgatcatttgaatggttataaaagagacttggggcttgtggtataaagcctgattaaatagaaagaaacctgaactaagcatgggaagctatgaatgcaagtccaagctgtgctatgcttgctatatcattatttgtggacttccttttttattttcctgttctggcctcatgacagggtttccattttcctggcatgtcttgggctgttcaccagccccagggtcatgtctaggtgattcttcagttggagacctaactgacatccttcccacagcaacatcagtgccaggctacctgtaaccctgcagagtcaaattaaaacttacaagctttccacattccccacgaaggaagtactagcaaacttttagggagcagtacctctgggctctgtgcacactctccgtgcttaggaggaaagcacatgagcttccttaaaacaaaaacaaaaacaaaaagccatacattctagtgatgtttatttttgcagatagagatgtttagcactgggtcatgacagagtggatttcacctttaatggaagattaatttgcccatttgattaatatctgcggcaatccctggaatatgccagcactctgcctggcactataggaggaacaaataccagtgtaatatggttcctgtcctctggtgttaaaggcaatacagcaggaatgaaaagaaaggggagaacactattatccggggtccctcaaagatccctcagagagctttttgagctaatatgtaaacaggtagggaagtgttcaagggatggaggtgctgcaaggggaccttggtaagggataagtgtatgtgagtgtgtgtgttaggaatatgtgtgaatggaaggtgaacaataattgcactacaagcaaaggaacagataaaggaaaatataggtgttgtacaggaaacatgaagtagctctgtttagtttaaagaaagaatgtggggagtaggtgtagatgatgggaaatgttggttagagtaagactggcagagggtcctgagttctactttgctattagacatgagatagataaatgagttttgaaagattaaaaaatcaccatcagcttcttcctctcttgtttttgctttatttggggtgtgggagcattgtccatgttggttttataatttctacttcttattccagtaatttttaaaaatcagcttagtatttattaaagtaatatatgcctatagtttaaaaaggtgaatagtattataaggcctataattaaaaagagtactcccttcccccactttgcctaccactcctccttcctgcttctcaggggaaactattttttttttttgcttttattatgaaagatgtttattttccagagtgtgtaacctcatatataggtaagacttttgctgcaatcaattgttcttggtttggttaatctatagtcttgtccagcgcaggaaaactagcactgtccagcaactgtaaccagggagattgaatttcaccatgggagaggaaaccacttttaactatgctatttacatccctatacttaagtactgtgtatatactgatatttattaacttattcttagagattatctgccttactactatgcaaaataaggaaaatttagcactctgatactatcacacgctcccaagttttctttcctgatctttccagtgggttaaatggcaacttggggttaaattgatattccagtttaccttactatgaccatgtaatattgtttactaccaagacaagtagtaaaagagtatgcgttcgatgttgttcaacatcttatttttcctggtgttgtcttttattttgctcacctcttttgtgtatctatcattaaccattcatgaactacccaaaagaactatagaacttatattgaaaccatttttttttttttttttacacaattagcccactggttagtctactggatctctttttccctggaggagcctcccgtccagcccctctggtctaggggttttccaggccagctgcccacctgttgtcctggggcttctttttaacaccattttgtgaaatccctatgcctctttcctgtgttggagcccccatttcctggatcccatgatttcctctttgttggtttacatcctcatttttgtagagcacattctctagtagcttcctgagaaaaggtacatgggaggtgaatttgttgagacctcatgtgtctgaaaatgtcttaattctactctcatactgagttaaacttgtaattgaattttaagtaaaatgtaattttccctcataatgtttaggctgtacttcattgtcttctagcttccagtattgcagtctcaggccactactattccttttaccaggtatgatcttttacatgtgacctgtgttactcctctggaaggttttggaatcttctttttaatcctggtattctgaagtcttagagtaaagaaccctaatgagctaatgagaatcttttcttacccatcattttgggcactttatggtctctgaaaatctggaaaatagcattgttccattttgacaattcttcttctattattctttagtacttgtctctgaatcatttttttcttgttttctccttctggcatgcttatggtaaaatatggaacctcatggattaatccactatatttctcacctccacctcaccccacgtccgtctgatatggttggctgtgttcccatccaaaactcatcttaaattgtagctcccataattcccattgttgtgggagggacccagtgggagacacttgaatcatggggggtggtttcctccatactgttctcatgggaatggataagtctcatgagatctgacggttttataaggggaaaccccgtttgcttgcttctcattctgtctttgcctgccaccctgtaagatgtgactttgttctttccttgccttctgccatgattgtgaggtctccccagccatgtgaaactgtgagtccattaaacttctttttttaagtaaattactcaatcttgggtgtgtctttatcagcagtgtgaaaacgtttggactatctactttctagaaagtttgacttctatacctctgaatcattttatattcttctataagtttaatttccaatacctccttcttattttctaattgttcctgttctatagaatgctttttattttatagatataacagtatctctcatctttctgaagttactataggtttttaaaggctttcatttgcttcctgaaatatctatatcttctctgagctcctttagcccctttctctgttttgatctctatattttattctatattttatgtcagtggatatcctcaaatatctgatggcccttcattactcatttatatttaagaaatatatatgtttatttcatatatatacattatatatgaaacaaacgattcatttatatttaaaaacagtgggtctagtttccaagggaaaccctgagtgtagacagggtgtgctttttccttgactggcatccctccgaggtaacagagtggggaatctaaccatttcaacagggactctgccaatcagtcattttttggactgagtttctgcagataagaatctccaaacccctgcctaaggagccagtccctagctgtaggttccctgggagctatgtcagggaatagtccaggagggtttcacctgttctctctgtggagtttcatcctctctcctgggcccaatccctgagtctagagtatctctgattcaatgtagcctaagactatccctgatacctcacatagggttggggaattggtagagtcagtgtgagctagggagggcagggcctaactactccatatactctgttggtctgaagctcctggcaatcaattctcctttttccagtctcatgactcctaagcctccacagcatcccgtgcatgaatctgaaggctttgctcagtgcacctcagctattcctcctccatcactctgctgtcttccacaaattgcctgatatctcacattcagtagcctctcctctgttctctcatttgctttgtgtccctgctttgtggtttttaaaattctttactaatttcagtgagatttattttttgttctttactaattttaatgagatttattttttattctttactaattttagtgagatttctggaacaggaagatatgaaagcatgtgttcaatctaataaaaccagaagtttctagtgttatacattttactttgtagttatatgtacttatgtattttgttttggtctagtttgtttgtccagagaactttatgagttacttggacaaactagtaaccacctcacaactactgttaaggagggtattgacaaaatcattttacttctttgttattttttagggattatcaggcaaggtcaagttgactttccataaatgttatctttatccagataacagcattttgttatcttggctccagaagtttggacaaataatcaatttgaggtagacgcatatcaatttatcaataagaaggaaggaagactataaggaggagggaagaaagaaagcagaaagggagggagggggaaggagaaaaaggaaacagacataaaagattttaaaacagaacagcaggaagactggcccaactaaataactatactaagaaaagctatgtatgttcactaaataagaagataaatttcggaaaatcatctggctttaagataattccaaacaatgatcactgacttggaaggcagttaagcaatttatgtcactgaatgttaatggtcaaactacgttttatcagtcaacaaaatgtacccaaaatgcatatgaaaagcagtatagcctgcaacagaacctatcacataatgatttttcacaattacatgtccagaccaacttctaactatatactgactcttaccactctgaaatatatctattttttggctcaagaatatatgtgtatatgtatgtaccaaggtatatatgtgtgtattcctcccctcatctcccaaagaaatttatgttagcttgcaggtaatccttttacttgaatatatgtttattttcctgcttatatttcttataaatttgtctagctcaaattatgtagtcctctatcctctgtcatactcaattatggaccaataacttttttaaaaaagttaactatgttgtcaacaacatcacttccaatgtagccatcatcatatctttgagcttaacaaaaagcttgactttacagtcagattgaccttattttaaatcccctgtcttccatttactaaataaactccccgataggaaaatggacatattctctattttgcaggattttatgagaattaaatcatacaatgcatataaagcacctggcatactgtaggtacccaattaaaaaaagctattcaagtcagaatatgagatgatattgaaaccttaagctgtctaaaagtacatcttttccaactgactaatttttcatttccattttttaggcatcgcatcactggtaagctggtcacctggaagcaacgcatcagttagccactgaaaaggggtgtgcagagctcttacagaaaattgagaaaatcattatattgatatattgattatattaagaaaatcattatattgctatctacttttatataagtaggggaaagggaggactggacaaaaacaataaaggaaaatatttggcccagcatcagtttcttgacccctttagaattctatttaactacaaaattaggaggttatatgaagtccctccaagtgttcaggacaaagagttctgtggttagatgattttgaaacacacctcgatcgtctcacacctccccctccccattcttgaagctttgaaacacatatgagtttattcaaggtatctgtcccattttgttttaccttccgttatacaaacttacttgactacagactctcccccttttttcttttctttcaggtaatatttattgacatactttggaaaagactggatgagttgctctgcgacttcccactctaacatatgtttctctgagtttctacaacttcagctaaatgttttaaggaagaaaagaacaacagaatatgtgctaattttgattgattgatgctccctcctatagcagcatacaaattttagagtgggagaaaaatctattacgatttcaatgaaatgagctattttatcttgtccctatgtggtaccatcaacattttagacagatgaacaccaaaccattgactgaattgctgcatagtggatttgccttgattataaagacagttgaatgaccagggtacctctggcaattttggcaatcaataagtaacatgaatcaactatgtagtggtcagactggctacccagtgctcaatcaaaacagaaaataacagagataagttaatccttaggttgcaggactataccatgataccagcataaaactcaaatggacattcatgatgaaaaaatgttaatgctatcattatacaataaactgctaaaagtatttttattagtaaaatactttcatttttctatcaatctaacaacacttatttttatctgaaaggagggtactatgctaaacgtcactgggactaaaaggatgtagagtaggaaaagggccaaagatcctaccagaaaatgatctaggagccatatgttagttctgtcagtaattttctatgtagctgtcaataatcctttgttttctctttgtaaaaataactatcctctgctgggtgcggtggctcccacctgtaatcccagcactttgggaggctgagacgggtggatcacgaggtcaggagtctgaggccagcctgaccaacatcgtgaaaccccatctctactaacactacaaaaaaattagctgggtgtggtggcacgcgcctgtagtcccagctactcaggatgctgaggcaggagaattgcttgaatctgggaggcagaggttgcagtgagccgagattgcaccatcgcactccagcctgggtgacaaagcgagactctgtctcaaaaaacaaacaacgacaacaacaacaaaaaaccaaaaccaaaaaataacaacaagaaaaaactatcctcaaggggcttattgtttagttaattatatttacaagtttgggatttttgctccatgccttcttttgttacaaaattatccttaatttacctacataacagagacaaaagtgagtgaatattttgatgttctttaattaattacatgccataatacccctccttcatcttaactgcagaaattctgtgagaacctattgcaatgttttccctttttctcttgatatgtctctttcccctcaaggctgctaaggttttaaagtgttctgtttctatttttttcattaaaaattctatcagaaaccccacttcctctcaagaggaaatttatccaaaaccacctctgtggtatccaagtcataagtgtgttggtagtaggatggccaactgtcctggtttgcccagtaataaggagtttcctactatgtggaactttctgtgttaaaaagtgggatagctgccgggctcagtggctcacgcctgtaatcctagcactttgggaggctgagggatcacgaggtcaggagatcgacaccatcccggctaacacggtaaaaccctgtctctactaaaaatacaaaaaattagctgggcatggtggcgggcacctgtagttccagctactcgggaggctgaggcaggagaatggcgtgaacccgggaagcggagcttgcagtgggcagagatcgcaccactgcactccagcccgggcgacagagcgagactccatctcaaaaaaaaaaaaaaaaaaaaaaaaaaaaaaaaaaaaatagggatagctctctacaaaccaagggagtaggtcgccttgggtgttagcttgagagaaggattggatatggcacggaaacctgcaccagagagctgcaattttgatcctattagaaacactcttctttcactgctaagcagctatgtacaacaatcaaacaccagatggatatatgaatttaatgacctttaagtttcctttacactggtggttctcaattctggtttcttactaaaatcatctggttagctttttaaaaagtgctccctgatttaactgatttgaaggtgagtctttgccatgggcatacatgtttgaagttccccagccaattctcatgtaagtcagagttaagaaacactactttatacacattctgagattcaaactataggcctagcaagagctgtttaaagcaaggagaaatctactttgtgatctctgacttgttaattattacatgcaagtttctacttcaactttaaaacaaatgagaacctgcaaactgactttatgtattcatctacattcatttattcacctagggttcatgatctataagcatctcccttgtcatgtttgtattctgaacatcaatcaccaccatctattgatatatatatttttttcttacaagaaactgtattaggcaccgtggggtataatgatttaaattgcaaggtctctgtcctcacggactctataagtagaatatatgaaaggtgactacatgatcaaggcaaatgaccccaccgccaaccaaggaggacgtggtcatggcctgggatggttaggaaatcttcatagagcaggtatgatttttaaggggctttgaggactgggtggaattttaattagagagccataaataaaaactacaaaaagggagaaaagcagtttgagaatgagtagggaggaatcagtttaccaaagttaagtatgtatacaaataatacagttcaccttttgagccatgcaaactgtatctaaggaggcacagaaccttgtatgagaccaactgctgagcaaggaaatgtaattagcgcaatcacttttttggtgctaattacttaagacattgaaaaagaggattagactgaccaatgaaacaattggttctggataaacatacaaagcttggtctgtaatgtggagaacaagccactgaatagcaatagccaagccccttccctctggtgctgggcccactcaagagacctgatcacacagacagtgaggcaggtgctgcatagatcactgcaagaaccccgagggacccactctatctgatccagtgagatgatttagggttgaagaaataaatttagaacacaagtcatgtaaaaagtacatgttactttatatgtgatgttatgtgattatcagtcattgattttcaattacttttataatgcaagagcttttcttctggatttcagaatttaagaatttctgcgccatttgtctttgcctacgaaaatagttaattctcatatttattccaatagctggtcttcatgtaagatattaactaaatgcccattaatagtctgggtatgcaactcaggaagtcagttggcaaaattaacatttagaagtaggcaccactggttatttcacacattattaacttatattacaattcaaataagcttacagctggcaaaaaaatctcttctgtaaagcgatctcaaacataataggcttaatcagagataaattaaattaggcagccatgcatactacagcatattaattctgagtagttattactacattttctgttatcactggtgtgaacaacattatgtgcaaacaaattcttcgagagggtagcaaataaagtttatgtttgggatgccatgtgcctagcattttcccatgttttcttaaaatgttaaataatcttttctgctaataatggcactaggttaagtccccataaacgagtcaacctcactcccaggaaattaaacaaatgaacatcagacgaaactgctaagtgtggtttggatttttccaaagggaacttctcaactttctctggcaattaaaaaaaaatttgttaatgagtcatagctagagcaaaattgtccaaaatgtaaggtagtgcatagtcgttacgttaaaaatcggtgcctctcattctctgttttggatgaactatgttgccttagaatactcaaagaagaaaattattcaggtagaatgctattttctaaataagatcctgccattatctctctctttctttaaacggtagtaatctaagccagcaaactagcactcagatcccacacgctagcaaatgatgcttttgtgaaagaaaatgaaaagatgcatctaacctttatacacacacacactcatgttgccttttttgatgcacttttgtcagattatctgattctttgttaatgaaccaggccctttaatttctgtatccaggagtaattcaagttactaggcatgacagccactaccgcccccaagtctgagaaacatgtttcacattctttgcgctttgcacatttaaaactcaatgtaaggtgacaagaacattaagctgcccagtgagtaaaatgtgaaactaatcactatctgttctacagatagtgggtacaataattggcaaattaaagtgcctgggaagagctgggccacctgcatcaaaaagcatcaccttggaatggctaatgaagataaatgtatgcagctagctttactgacaactacttcaaacaccagcagactgaaaaagcaacactacagtacttatttcatttactgtaaagtacgcaccatgtgaaatttttgttatttaaaggaaaaaatacccaacccctctcaatatgttgtacacatgccggctgaatcgaggctagtacttactcctaaaaagccaatgcttttcttttaaactggcaaactgggatcaatttgcttattaaaacgttgaatttgtattttcatgacaactagattcaaataaattagaagactacaaaaaagaaaataatccaatttcaataaaattgctactcttattcatccattcatttatttgacagttattgaatacctactatgtgcaggtactgtgcttgacatttggcagagagagacgaatgacatctccttaaggaggttgtggactatttgcaggcaagaggcatgcttacaggcacacacacaggcaactagaaccatgtgctattgtagaaacatttcagaaaggtgtccctttcccttagagtctttcaagagaaggctcactcttaagctgaattctaagatgatttctgaagagtttttgagggtgagtaagcttgagaatggtcttccaagctgaaaaaagtagcatgttcaaaatcaacaagaaggtcaggatctgcttgaggaaaaaaagtgccttcaaaatatatgaaggaaataaatacagaaataaatataggaggcaagaggtcaacagatgatgaagatgaaagctagacaagggtaagaatatgaagggccccagaagatatgttgaggagcttgcatttagttctgcagggcagtacttttcagaatatgtgacagagaaccctggggacctggggaaggagggaggcagcctggaagggagtgaggagtgagaagaggctgagcagtcaggactcaggccctgtacctctactcataccacaagagctttgccaatatctgtttcaccttttgggccttcttattattagtgtttttgacaattttttatactggaataatcttaaatttgcagaaaaaattgcaaagataatagaaagagttcctacatactcctcccccactttcccccactgttaacatctcacattaccatggcctggtacgtttgtgacaactaagaagccaacattggtgcatcactactaactcaactccagacttcatttggattttaccagtctttctattaatgtcctttctctgttccaggatccagtccagtctaggatatcacattgcattgtgtcatcatgtctcttcagtcttttttggtctgtgacagtttctcagttttttcttgcttcccatgacattgacggtcttgatgtgtattagccaagtatttttaaagcatgccctcacttttggctgattagggttattgggaagaatatcaccgaggtaaggtaaacttctcatcacatcacatcagggggcaggcaaatgacatcagcctgatttatcatggtgatgttaaccttgatcacctggttaagataatgtttaccaggctttttcactgtgaagttactatttcccctctttggaagccagtcataaatccagcccacatttaagggggagggtaagcttcactatctgaaggtggatatatctacctgtactatttggaattcttttagaagaaagactctatttatttatttgttcgattgtttatttatattaggatgaactcagacatttattttatactttcggttataatcaaataccatgttatttattttgtggctcaaattgttccagctttggtctctgggagctctattaaattggttcctgtatgcctttcacatgcctacatctttttgttttttgagcacttatttttttagggcataccatgtgctccaagatcttgtatttttactgtcccagccacaaactcagtcatttctctgaggatccctagttcctattattggaggataatatttagaaaccacggtctgggcactgcatgtgcttgatgctactgaggtatcactgctcccaggccccctcagcagaaagagccaagaagtataaatacatattcaaacccagttatatgcacatgtctataattgtttctgtgtctgtccgtatgcatatttatcaaattaaatagtagttaagctaacatgaagttagctgatatgtccaactctaatccagcattacagggtttgttgcagccccctctcctagcttatggaaattgtcctgacaatgagaaacctggcttgcaccacctaccatccattcatttatttgttcagcctcagtatttgggtcttcttttgaagagatttctgttactttaaaataataatatataaaagggctttatttttattcattaccatcactccaattgctctgttttcatcaaatcatttcatgtttctcctaggcacccaggaagactataattctcatgatcccttgtatttaggtccagttccagttaaaggaatgtgggtagaagtgatactgaccacttgtagccctaggctctataatctgttgtgggattctctacatatattgtctatttttttgataccaggtataagacacagtggaaaattccaataataaaagagaaaaactatatgacgattcaatggaaacagaaaaaaatcttgaaaaaagtaaaaatccactaaggatttaaaaacaaacactcatcaattagaaatgaaagagaacttccctaatacaataaaatgcatctctgaaaattctacagtgaaaattatacttgattgttaatataataaaaaattcctcataaaatcaggatcaagacaaagatgtccactctcaccacttgtactcagcatttactcctcaaatgggaagtctgagtcattataataaagaaaaagaacaactacaaaaaatagaaaggaacaaaactttctgaatggtatattttgtataaaaaatcccattaaacctaccaaacaactatcagaactagtaagtagatttacaaaaattatagagtacaactttatttttttattggagatataatttatataatgtatagttcactcttttaaggtgtacagttcaatgctttctagtacattcacaaagttgtgtgaccattcttcttatctaattccggaaactttcatcacacaaaatgaagtcttgtacccattaacagtcactccccattccccccagcccagtcccttataaccactactcaactttctgtccctgtgaagttgcccattctggacttttcatataaatggaatcagacaatatgtagtctgtgtgtctggcttaatgtgctcaaggtttatccattttgtagcatgtaaatgtattccattctgattttaggttgaataatattctgctgcatgcgtatatcacattttgttcatccattcatcagctgatggctatttgggttgtctattattttggttattaggaataaaattgctatgaacactcacatacaatttttgtgtgaatgtatgttttcagttctcttaggtctatacctaggagcgagataactctatgattaactttttaagaaaatgtcaaggtgttttatcaaagtggttacagcactttacaatcccatcaaaatgcatgaaggctccaaatttaccacatctctgtcaacactgttattgtctgtcaattttagacaattactacattactatatactatattactatatttactgtctaaaaatgatagactatagtaattcgacagacagttaaaatagtaacccaagtgggtatgaagtggtaccacgttgtggttttgatttacatgtcttaagggctaataatgttgggcatttcttcatgtgcttattggccatttatagtatcttctttggacaaatgttattttaaaattttaaaattttaaattttaaaatttctttatatatctggtatactctttatcaaatataaaatttgcaaatattttcttccatctttgagttctcttttcactttcttgctagtgtcctttgaagcacaaaagtttaaaattttgataaagtctgatttatctatatttttcttttgctgtacatgcttttggtgtttcactcaagaaactattgcctaatccaaggtcataaagatttatacctatgtttccttataagaatttcatagttttagcttttacatttaaatcttggatcatttttaatttttgtatatggtgtgacacaagcatccaaattcataattttgtattattaatacatgtggaaatccagttgtcccagaaccatttgttgaaaagactattctttcttccattgaattgctctggaacccttttgaaaatcaactggccacagatataaggtttattcatggattctctattccattccatttatctatctgtctatccttctgccagtaccaaagactcttgattactctagctttgtaataagttttgaaattgggagctgtgagtcctctaacattgttctttttcaagattgttttggctattttgggtctttatatttccatatgaagttcaggatcataaattcctttttttttctttttttgagacagagtttcactctgtcgccagctggagtgcagtggtgtgatctcggctcactgcaacctccgcctcctgggttcaagcaattctcctgcctcagtctcctaaatagctgggactacaggcgcatgccaccacacccagctaattttttatatttttagtagagatggggtttcaccatgctggccagcatggtctcgacctcttgacctcgtgatctgcccgcctcggcctcccaaagtgctgggattacaggtgtgggtcaccatggctgccctataaatttcttttaaaaagccagtcaaagcaggcgcagtggctcacatctgtaatcctagctcttagggaggcagaatcaggaggatagcttgagcccaggagttcaagatctgcctgggcaatatagtgagaccccattctccacaaaaaagaaaaaaaaaaaaaaacaaagccagataagattttcatagggatggcactgaatctgtagatatatttggggagtactgacattttgctaacttaagctttctatgattatggtgtgtttcaccattatttaggtcatgattaatctctttcaatgatgctttgcagttttcagcgtgcatgtcttacactgcttttgttaagtttattcctaagcattttttattgatgctattatgaataaaattgttttcttaatttcattttaaattgctccttgctagtgtatacaaatataactggtctttgtatattgattttatacgttgcaacctcacagaactcatttattagctcatagtcaatagtacattattgactagaagtgggtagagtagaaatgtttgtcttgttcctaatcttaggtggaaaactttcagtctttcactaataactgtaatgttagttgtgggttttccatagatgttctttagctggttaaaaagtttccttatattcctagtttgttgagcatatttatcatgaaacggattttgtcaaatattatttctaagtttactaagatgattgtatgtttttcttttattctattaatatggagtttataccgattaattttcaaatgtttaagtaaccttttattagtgggataaattatatttggttctggtgtatagtcttttttatatgttgctgtatacaatttgctagtatcttgctgagaatttttctacctgtattaataaagaatagtggtctacagtttcctttcctcttatgtatttgtcaggttttgctatcagggtaatattacaattgtagtttcatctattaacaggaaactttgaaaaataaaaattttaaattctatctgaaatatttaaaaataaaattctgagtaataaatataatagtaggtatttaagatgtttatataaaatattactgagaggttttaaagaagatctatataaatgcagagatagtgtatgttcatatattggaaggcttgatattggtgagaagtcaattcttcccaaactgatccctagaataaatatattcccaatcataatcccatttggctaatttcttagaaaccaggaacataattctaagataaatctaaaattttacaggaactaggatatacaaaccaattttgtaaaaaacaaaaaaagaacaaagatggaaggcttataccatctgacttgaagacttactataaagctacagaaatcagtgtagtctggtacactgatatataaagagctacaaaaccaatggaacagagcagagagctcagaaatagatgcatatttatgtggtcatttgatctttaagaataacattaagaaattccagtgggggaaaggaacgtcttcaagtagtgctggaagaattaaatatccatacagaaaataaaaaactctacactgacctcacacaacaaataaaaattaatttaatatggataataaatctaaacataaaaagctacaactgtactataaagttttcaaactatatgtgtgtgtgtatatatatatgtgtatatatatatgtgtgtgtatgtgtgtgtgtgtatatatatacatatatatatacatatatatacacatatatatacatatatatatacacatatatatacatatatatacacatatatatatgtatatatatacgtatatatatatgtatatatatacgtatatatatacatatatatacgtatatatatgtgtatatatatatatatataacagagataaccttgttttagacaggatacagaaaataattaaccatgaaagaaaaagaaagccctgataaattagacctcaaaatttaaacttctgctcatcaaaagacatcactaagagaataaattagcaaggctcagattggaaggaaatacttgcaaaatatacctaataaaatacttgtttatatatttacatacatatatatttttatatatggctcatacatataaagaacttctatacttcaataagaaaaacacaaataatccaatttaaaaatgggaaaataactgcaatgaacactttacagagaaaattatataaatgaccggtgagcatatgaaaatgatttcgacatattagtcatcaaggaaaaggcatattagattactattaaacatcaccacaaacccaccaaaatggctaaacctaaaaagtcagactgcaccaaatatgggtgaggatgtagaacactaaaactctcacattttgttggtgggaatataaacaattactttggaaaagatctggcaatttcttcaaaaattaagagtacacctatctatgaccagaatcctacttttagatgttgacctactataaatgaagacctatgccctcaaaaacatctgcacaagaatgtttatagaagctcattcatactagtcgaaatgtggaagaatggataaacaaattggtaaaatggaatacaactcagcaatagagaactaccaatgaactcaagaacagactgatctcaaaaacattatgctatatgaaaggagcctgacacgaaagagtatatagagtatggttccatttatataaagccctgaaagaagtgatttactcttggtggggtagggatactgggaggggcctgcaggaactttctggggtaatatagattcgggtgcaacaggcagatacatttgtcagaactcacggaaattcactcataaaagttgtgtgtcttatcatatgtaaattttacctcaaaagaaaaaacaaagaatcgtaaaatttaaattctggtaataatgcacacgttcaagtatttaggaggatatgtactaatgtctataacttgctttgaaatgtgtccaagccagaagtggtggctcacacctgtaatcccagcgctttgggaggtcaaggtgggaggatcacagggtcaggagatcgagaccattctggctaacatggtgaaagcccatctctattaaaaatacaaaaaattagcctggcgtggtggcaggcgcctgtagtcccagctactcaggaagctgaggcaggagaatggtgtaagcccaggaggcggaggttgcagtgagcagagattgtgccactgtgctccagcctgggtgacagagcgagactccgtctcaaaaaaaaaaaaaaaaaaaagaaagaaagaaatgtgtccaaaaataagattcatgaatgatgaatggacagagggatagaatgatgcacagtggtgggtatatgagtatttactgtaaacttctttaaactatttggaatagttaaacatttgaatataaaatgtttaaataaaaaaattctttaaaactaagactttcacaaaaaaaaagaaaagaaaaattaaaagaaaaaaagagaaagcaatcccagctttgtaagttactagccatgcttcataaatagtctaagcataatttcctcatttataaaatataaaaaataatatctactatacaggactgttaaaggactatacttgccaatatatgtaaaaaacagttcctggtataaataagcactgaataaatgttttagctactatttttagtaagcatagaacgtctgtagccataaacccacaaaaataaaacttcctgagaaagaagacaatgtttgcacactttgttaaaacaattgttatgtttgttgcatagaaaaaaatcagattcaccgtgatttttttctacatgtgaataccatttattaggctccctaagtgaatgagctagtagaaaggaaatattatatttaaaaaaccccataaggcatatttttagaaacggtatttccttgactttcattccaggaaaattctaacacacggcacggtgcatgtggagcccagaaaagaaagcctgccagatgccacagcaataaatagagtagggccttggagacgaagcataaaaggaaaatgtggagcatcatatctgcagcacccttctccatctggtatttagcccactgaggttatgggatttttggaaattcacctttgtaggctacctttaattatttttcttgtttatttgtccagtaaacatttaaattgtagcctaatatgagccaagttctatgaaggtcttccaggacctttggaaaatgaagctgggtacggaaatttcaggaaaaaaatgttctaagtacagagtaatgaaaggttaatactatttacgtcttgccatctctttttacaatattaatttcacaaatacaattttagcatttccaaccaataaattaagcaacagcatattttctcaaatggcaggaattctcagacaggaataaaagggagtagaatttcttaagtgggttatgtctcactttgctaagaagggcagaaatgaaaataggttttcataaattatattttctatgggtcttgtattatcatttttataaacagatattttccaagcaagtggaatttcttcacatcgtctctcaatttagtaatctttctgatgagcaaactgagctgtagaatgttgaacattgtttcatcctactatgactgtcatcctttggcttgttgaatatatattcttgtgataattctaagaaactatgactaatggatttttatccagaattttaaaacaacaaaaagttattttaaattaaatgaaaaatacattctattcccttaacttttcttttttggggggattacacattctctgctaaaatttaggatggaatttctaacagtgatggcattgttcggtaactaacagtcttttgtgtgtgtgaaaaattctaaatgagtggaaatgatctcagaaattttatcttgaaaatgtttgcctatagtatttattcaagtgttgtccacattttaggaaagaacttcaaaaatgtccttttcataaaaatatgcagttctcttgtgtctatttaaaagggaagtccctctcctaactccagcatacgcactcatctctgggctatcaatagaagctaaagaaaaaattaaagaaacactggctgcatgccaaattttgggttaatagggaagagaaagctggttggcaatctcccttcctagtccttatcttttcctccccttatctctcctgtgctaggggtgctgggatgtctgtactctgtaacctctttctctgaatggagacagaagcaggaagtcaggtgccctgcactttaatgtcttattattcttctccttgagtaaatcctaactgttaacgggaaataaaatgctatatgtaaatgaacatcgtcacttggaaatcatcattctgggctacagcaccaatacacctgtaatcttaaaacatccttttaatagtaatgaatttgtcaaaaaagtatattaggacatctatattcaaattaagtttaccactggcttaggtttttaaaattaatacaagttgcttaagatggtgaaaggccaaactgttgtgattccttccactatgtatcatcctggagcaaaactcataggggaaaattagatattcgtgaagcaagatagcgagggtttttgttgttgttgaggttcccatcaggaacaagcttatattattggatttacttgagagtgtacaactgcccttgaaatgaaacatcacctacttccaacaagtgtgctctctccctagttcaccctaattaaggaggcttccctatattaattttgtctcttatacaagcatccttgagactctttgtgcttaattatttatgtctatgtctcaagtattaagagcacacttgaaatttaagatttttctaagtttctaacacttactagctttgttttttgcttagacctgttaatctaattttgtcttctcaacacttttgggaataatgcattgcttatccttaaattttgctttgcagtttctgtatgaaagattccaaattcaggtttcaatgtatttgaaacgaagttgctgattcctctcactggaattaagacctacacttacttttctcactcttctttattctatttcaaagtttgatgaatattttctcaaactgtatttgaaaaatttagaatccaataccatgaccaatcttcctcctgctaagccattggtggtctaactattactttttaagaaaaattaatatggaccctgatgtaaaaagaaaagaaaaacaaatatagagtgatttcagcaggtctattactagacatgttttctcatgtttctcggtagcttgaccctcttgtctggtattcctgagagaatgggcctacccacagagaaagggagaaggaggtaaagaagttgcaggtttgctggtgatttgagatgaatcctcatgcaacaacttgaaggcagacagattggaagagcagtgagttgattttctaaagtaaaatccaccagaaagagtttacacggtgttggaattctaccacatttacaaattaatgtgccagatgccatcagcagatctatcattatgatggctattgataaatatcaaaatttgaccattaagaaaatagtactactaatctcatactggggatatcagtaccactacagaaaaattctacttaaaaacatatgtgagctaaaagtgaaaagcatttccctgctgattccacatgtccacaacagcctaagcagtgtggagatggccagcggagcagcaatagggaacgtgtgccaacatttctgataggaactctattttctgaggatttaggctcaattatgaaagtctgctgaaaatgaaacttggcataaatactgtagcttagtagaattccatcaaatacaacaaaaatgaagattaaggagagggaaatcctataaactcaactttcagaaaagaccagagcattgctaaggaaaatcaaaggaagttctcaatacttattaattaatcttttcataaacgaaatcatatttgagaagtggtgagatcatttacagcctaataatttccagatatggaagggaataaataatttaaaggggtaatgattgaacctaggaagggctgtgtcagttctagaaatagtggcttttactcttgaatttttaaaagttccattttcttagtggtggcattggcccaggccacaatcatatacaaaaacataactgaccaaaaaaaaaaaaaaaaaaaaagaaaggctttaatctcttagaatagcaaaacagaatttgagaagagcctaaactctaagatatacagctcttaaaattttaccataaaggacacttttttagagccctaaataaggtgggaaccttaaacacagaccttaattttaataactcttgggaatggatggtctcagttaactctaatcttatatttgtttatagacctcagttttcaattacaggaggtctaagcattgaagtgttagagtgtttcaatagatgaaagatgattaatagaaactttaatatctctccaagtcaaatgaccatgtaacctctacaaatattactgtaatcgctacaaatatttgttactttgtttattcattcagtaattcaaaaaaagatttattgagcacatgctaggtataacgctccataaaacaagcctaaaatctaccaaaaatacaaatatgtattcacttgagaatttctgatagctctcatttagtgaaggtaccagacactaaacaacatttaacttgagatacatctggaacctttaacaacatactaaactttaaaaaaaagtgcatatttttctaatgtggttctgaaacaaagagacaaaaagaaattttttatttgtctaatggaagagaaaaggcctcaaaaactagctgacctcccagataatgaagtgtaaaagaatgtgcaaatgtacttcaaaaagtaactctcctggacaccaactgaacccttagaagctaaaggcgggaaataaccccttcttccttcttttactctctctagtttgtctttgttctgtttcccttgtcatttcccactcttcagacacaattatagttgattgagatataacgagtaaagctacattagaaactactcatggaaaaatcaatagaaaaggatagaggcacattcaacagaaacaacaaaacagaagcactgttaggaagaaggaagtgagaggtttttgtagcagaatgtacggaacagatatttcccaagtgcctcttctatggtaggtgggacatagcagcatcatacagtcacctcatatatccactgtaaaagaggagatgggtgggtgcaggcaggtaattgtccagaaaaagcaacagactggttctattatgagaaagtgaacatacttcatttgtggaaaactatacaacaattaaccactatgaatgaaacagatctccatatattaagagagagattctaaaaaaataaaaaaaaaattgagaaaaaacaagttccaaaggtatatattcagtatgatcccatctatgtaaacttaaaaaatattgcacatatatatgtgtgtatacatatatatacacatacatatatatatatagtatacacacatatatatagagagattaattataactatatatgtgataaatggtataatatacaacaaccttattatcatgatagtacctctgggaaaggagaagtagatatctgaagaacattttaaaatttttaaatatgggggtgaatacatacgctttgctcttttctgtaggtttaagctacttgacaataaaaattaacatttttttgaaatttgttgtctaaaaaaagaaagctgtagaaattgagacaattagaaggagctgttctagtaagtctaactttcttatttctgagctgagctgagaatatacaaggctgattattttccatcttcagaaagagaaacaatggagacttactgtagaagaaaagactatccttgcaatgagaagtcagtggcacttttggcaaatgaatggtcattttcaggtggaagtgaattatctgaatgtagttatattgagtcctccagctttaaaagaatgtttcaactcatacactatttatttgagttactcttttttttctttatggggtgtgaatatgaggtttaagggacacagttaatagatgccaagttttcattgtttctacaaatgtttatagagtctggattttggaataacaatttgcacacttacaagtgttgattagctgggcaacattgcaattaatattacttttttaagctcctcgcaaagacttccttttctttcaaaattgccaataaacattttcaaacataatccccaaggagctcattcactgggtgctgggggactccagcaggaaggaaacctactaacattttattaattttggatcatgtgtaattcttaggattaatggcaaggagccagagaggttttttttttttttttttttttttttcattttttaaatcacagtggaaaataagcctgaaacatttcactagtaaggcaagagtcacttaagatatattattaaatatgaggggtagaaataaatcacagacacaagtggtattatacagtgggcatttttctgaaaaaacagactccgtgcatgaggattagatatacgcccacaataagagggcatattgatctataattttcagtattacatccttgtattttttattatatgctatttttcaactagtagaggaacgtgttctcataaagctaatatttattcttccatgtttatacagctagtagtgcatttcaggaaatgagaaattctgagaagccaaatataacttgatgtcgtatgcaaaaaagaagacaagacagaaaaatccccatattttaaaaacctgactcaggaactcactcataaagctttaaataattaaataacacaacataatgaaagtcttttgatattattttttctattcccataaatgtagccttttcatagatgatacatcttatcatgtagtattcctcattttactagaaatcaaagaaaaggaccctttagtccagttctcattttcaacactgtactcactgtgtgtattttgtggaagctgaggcagatactcactgtaatcccactataaaaattgagatacccctactggaaactgtattgttaattcatgaattcttctcattttattattaagtaacctgtgtactggggaattcaatgatttcttaaacccaaagaaaatagtagtgaatgataatttggtttttcatggagaggctgtattcatattatattacggtaaaagcctcaagaggtcagagccatttcgggggagaaattccccaagcctttggaggagaaactccccaaaggtcaattgtttctatgtcctctccttttagtttataactttacttgagcccttggagaaatcaggagaaacagaagttgtcaagtcatttccccatactccgcatgcataaagatggaactgggtgttggcaacagtaagtaagtgaggcagaaggcagaagtgttgagggggatggcaggaggtgaggccaaggatgttgggactaaagggagagagcagttaggctgtaatcaagggttctttgagctccccacaaaccgatccttgattttctgaggaagcttgtggcctagagcagacagctgaaactatggtgcttggtgaaaagcaagtgaaaaaaacaactactactttattacttaccttttcccagtcatcttgcagatttcagattttctaccctttccgttctcagtaactgaccggccacctttgtggcatcagccccaccacttctcctgaggtccaagcctgtctccatctccatatccaacagctgtcctctctctgccattttcctgtactgagttctaatattatctttccctcatccatgttcctatatcaagaaaaatgatctcctttaaacaccaaaccagaatttctcgttcttcgaaagagtctatccatccatttatgtatgttagtgtatttctaggcagctaaaaaataaatgtaatctcagagtagaagtgcaatagaatggaaagagaatggtacccggagttagaaaaagggggctacacccagctccatctttctgcccatttgggcactgtcagctctaagtgaagtttctgtagtctgggcagttgcagacctccactgctggacaagggaaagaaggtttgagtctggttattacaataactggggttgggggagatgttggcttttggttcctgagaaccgtggttactaaacattcttttatttatttttatttttatttttttttttttgagacagagctgttctcttgctgcccaggctggagtgcaatggcgtgatcttggctcactgcaacctccacctcccgggttcaagccattttcctgccatagcctcctgaagtagctgggattacaggcacccacgaccatgcccagctaatttttttgtatttttagttgagatgggatttcaccatgttggccaggctggccttgaactcctgacctcaggtgatccacccgcctcggcctcccaaagtgcttcaattctaggcatgagccactgcacctggctggttactaaacattctaaacatgcatgggacaaccttgcatcacaaagaactgtcccacttaaaatgccaatactgccctgatgaagaaacatcaatagatgattttcaatgttccttcaacctatttggcctctaaaacttaagtgaaatgtagggaacttaagagactcaggaaagaactgtgaggataattaaaattttggattatgcagatttataggaaaagttttaaaaatgggcttatctctcccaaagagaaaaaggatgatttaaaaactgagactaggatgatacaggggaagtctgaccaataaattttctttttcaatggaagcagaaataaattaacatgatatgagctcagaaattacattggctttcttgagaaagacttgaaatcataaatgaaagaggagacattacaactgatatcactgatatcacagaaataaaaaggattatgagagactacaaggaacaatgatatgccaaccagttagataacctagatgaaacagatacatttctagaaacacacaacctaccaagactaaatagagaaaaaatagaaagcctaaacagacccataactagtaaggagattgagtcagtagttagcaatcttccaacaaagaaaagtcctatatcagatagcttcaccagatcattctaccaaacatttaaagaactaatgctaatccttctcaaactcttctaaaaaattgaaaaggatggaacatttcctaactcattttataaagccagcataagcctgataccaaagtcaaccatgccacaagaaaactacaggccaatatccctgatgaatgtaagtgcaaaaattctcaacaaaatactagcaactttttgctagcaacaaatactagcaaaccaaattcaacagcagtatgcagtatgctgttgaatttggaagcctcatacttcccgatgtcgaaatgtaacaacaaactctctatatattatatacagagtttcagtcatgcaagatgaaaaaattgtaatatataaagctacaatagtcagaatggcatggtactgacataaaggcagatatatggaccaatggaagaggatagagagtccagaaataaacccatatatatatgggatcaaattatattcaacaagggttccaagactccacaaaagtgtaagaacttattcttcaataaattgtgctgggaaaactgtatatccacatgccacagaataaaactggatccttattttataccagacaccaaaaccaacccaaaatgaattaaagaattaaatataagatttgaaactacacaactagtagaagaaaacccagggaaaaagctccatatttggtcttggctgtgatttcttagatatcacaagaaaagaacaggtaacaaaacaaacacagacaagtagaattatatcaaattaaaaggcttccatgcagcaaaggaagcaatcaatagagtgaaaaggcaacttacagaatgggaaaaaatttgcaaaccatatatctgataaggggttaatatattaaatatgtaataaactcctacaactcaactgcaaaatatccaaataatataatttaaaaatgggcaaaggacttgaatagacatttctcccaagaagacatacaaatggtcaacagatacatgaaagatattcaaaatcactaattatcagggaaatacaaatcaaaaccacaacgaagtatcacctcaagatggttattatttaaaataatagacaagggttagcaaagttgtggagaaattggaacccttgtacactgagggtgagaatgcaaactggtacttctgctgtgcagtatgaagattcctccacaaattaaaaatagaactaccatatgatccagcaatttcacttctgggtacatatcaaaaaaactgaaaacaggatcttgtagagatatttacacactcatgttcactgcagcattattcgcaatagctaggatgtggaaagaacctaaatgcccactgacaaatgaatgagtaaatatggtctatatgtagaacagaagattattaagcctaacaaggaaaatcctgtcatatgtgacaacatggataaactaaggtcattatgctaagtgaaacaagccagtcaccgaaggacaagtactgcatgatttcattcatatgaggtacctaaagtagtcaaactcatagaataaggtaaaattgtagttgccagagctgaagggaggagaaacagggagttgctttacaacaggtatagcactttagttaagcaagatgaaaaaattgtaaggatttgctgtacaacatgcagagagttaacaacactaaagtatggacttaaaaatttgttaaagggtagatttcatattttgtgtgtgtgtgttttaaccacaataaatgaaaaaaaaaactaagaaaaaaaggaaattggatccctgggtatgaaggtttgaaaacaaatggatttttattggtttcagacagttcacgcagaatcttgcttgtagactagggaggagcatttaggtaacttctcacgtccttcccagcacttctgtttctatggatacagttattaggttccagcacactgtgatatcctactgaattgacaggctagagagctgaggatggaggcacaacttctcatctaccccataccctagtaaataccccctgcctcactgttcaatgggggttaatcatgaggcccaacagcgaagggtacagtgggaaaactggagtctagcccagcactacagtaacatctactttgattcttagtagaaataaaagaaataaaaaaagtagaaccacagtaaagggctactaagagagaaagcatttgtcaccgtggacagaataaaagtaccaccaaatgaaataaatgcctatgggaaaagatgtgtcatgctagaaagtactgtgttccttctcctttgctcttcatttagttttcatccactcaatgtaccaagccttatcctatatcctgtttccttttccagctttgaaagatgcatggactgaatttagcctttggttaggtctttgtcagaaagtaccttcaaaataaaagtgttttacttggtactatctcaatagcaaacatgtatttccaaaatgaaatgcttgctctactagcaagctttttccttgagtaagcaacaatattgttagtaatttttcaaactgttaatacacatacacacacacacacacaaaaccccaaacaagccctattctatcatttataaatcatagggtgaatatcctctggtagaactaaatgaaaacattcagggcactgagtttttataatttgaaaaatgataatactagttgatattgacaaattcagttttgattttcaacgtttcaaaatataatttatccacaaggtcttaaacaattgaaagtacttaactaaatctgatatatgtagatgcttggcataaatttattgaatctattcagttagaatttataaacacaaaaataaaatttgttttaagtcaatgtggggtatattttatttctaatatccttgttacattccacagggtatacataaataagtatgacaagatatttattttcatttaaatctaactttcaatgaaattaagaaatgaaaatctgtttaaaatctacccccagagttctaattgaaatagagtacaaatattttccattaaaaaatatccctcaaacttagtatcttcagtaagaaaaatgaaaaaattaacacaaacctcaaaactgccagcagctcagaagacaaatgtgttctctggggacttgattgaaaccatgtattcataaaagtcttttaaatggatgctcttcacaaaggaagtctcatggaagacagcatggttctgacatatcagaggcttctggaagcaaagaaaagcacaccgttaggatatgtctaaagtaccattactgcctgtaatggtattattatcacttatatgtgttatcagcatgatgttattaatttctattatcaattttgtaccctaaatcatcttattcatcaatggcagagtgggacactaacctttcaatatcgtatttagaaatttctaaaagtcaggagtatttataactaagcaaacctctgcttttcctcttatctaggctgggattgaataactgtgggcagggtatgagcacaagaacagtgacagtatttactgagtgtctaccagatataaggcactgtgcaagtggcttttaaatctgggatctttaatacaaacaacactgcaattgaaaagtattggctccattttacagatgagaaaaaaatgcacagattgctgacctcaggcttagaacctgtaaccatcaaagttcaaaggccttagggcaggtactttccctcatctcactctgtagccttggtgatttagaaaaatatttcccaaacagaactgacaagagaacagataatgctgcaacatactaaattaattcaaatattactaattaattaagaacttgtcttgcctaatttactttagttttatattaaatatcatcttattcagtcaggcccacataaatacaaatgcccagctttaagcagtatatttttttctaccaacttttcttccttagacaaagagagaacttgctggaaactgagaagctcctttgtgtttggtgtgggattacatgcagcgctacatcaaggctggcactgcaaacttctcatcttcctctggcccatccatgtgacccacagttcctccactgtcctgatgaatgagaacacttagttttcctgattgcatcaggaactgagcccacatcctctatggctattactgagtgatattactgtatctctttgtggctacattcaccttaatggctgagggtgacaaagcgagggctctagttggatttccattctcatttttagtcagctatctctatatttgtttctgatggttccagtgcaacacagagaccccctgcaacttacccaccaccagctgtcccagtacccactctcacactgtgttgcagggctactgctcaccaaataaatgcttcaacacatcccttgaaatgatagctttggatgccatagacttttgtctgtcctgaaccttttagctcatggccccactgcaggaccaaaagtcccttagagagactagaaaatgatggagccaggaaggtcatgcataacttttgaaatttttagtttattggatttttggccacaaaagcttcagtcatgaataaagaaacaagggaaaacgattgatggtattttcaaattctacagaaccagagcctaggattattacacaaagaaaaaggaaaaagaacagaggaaaacagagctagtttatctttgcatgacagaagaaaggtgagcttgacaaagaatgaagaaaaaagacttgaaccaatggatctaaactaagtgagaggaatgtgaaatgaatagcaactcttcttaaaacctcatacactagcattctgtttacttcataccactcagaaacacattttcaggcagggcacggtggcccacgcctataatcccagcactttgggaggccaaggcgggcagatcacttcagtccagaagttcaagaccagcctggccaatgtggtgaaaccctgtctttacaaaaaatacaaaaattggccaggtgcggtggctcatgcctgtaatcccagcactttgggaggccgaggtgggtggatcatgaggtcaggagatggaggccatcctggctaacactgtgaaagcccgtctctactaaaaacacaaaaaattagccgggcatggtggcgggtgcctgtagtcccagctccttgggaggctgaggcaggagaatggtgtgaacccgggaggcagagcttgcagtgatccaagatcgtaccactgcattccagcctgggtgacagagcgagacttcgtctcaaaaacaaaaacaaaaaacaaaaattagccaggtgtggtggtgcacacctattaatcctggctactcgggaggctgaggcataagaatcacttgaacccaggaggtggaggctgcagtgagccaagattgcaccactgcactcgggcctgggcaagtaagtgagactctctcaaaaaaaaaacaaagacaaaaacaaacaaacaaaaaaaccaacaaccaaattttcagattaaatgcctaaactagtaggcccagtttttataaaatcctaatgacaatttttaaacattcattcagccactattcattatatacttatgagccaaacaataagttggaaaattccaggaacactgcaataatcaagatagccttttagtcaagcatcttaactgtcttgtaaagagatacaactaggatgtcaaaaaccataagaaggtggtaccagtaggtgtttgtaataatggggtctgaaaccaaactggcgggggtgttcctgcttcattacttcctggctgtatgaccttgggcaaggtactaaaactgtataacttagcctccttatctgcaggatgtatttcccgcaaaggctgttcgaggattaagtaagagaagccacataaagtgctttgtgcactgagtaacatacaataagaactcatcaaaagttaggaaatgttggcgggatgcagtggctcacgcctataatcccagcactttgggaggccaaggcaggcagatcacctgaggtcaggagttcgagaccagcctggccaacatgatgaaaccccgtctctactaaatacaaaaattagccaggtatggtggtgcatgcctgtaatcccagctactcaggaggctgaggcagggagaattgcttgaacctgggaggtggaagttgcagtgggctgagatcgtgccactgcactccagcctgggtgacaaagtgagactctgtctcaaaaaaaaaaaaaaaagttaggaaatattagtagtattgttgtataacagatcatgggtggtatcagtgatggaaaacgtgctatgaagctcagaggaattggagatcctttctgttggggatgaatggaatcaagaaggcttcagtgaagaaagtagcatttaagatcaactataagtaaacagagagacatgattaggcatttacagaaattctattataattgaaaagccagaatatgatatactttagaaaaacataggttcatgaaattagacattattttccaggatttggtgtgaaagtagacacctaacctaacaacacagccaggtcatagtacaaagaaaatcaacgtactgctaccaagagaggtacacgatcccatggggtcctgttctatttaactgtaatccaaaatgacaccatggcttttaatggagcttggcaagctctagacgtgccaattataaacttagccttaaatttaaatcatagggcttgagactcaaatctccaatgtgacctttcctgggtgttgttcaagaaaacatgtctgtcactgtggacagaaaccacacacccttttactctggaaagtataatataaagatgtactgtattttacaagcacagagccacaaaatgatggtggctataattccctagaagcaataaaagcaaaggctgtttgatttgtaacattcatttagaaatgtcttattgcattaatgaacattcttatttcccgcatattcgggactttaattcaaaaaaagcttggcaggaatctcatcatttatagatttaacatatagttcctctggatacattcattttgcaagggctcactaagccacactactttgtccttgccagacccatacaatattgtactgaacagaggagctaaaagcccacagtggcttgaattctcctataccctccctgtttcctagccatggaaggtctaatcaaggagagttctatggttgaaatgtgttcaggtgttgccaatgtgatagtgtgaagaggtatagcctttaagagatgattaggccatgaggactcctccctcatgaatgtgatcaaggcccttataaaagagtcttcacacagcattcaggtagctggcccttctgccttccaccacgtgcaaacacagcaatattcccctccagagaaaccatcttggaagtggagagcagccagcaccacagacaacagaatcttctggtgctttaatcttgaactttctagcctccaggactgtgagaaaataaatttctattctttataaattacctaatcaatggtatttgttataggaacaacaaaggcagaaattggtgccagaagaatgggatgatgctgtaataaatacctaaaaatgtagaaacagctttggaattgggtaatgggtagaagctggaatggtaatgggtaaatgctggaaaaagcctgtaccgtcatgaacagaacattaagggcaattgtggtgagggctaagaagaagcagaagactagagaaagcctgacttccttatggattacttaagtgtttgtgaacagaatgttggtataagcatgaacagtaaagattattctgttgagatctcagatggacataaggaacagggtactggaagctagaggaagggccgtctttgttataaaatggcaaagaattatgctgaattctgtcctgtcctaggactctgtgaaatgcagaacttaagagcaattaactagactatttggtggagtaaattctgaattttccattaattcaaattgtgagcatttgggaaattttcagcttggacatgtggagaataaaaattaagtgcgtttagaagagaaaaccaagtgcatgaccaagtgactgtttggtaaggagattagtatggatagaagaaagccaggtgctttagaagaaagccaggagccattgacaatgcaccaatggctctaaacacattttgaagatctttgaggctgcccctcccatcatgggcccagagtgctagggctttgagggcagaatggttttgaggaaggggcccagggtgcctgggggatctggggactcactgcccagggcaatctcaagtctctgctccccacattctgttacggcattcctcagcctccccagctgtggcttgagtggacccagctgcagctgtaaaccctggcagcctccatatggtcgtaattctgaggcttacagagtgcaagagctgtgagacacagctgcttccgcctagatttcaaaggatgtctcaggcagccttgggacctaggcatgaacttgcttgccacagaggtaggaccatggcagagacccttcactagtgcaatgactagtggaactgtggggtcagagccactgcagagagtccccagtagggcaatccttagtgcagccatgggggcaggttcactcataaaatcccattattgtagagccacagcatgcaactccagcctgagagagctacaagggctgaactccagcccgcgagagctgcttcatgggctatgctcaacaatattgtcatagaagggtctcctggaggcttggagacccaacccagctgagtatgtcttgaagaagatatgaagtaaaagattactttcaagtcttaagatttaatgtttgccttgttgggttttagacttacttgggacctgttacccctttcttctttgctatttctcccttttggaatggaaatgtctatcctatgtctgtcccatcattgtattttactttatttttgagacagaatgtcgctctgtcacgcaggctggaatgcagtggcatgacgtcggctcaccacaacctccacctcctgggttcaagcgattctcctgcctcatcctcctgagtagctgagattacaagtgcctgcccccacgcccagccagatttttttctatttttggtagagacagggttttgtcatgttggccaggctggtctcgaactcctggcctcaagtgatacacctgcctcggcctcccaaagtgctgggattgcaggcataagccattgcgcccagtcccatcatcgtattaatattttagaagcgcataacttgtttaacttcacaggttcatagcaggagagcaatttgccttgacatgaattatgccttgagtctcacccatagaggatttagatgagactctggattttagactttgagttgatgctagaacaagtttagactgggctactgggatggaatcaatgtattttgcatgtgagaggacataaatttgggagaggggccagggtagaatattatggttaaaatgtgtccccttcaaaattcaggtgttggcaatgtgatattattaagaaattgggcttttaagaggtgattaggccataaggactcctcccaggtaaatgagattaaggaccttattaaaaaatgtttcacacagcatttggataattgctcttctgccttctgccatgtgagggcaaagggttcctcccctccggaataaccatcttggaagaaagcttccctttccagaaaactgaacctgccagtgcattcatcttgaacttttcagcctccagaactgtaagcaaacaaatttttatgctttataaattaccccatctattgtattttggtatagcagcacaaatagactaagagagtgagcctgcaataaatacagtatccttctttatccctttcactgaaaacctgttaacactattttccattcattccaactcataacatcacaatttatgcactaccattgtgtcaattcattcttagattgctataaagaaacatctgaggctgggtaattcataagcaaaaatttattttggcttatggttcttcagcctatacaggaagcatggcgctggtgtctgcttctggcgcatcctcaagaagcttactatcatggtggaaggcaaatgggagcaggtccatcacatgatgacagcaggggcaagagagaaaagggagaggtcccagactcttttaaacaaccagatcttgcatggacttagtgagaactcacctatcacaaaggacatggtgccaaaccattcatgagggatccacccgcatgatcccatcacctcctaccaggccccaccttcagcattgggaatcacatttcaacatgagatttggaggggacaaacatccaaatcatatcaaccataacttctagctagtatttattcttgtagttcatcctgaaaagagcccaaaatgggtcatcctcaggctatagtggtgataaacatttgaactaaagtaaataaggcagggcactgtggctcatgcctgtaatcccagcactctgggaggctgaggaggcagatcatttgaggtcaggagtttgagaccagcctggccaacatggtgaaaccctgtctctactaaaagtacaaaaatagccaggtatggtgatgtgtgcctgtagtcccagctacttgagaggcggaggcaggagaatggcttgaacccaggaggtggaggttgcagtgagctaacaccactgcactgcagcccgggcaacagagtgagactccatctcaaaaataaataaaataagtgaataaatgcatagatgagataattcttaaaatgtaactctaattatgtacatccactactaaagaacttacaagggctccctattttccaaagatcagacctaagttattcaccagaaatatctgttcccaccatcctctgtaatctcaaaacagactatttctgaccaaaacccttggatccagtagaaatggtctgctcactatgttatatagtgaatctcaactagaggtgcatcacaggtgcatggggtgtcgcctatgacaaaagtgataaatgacatctctcttgccctgtttctctgatcagctactactttgtgaaccaccctatggcgaggcccatttggaaagaaactgaaggatctttccaagacaacagccagtaagaaacttgggccctttatctattagcctatgagaaactaaatcctaccaacaaccaatgagcttggaaatatattctgccccagttgagcagagatgctgtagatgttgctctagttgagatgactacaggcctggccattgctttgactgaagccttgtgagagacccagagttggaggacccagctaaggcatgctcagattcctgactgttgtttaagcaattaaaatagggggtcaggcctgaaaaattcctgagcaaatacaaccagaggtcttaaaaatagccttaatcttgcttaaattgccaacataagcaaaacttaactcaggtcacttctgataaatgcttacattagaactaaaacttaaccccagtgcatcgtaagcagctaatgaacataattatgtgactggactttccaagaaagtaccaaagaaaaggccattttgtcattgcaaaccggtcaaataattttattttaccttagcattttcccaataaatacttgcctcattctgtcattgagacactaaacctcttgcaatctggtgttctccatccataaattgtttcttactcaaactctttaaaattttatgccttaaattttaatgcagtgatagttaattttatgttgttaacttggctaggccatggtacctagatatttgcaaacacaagtctagatgttactgtgaagatgttaaaattaacatttaattagtagacactgagtaaagcagattactttccataatgtgggtgggccttatctaatcagttgaagcacataaggcaaaacagactgaggtcccccaagaaagggaattctgcctccagactgtctttggatttgagcttcttccctagatctccagcctgctggcctaccctgcagattttagacttgccagtgtctataactacatgagctaattccttaaaatatcttaagattctctctctctctctctctcccccctcccactccctctcctgttggttctgtttatctggagaaccttgactgttgagatagaactgataggacctatagagagagagatgtataataagggatttattaggggaattggctcacttgattatggaggctgagaagttccatgataggccagccatctggaagttggagaacaagagaagctgatagcaaggctcaattcaagtctgaaggccttagaaccaagaaagtagtaactctcacaccaagcccaaaggcccaggagcctaggggcattgctggtgtaagtcttggagtccaaggacaacagagtctggacttctgatatccaacagcagaaggaaaaggccatcctggctcccagaaagagcgagaattcaccattcctttgccttctttttccatctgggaaccccagctgattggatagtaaccacccacattgaaggcagatcttccccattcagtccactgactcaagtgctaatctcttctggaaacaccttcacagattcccctgggggcaggcctatcattctaatcaaatgccaaaacagtccatctgggtttccctttcatcaggagaaggacaagctcagtgcctactgaagcactgagaataattaatgctttaccagctatctgggtatccctttgttttagtctattctcacgctgctacaaagaactgctcgaggctgggtaatttagaaaggaaacaggtttaactgactcacagttctgcatggctggggaggcatcaggaaacttacaatcatgacagaaggtaaaggggaagcaaggcatcttcttcacaaggtgcaggagggaaaataaatggaggaactaccaaatacttataaaaccatcagatctcgtgagaactcactatcatgagaatggcatgggaaaaactgcccttatgattcaattccctccatctggtctctcccttgacatgtggggattatggggattacaattcaagatgagattttgggtggggacacaaccaaaccatatcatccttagaccagtcacactgacacccaatcaaccatcacaataatcacaattaactaatacgaagacccacagatactgtgagactaatatgacagccctcccatcacatttatcacaatgaattataatttttggattcctctctaatatggtaagcttcatgttctgtcaagcagagaccacgtacatcatgtttgcaaacaaatattgtactgtgtccagcacagtgactacattcttgttaaacaaatgagtcaaaactaaagcttctccagcagtgtcttcatataacctaagaaaatgacggaacagtcccccaactaacttattgtttacgatttatttgtacctttactgaaggtacctttaatattgtaagaaggcacatatattcattctttcacaataataaacaaaatagtagagatgagacaaatcatgacacacgggagtgacacacagagtggagttttatggagttggagaataagatgattgtgaaattgagaataacaaatttgaaattttataggctgctttagagcagaagtatcagatttcaattaaaagtgtttttgaagatgaacgtggcatcaaagtttagaataggaaaaaaggctattgctatttgaataggtcagttagacagcagtggaaatataaaagtagggttggatggaagaaaaatgcagagaaaaaattccatcaattagatgaaatggataatgagaaaaaagatgcagtcaacaattataggaatattttgagcctaggtgtgggggagactgtaagaacactgacagaatgtggagattcaagaggggagctggtatatgtctgcatgcttagggagtataaaatgatagtgactttactttgagatatgccaagtttgagaaatgccacattccttcctatgttttatgaatacagaaaatctaagtttgataaatgtttcaccaaagatcaatagagactatcaaagactatctctaatttattgttcagcgagtataatatatggtaaaatgcactgattttaggtgtacagttcactaggctttgataaatataccttcccaagtaacctacacacaagtcaagatacaaaacatttccatcacccctgaaagtttccttctagtcaagccccactcaaatgtgaaatttcaatgtctatcaccataaatggctttgcctatacttgaactctgtatataatcatacggtataccagatagcatatgttcttttatgcctggttccttttgttcaatgtaatgattataattcttgttaaatcttccagtagttaattcataagtattcaattgtataaacgactaataacctactacatataatattacattatatgaatttaccataacttatccattctcctgtctatggtcatttggcttgatccagtatttggctattaataaacaaagctattacaaacattcttctcagggctttatgttcttatacaaagccatatatcctttcattcttaagtaaataggtgtgaggttgccagggcattaagtttataaggaaccactagttttcaaaaaaatcctgtaatatgttataccctcaggagcacggtacaagaatttcagtattaccacatcctcaccaatgtttggtgagctcagtccttttatttttatctttttcttgtggatgtgaagtggtacttaaatttacatttccatcatggctaatgatgtcattattatggcttcaaatgtttattaaacattcttatcttcttttgtgaaggttctgtttaagtaatttgccaattggaagaaaaatattttctttgtattttttgagttgtaaagctttgttaaatattctagattcaattccttttcatacatatgtattgcaaactattaatatttgccctttctgtggcttgcctattaaaaatgtttttttatagggagcctttaatgtttgtggagtatagttaactgatttttttctataatgtgagtgcttttagtatcctaagaaatagttatcatcttttgactttttctagaaatcttataaattttactttcatgtaaagatctaattcaaagtatatactttgaatcaatttttgtgtatggtctgaagaaggtgttaaggttcattctgtttcaataattgctctagcaattggctctttttctttttctatttttttttttaagagactgtgtcttactctggttgcccaggctggagtgcagtggaacaatcatagctgactgtaaccgagtacccctgggttcaagcaatcctgcctcagcttcccaagtagctggaactactgatgtgcaccaccatgctcagctactttgactatttatttagagatagggtctcgctatgttgcccaggctggtcttagactcctaggctcaagcagttctcccacctcggcctcccacagtgttgggattataggcatgagtcaccacacccagcctccatttcttaatgagcctttctcctatatgtaacaaaattgctttgttattaaatcaatttactgtataagtctgtgtctatttcatgataacatattctgttccattgatctatttgtctatctttgtctagtatcatattttcttaacacttttatagaagtcttgaaatcagaaagctagtcccccaacactgtcatctttttctaaaataatttgacactaataagtccttataattctgtataaattttagaaccaatttattaatttccaccaaaaaaacataaacttttgggactgtgttaaatatacacatattttgaaataaaaatcttaatatagagtcttccatttgcaatttcatttaccaaatgtttcttactgtatagaaatagcactgatactttacatttatcttgcatcctgaaaccttgtaaattcaagagatttttgctaagttcaaatagatcttttttagactccataggattttctatacaattttttaagtaaatttttgacttgctgtctccaaatatttttattattcttttccaatctatatactttttatttattttactggcctgactgcattggttaggacctccagtacaatgttgaactggtgagagtgaacacccacatctcttttcctgatttggagggaaagtattcactgttaacatccttagttgaaggtttttcacagattccctttaacagattaggaaagataccttttattcctagtctgagtttttatcatgattagaggttgaattttattaaatgctgtctctctaactagtaagataacctttttttctattaatgtggattgattttgaatattaaagaatgcatacatacttgaaattcatttttgtcaggatatattactgtatgttaatacataataacacatcactgcagtgattatgtgttatttcctaattgtatgttaaacatttttgtgtctatgatcataaggcatatcgatgtgtgacttttttaataatgtccttatcaggacttggtattagaattacaaagctctcaaacaatgactagaagtgttctccccacctctatttcccgtctttgtttaagactggtatttcttcttaaatgtttgaaggaattcattagtgaaagcatctggatctggagtgttctttgtgggaagcctctgaattataaattcaatttagttaacaaatacagagctattcccattttctgtttcttctaatataagatttagtaaattttatcttataaaaaaaacttgtccatttcatctaagataagtttgtttcttatggcttctcataccctataataataattccttcacttgactaaaccatatatatttcactggacctcctttcttggtacattaaactcgctggtactttttcctcttctgagagcttctccagcccttactgacataattttgcactgccatgtgttttcagtcatctttattagtttgttttacctttgaaaaacagattatagtgtcctcagaggcggaaatatcttaaactttcattgttctccatggaatttagcatagtctgttaacattttatatgtgtttctgagattatggatttgttcactgttggttagcttgatatctattacagatgtgcttggagcatcttatagtaataacaggaagcatgaaaatgttagaaaataatgataataataactaagattggacacatcaaagtaacagaagccaaccttaaagcgcttccaatggccaaactgcaacaatttgagaaacaataaataataatactggactatatacctcaaagaataaaataatgatccatgagttcataatattgtcaatagtcaactgaatgactgaatcaataaatgggtgagaaaagtatctttcttgcagaattctaaatttaaaaaaaaagatggaatgagagaaacaataattagaacatctagttagaactgctacaggcaaaactcaatgatgaatacaaaaaaatgagtggccaaaagccactcatttaacaaggagcaggacagttaaaatgactcaaagtagtatccctaacatattaattactatggtggcttttaacatgtgtctacaattcttttatattcttccatcaggagatggaacttaatttttttccccttgactggatgatagaattagtgacttgcttgaaactaatatggaagaggaaagtagtaattgtggagaaacctggcaagcaccaccttaatcaagtaatcaaggttcacacatcaccatttaaagtcatgttgatatcatgtacctttgatattatgataaatgtactttaccactgtggtatttttccctaatatccctaatgctcttctaactgtgataacatattaggaaactaattaatattctatgaaatatcagacctttactcttaaatattgtcaaggtcatgaaaatcaaggaaaacctaaaactgtcacagattggtggatactaaagaaatatgatctctgtggtatcctagactggatcctggaacaaaaaagggacacagttgaaaaactacttaaaaaaagagtaaagtatagactatagttaattgtattgtgtaaatgttaatttcttagtttgataaatatactatatttaggggcaagcaagagtaatttggaaacatctttggtaacagctataaccactacttccaaaaaagacacaggttgccaatagaaaaattaataataaaggtcaatatccacaatacaaagaccctggacacaaatccacttactcacagacactgacacccggcccacccacagccctcatcaacagggccacctgcagaccctgtcaaatgtcctgcccagaatctctttccaggatgacttgtggagggctttccctaccaaaaccagtctataaagatggagagaggtgactgcttcttcaagtgcacagacaccaacacaaagatacaaggatcacaaagaatcaggaaaatgacaccaccaaaaagacaaaataaagctccagtaaccaaccctaaagaaatggagacctataactgccagaaaaagaattcaaacaattatcttaaagaagctcagtgagctacaagagaacaaatcaggaaaataaatgaacaaaattagaagttcaacaaagagatagaaaccataaaaaagaaccaaatagaaattctggagctgcagttattatgactgaactaaaaaattaaacggtttcaacagcagattcaatcaagcagaagaaagaataaactcaaggatatgtcatttcgaattattaaagaagaaagaaaagtgtgaggaaattccactagacttaagagcaagcagactaatcagcaagtaagctaatatatggactagcaagcaacatcagcaagcaaactaatatatgcattatgggacactcagaagaagagaaaaaggaacagaaagcttatttaaagaaataatggctgaactttttaaaacctgaagacggaaatggacattcaaattcatgagagaactcaaataggtggaacctaaagagttctaggagaaattactattaaattgtcaaaagtcaaaggcaattttgaaagcaagagaaaaaggactcctcacatatataaatctccatacaactattagcagatttttcagcagaaatgttgcaggcaagatgagagtgggatgttatattcaaagtgctgaaagagaaaaaaagttgccatctagaaatactatatctggtaaaaatgtcctttaaaaatgcatgagagacaaagatgttccaagacaaatgaaaactaaggaagtatgtcaacactgggtcctccttataagaagtgtgaaagggagttcttcaagttgttacaaaaggatactaaacagcaacatgaaagtatatgaaaatataaatcttggctggtaaaggtaaatacacagactaatacataacaatgtatattgtaatgaagatgtataaattacttataatcctaatataaagtaaaaagattagttttaagaataactattaccaaaaatattaatgcacaatataaaaagtaaactatcacatcaataactgtgtaataaacatagtttttgtgtgttattgaagatatgttatcttaaaatagactgttataagaagttttatgtacacctcatggtaattacaaaagtatagtagatacaaaagatagaataaaagcttattactacaaaagctcacataataaaacagcaaaaaggaagaggaacaaaagaactataaaacaagacaactaacaatataacaatagtattttacttatcaataatttaagtggatcaaactcaccaaataaatataaaaataagattcaactatgtgttgtctacaagagaagaactttaaatttaaggacacacagactgaaagtaaaagaatgaaaaaaaaatactcaaagcaaacagtaaacaaaataaagcaggggtagctatttttgaaatatacaaaatgcttttaagtcaactgtcacaagagacaaagatcattatataggggaaaaaagagtcagtttaacaggaagataacagtagtagacttcaataactcatcttcaatatggattgatcacacagaaagttattaaggaaaacagcagtcttgaataacactatataccaaatggacctaacagaaatgtacagaacattctacccagcagcagtagagcaaacattgttctcaagtgcatatagaacattctctagggtagatcacatgcttggtcacaaaacaaatctttattttaaaaagattaaaatcataccaagtatctttctgaccacagtgaaatcaaacacaatatcaataacaaaaaaagagaaaattcacaaatacatggaaatttgaaaacacactcctaaacaactattggctcacaaaaagaaatgaaaaggaaatttaaaaagtatgttgagaaaaataaaaatgaaaaatatactaaaacttattggatgcatcaaaagaaataataagagggaattttatagtataaacacctaccttaacaaaaaaaaaaaagctaaatgaatgacctaattgtatgctttaaagaactagaaaaagaacaaaccaggccaaaagctaacagaagaaagaaaatattaaacgttagaacagaaataaatgaactagaaaacagaaaaacattagaaaataatataacaaagagttggttttttgaaaagataaaatacacaaattcttgcccagactaagaaaaaaagattcaaataagtcaaataaaagaggggccattataactgatgccacaaaaataaaaaatatcataataaactattatatgtgacaatatatacgaacacattggataacctaggagaaatgaatacattattagaaacacaggacctaccacactgaatcatgaagaaatagaaagcctaatcggatcaatgacaaataaggagagctaataagtaatcaaaaaccacctactaagtaaaagcccagtatcagatggttccacaggtgaattctatcaaacatttaaagaatgaatgccaatattcttaaactctcaaaaactagaagaggaaacactttcaaactcattttatgagtccagacaccccaatacaaaccaagacaaagattccatgagaaaagaaaataggccaatatctctgttgaacattaatgtaaaaattttcaacaaaatagcagcaaaccaaattcaatagtgcattaaaagggtcatacaccacgagcaaatgggatttattcctgggatgcaaggatggctcaacatatgaaaatcaatcaatgtgatacatcatagtaacagaataaaggataaaaatcacatgataatattaatagatgcagaaaagcactttataaaattaaacacgctttcataataaaaacttaacaaattaggtaaagaagaaacttaccttaacaaaataaaggccttacatgaaaagcccatatgtatcatcacactcaacggtgaaaaactgaaagatcttattgaatccagaacaagtaaggatatccactcttaccatttctattcaaatgagtactgaaattctagccagagcaatcaggcaataaaaagaaatatatatatattttttactttgtaaaggaaataattgggaagaaaaaataaaataatctgtttgctgatgacatgattttatatacagaaaactctaagaagtccatacacacagaaagtgttataaataataaatttagtaaagttacaggttgtaaaaatcaacatataaaaattagttctgtttctatacataaacaattagctatctgaaaaggaaattaaaacaatcccatgtacaactgcatcaaaaagaacgaagtactcaggaataatctttaccaaggaggtgaaagacttgtacacaaaaactgtaaaacaccgatgaaagaaattaaatcacacacaaataaataaaaatcccatgttcatggaaagacttgagatatcaaacaaaaatattttgatttgaagaatatcaaaatgttcacactatccaaagcaatctacagattcaatgaaacctctatcagaatcccagtggcatttttttacagaaacaaaaaatacaatcctaaaacgtatatgaaaccataaaagaccctgaatagccaaagcaattttgatcaaaggaaaatctggaagtatcacatttcctgacttcaaaatatagtacaaagctatagtaatcaaaagaggataacctggcataaaaacaggcatatggaacaatggagcaaagtagagaatccagaataaacccaggcatgtaagatccaatgatctgcaacaagggtgccaagactaaacaaatgatggtggaaaaagtggacatccatatacaacagaatgaaattttacccttactgttacactgtatacaataaaaactcaaaatggaataaagacttaaatggaagacccgaaaccacaaattttctagaagaaaagctccataatgttgacttcagcaatgatttattggatatgataccaaaggacaggcaacaagagcaagcaatagatatgtgggatcacatcaatctagaaaactacaccacaaaggaaataatcaacaaaatgaaaaggtaacttacaaaatgggagaaaacctttgcaaaatgggggaaaataatttatctaataaagggttaatgtcaaaaatatatcaggaattcctgcaactcaatagcaaaaaaatccaataaaaatgggtaaagaaactgagtagacatttctctgaagaagacatacaggtatatgaaaacatactcaacagtaccaatcatcagggaaattcaaatcaaaactgagataccacctcacacctgttaggctattataaaaaataaaaagataacaaatgttggtgaggacacagagaaaaaggaacctttataagctgttggtgggaatgtaaattggtgcaaccactgtggaaaactgtatggggattccttaaagaatcagaactaccactggatagtagaaatcccacttctgagtatataaccaaaggaatcaaagtctgggtcacaaagagatttctgcactatcatgctcactgaagcattattcacaataggcaagatatagaaacaacctaaatacctgttgacagatggacaaataaagaaaatgtggtatatacatacaatgggatattattcagccttgaaaaagaaaatcctgtcatttgcaacaacatggatgaatctggaagacattatgctcagtaaactaggccaggcacagaaggaaaaatgctacatgatactactaatatgaggaatctaaaataatcaaactcataaaagcagatagaatggtggttgccaagggccagaggaagggcaaaatgtggaggtattagtcaaagggtaaaaatgttcagttataaaagacaagtcctagggctctactgtacagtagagtgcctatagttaatattttgtaagacttaaaatttgcagtgacattatttgctcgatcttatgttaaatgttcttactgcaaaataatatgaaacttttggaggtgattaatatgtttatggcatagattatggtgatggtttcatggttatatacttatctctaactcaccaagttacatacattaaatatgtaaaaattttacattattcttacctcaaagtgatttctctttaaaaagatcaatatccaaaaccactctgacttcaaaagtcaggtagatagtactgacttttttaggaaataaaagaaacacctatcttttggtgaggtaatatccaattattttacattttaactttcaaacaactgtaaagagacatgagatttatacttgttctagatgcttccagttcaacatggtaatcggatcacatcaacttattccatgccttctcaggttcccaaatagccataaatctacaaagccaaagaaaattggagtgaatgaggaaatgctagaaaaattctagatgatagaattgaacaggactgagaaagctacagcctaagtacatgtgagaagaaaggatgatcaaaagaaggcagaaatttgagagaattctgtagggaaacaaccagatttctagactataccctaaaaagcaagatatcaggctataatctctgatacaaagtttgcagtcaaattttctttcttaaatataattgtataacacttactgacagacatttgaagaaagttggaaagataaagaagtctgcaatcaacaaacaaaaataacccttgagaagtgtctgtttatatccttcgcccactttttgatggggttgtttttttcttgtaaatttgtttgagttcgttgtagattctggatattagccctttgtcagatgagtatgttgcaaaaattttctcccattctgtaggttgcctgttcactctgatggtggtttattttgctgtgcagaagctctttagtttaattagatcccatttgtcaattgtggcttttgttgccgttgcttttggtgttttagacatgaagtccttgcccatgcctatgtcctgaatggtattgcctaggttttcttctagggtttttatggttttaggtctaacatgtaagtctttaatccatcttggattaatttttgtataaggtgtaaggaagggatccagtttcagctttctacatatggctagccagttttcccagcaccatttattaaacagggaatcttttccccattttttgtttttgtgaggtttgtcaaagatcagatagttgtagatatgcggcattatttctgacggctctgttctcttccattggtctatatctctgttttggtaccagtaccatgctgttttggttactgtagtcttgtagtatagtttgaagtcaggtagcatgatgcctccagctttgttcttcttatgcagccaaaaaacacctgaaaaaatgctcatcattactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgtggaagtcggtgtggcgattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacatggacacaggaaggggaacatcacacaacggggaatgttgtggggtggggggacgggggagggatagcattaggtgatatacctaatgctaaatgacgagttaatgggtgcagcacatcaacatggcacatgtatacatatgtaacaaacctgcacattgtgcacatgtaccctaaaacttaaagtataataaaaaaaaacccttgagggaatttgagtgattgacagaatagaacttttaaaactctaaaaacataaagaagattttattaaagaaataatcagacaattatcaattttacaaaaatcaatataaagaaaattgtgtttaataattcttccagaaagcttttaaaaactgaaagagaaatgaaaaacagaagacaaaagacaaaggatatagagaatccaaccagaagacccaactactaagaatgccaaggagaattcccagtaagaaaagcaaaggagaggaattcaaaagaaatttccacaagtgaaggtcaggtgttttcaaaattaaagggctcatcaagaggtaaacataatcaatgaagaaaagaatcataaccagatatgtttttgtaagagttcctacagataagtttctaaaaactgaggaggaaaaaattagtaacttacaaaggggcaggaatcgaatttcttgtcagcaatactggatactaaaaaatagagcaatgccttcaaatttccaagggaaaattgtttttaacttatatgtcttaatctagccaaatctagccaaaataataagtcactttcagatatacaaagattcggagtatttacttcccacatgtcctttctggaaaaattcttgaggatgtgcttcagcagtaaataaaattaaagtaagaaaaggcatgaatccaagcaagagcaaggcaagatgcctgtgtaccagttaccccaacctgggacagagggaggtatctaggaaaaaggggatttctaaatattttattctatttcctgaggtgaaagtacttaaaaatgcaataaaggcagattacacaaagaaaagtaaaagcaattagaaactctaggaaaaacaaatacaatcatagtatacaacttagatcagtagttataactacatattcatacctatatattgatttttaaccattagaatcaacctaacaatattacaactagagttgtaatatatttgaaaaacattatatcaaccttaataatttaaaattaaaagcacatatgagagaaactggaaggcattaaagggaggagttatagaaagaatgattgttatggtctgaacttgtccaaaatttgaaactcaatcctcattgtgctgttattaagaggtggatggaagctttggggaagtgacaaagtcacgagagctccatcctcatgaatggatcagtgccttatagatgggctggagggaactggcgtaggtccttttagctcttctgctatgtgaggatatggcattttcttcttttgctcttcctcctcttctatgtgaggatgcttccatgaaaacacactatggatagaacaggcctacactagacacagaaactgccagcaccatgatcttgtgctttccaacctctaaacttagaagaaacaaatttctgttctttatatatcacctagtgtcaggtatttttgttacagcaacacagactaagtaatagtctcatcttaaaaaggaatcatttggtactgtatatgattgagatagaaatgaaagaataagtatattattcaaaggtatacaggtaacgagaacttctgggttttcctctctaaaatatttagaggttttactctctaaaataggagggtattttagcaatggggagctgctagatcattatgtatcacagtgattaagtcaacagataatattgaaattttataaatcaagaaattgtgatcacatacacatgcaatacttgattcagccaatattacacagttagaactaaaaaggaactaacaaaaatataaacatagaaacagctaaaaaaaattattagtttttctttgggcagtaagtctagaggtgggatccaggactatagtttttcattataagccctcctatactctttaatttttaaaagcatatatatgcatttattgatcaaataaatgtgaaacatttattaatgtttaaaaatccatctggaaatcatccagctagactaatgcttcatcataatgcagctctcagcatttaaataaggtcttgttggtaattcagaaattactacattttaaagctcaaatagcaatgtcttctacacattctactctgtggtaggaaatatcacagcaatattttagaacagatgacaaaatagcctatatcagggatattaggtgttaaagaaataaaactggttaaaatatttgttaaaaatatgaggtgaataaatgcctgtcctaatgagtctccccactagtatctaacacatgttagagaaagaggaacactggtctctctgctcactagtacaacaatggatgactgcttaaattgcagccatcctgaaataccttgagtctgtcatttattccctctgatttcctatgagaaagattacaaattgcccactagaatcagggtctgtgagccacatcctccactttcatttctaggacataatacctctgccgtcaatcacagcacagctcaaattttttgaagcatagtgggatacaacagaattgtcacttaaaatttggaatacatctgatgtagcacgaactggactttctaagtgtgttaactactctgcaatatagatttggaaaatgtgaaaatgaagtggaaaaccttaaaaagacaaatgtccaaataagaaagattacagtctgtggatggtattctcattcatcttcaaatttcctttgctttgtgtttaaaccaaatgaagaggttttccaatgtcatttgacacaggcaaacatctgaaattcaacagcaaagtccccttcttgcagaagccttaaaaatgaaagctggtttgcttttcctaaagaaagaaaaaaaaaatgtctccccaacccccaacacccaccctttcctgaaagagaattttccagcagctggaagtttccagacctatgttctcagtgttggacagccttatatttacccatttttagcaaaattagggctcagaaagtttcatgagtagtggtacacatcagacgtctgttggaagtcattgtggaaagggtttctctgtacatatgtatagatctaagtaggagatggaagtcaccaaaataattttgtaacagaacagcaacaacaaaaagaataatctataaatattataggactttcttggtgtggataaaatcagagctcaaaaagagcctccagatcaatccatgtgagattttacaggccttctagaattggtaacagacaaggttttgctctcctgccagccggcactcctatttctgatgcattcatacagagtgatggttgttactaacattgtaattacttatacaatccttttaagaatgtaagttccatgagagcaagaatgttatatcatccactactgtattcaatcatttagaagagtgtctgacatataataggtattctgtaaaatttttaaatgaataaacaccttgtaaatttactgtaaagagcaaaggaataagtacaggtgaaagtgctttgcaaattaaattctaaaaggtgagcagttgttactctgcataatccaattcctgttggggcccgctcctaaaggctctgacaaagccattgcccgcattttgattccttctactgggccataattagactcatctacgtgggagaggcaggataatgcagttgttcaaagtgtaaaccctgaaactggacttcctgagttcaaatcccacctctatgactgactgactagctatatgatcttgagaaagttatttaacctctctatgcttaatttccttatatgtaatttgggagatgataatgatgcctaacttatagggttgtgataattaaatagattactatctgtaactcattgaaaacgggctggtacaaagtaagcattaagtacggctgctagtgttgttgctaccactcctattactatagggatgcagaaaaaatataaggaaattcagcaatgtccatactgcgaactttttctactaatgccacgtgcaagtttaaggctatattttacattgctgaattcctctgaagtttcaacttcatgaactattcttctacatatttagttccttaaagagctcaatggagctacagctcagtaagttatgtgttttggataaaataaggatatgagctgaggcatttaatcatagaagcagcctcaggctctctatccattcttggcttgtttttcaaagcacattgctaaatgtgttttctctttcataaagttttttaaaagttacttggacatgacaagcttctttaaatataaaacagtttcaatttttattgagatttgcttcaggaacattcttagtgttggtaatatttttagacaataattttattcagaagaccttattttatagattaactgcacaatagagttcatgcagttacatttacatggactttgtgctccatagtactgaaatccaaatatcagtttacttcagtataagcatatcagattgacctgaaatgctctagaacttttaaaaggcaaacgccaaaatgaaacaacacaccacctctcaagcatgtattctgtgctatgagcaagatctttcagttagaacttactaaattaggtcaagaggttctcctgggataaaggagtttgccaaagtaattctaaaattcccaaaataaggcacacagcactataacatttcactgattcttactcgttcttttatagtgctttgggaaatgttagaccattggtctgcatcatttcacctccttgtaggggaaaaactgtcaccagcaactgctgcttcaaactgtaataatcttccaggttcattctagggaatccaaaaggcgagcaccacatatttcctttcctttccacaggcgatcatgcaaattccctagcttaaggctgagaagtgcgtatgtgtgtatacttatgtatattatgtatatacagcctatggatattatatatatatacactatggacaatatatatagtatctatggatattatacatatgccatccatggatattatatgtgcataatctacgaatactgtatgtagatgcatatctaatatacatacatatacatgtattcattattttatagaatcaagttgagcttttcaattactggcagatctacaaaggctgttgagatttaaaccattacaaacaattacatgagagttgtcccggagtcacagagcccagaaagctaattctaacctgctttccttcttatgtactatatacttctaattacccagcacggttaggttctcataccattttgcatattttcatccaaaaattcaaacctactccatcctgagaacaaaagctggcaagaagcactcaagtgatgggtgaacaaatgtattaaaaaaagcaacattctgacatggaaatgtcatgtgagctgccgaatggcacacagctccaaagtctaccataatattttgaaacactttgccaatgagcatataattgactgaaaaacttgccagcactattccagagatgtttaaatactacataataaaacaatttacagaaaagaattaaatgttagaagtacatttttagaaagcttccaaaaccaatgtgtgtgggttttttttttttttttttcccattttggagccaaagaaataactctgatattctcagttctcacactttgccttccatatttgacctgctgcctatcacttgcatttttgcatagcagtcacatcagtcagtaataaacctgtatttattgagaactttagaagtacagatatcttggcgcaaattgctataagatcctgcctcatgaggtcagcatctgtgcttttttatgagcatttttccatccatctatctttctaacaagtatttattaagcacctaagatatgtcaagtattgggttagatgccagagagataatgatgggcaatataatgtgactgccaccatggagtttatagcctatctgggaagggtcacagttaaaggaataataatcataatttgtggctgggcgcagtggctcacgcctgcaatctcagcactttgggaggccaaggcaagcagatcacataaggccaggagttcaagagcagcatggtcaacatggcgaaaccctgtctctattaaaaatacaaaaattagctgggtgtgctggtgcaagtttctaatcccagctactagggaggctgaggaagtagaatggctcgaacccatggggcagaggttgtagtgagctgagatcacgccactgcactccagcctgggtgatagagcaggggaagaaagggtgtaaaacattaaaaaaattgttttcagaaaaacaatggctggtatgtagagaaaacaaggggcaaagcggtaagaaaaaagaccggagaggtgagcacaggctgggactattactgtttttctaagatccattctttgcccttggtcactcttctatgatcatttatagttttaataaatactggactgggtaactaacaacacatcctgaagtaataatacacaataaaactattattccattattcttaacacagacttctccttgtaacccagtgaatcatctgtaacaaaacccaaagcaactatatatctattccacaaggaaatttttagtttttttattaatagatgataggtcaggctttatgaccatatctgcatttgtgactgacatttcctttatgagatttattataatgaggacaaataatacaaaagcaatacatttaaaatcaataaaaaaggagaaaaatcataagtactcctttacctttcaggaaaagttaacccttagctattaatcacatagtttaaaaaacaatataggtttcaaagaaatataaggatctcaaaactatgattctgcattaatttattgtataaatgttttcatagaaaacatcaatatttaacagtgaaatgtatatattaatgcaatgtttgtttatgttcaggtacatttatatacatatttgcatgtgcatttatttctgtcaataggcagttacaggagcagtaataattagcttttattcttgtgggttaagtagaacaataatatctatctacttcatgttcacttcttgagacaaagaggcaattttttatttcagctcttttctttttgttggattctattaaagttgaggtagaataaaatacaattcaaaccagttttacatatctttaatgtgtaattgagagttttttgtttttagtcctaaatactttggctccatcacagtaagtccctatgggtagctgctaaattcttaaaccagaagcaattatatttcaggaaagagtcatttaaatgtttgtatctagcaccaaatgtatttttgtcttaataaattataaaatgtctttcctctcccttattttttctaagtccaccctttcttctctcttgactttggcatatgaacttgtacttgtagccaaacacatcagttgagctgggagtattatcttaaacagctggaagggaatgatgaagatgcttggccagcccatcacccagccagccttcctctgtttcctccccacccaagttctagattttggcttcacccaatccaaccagcctcttctaattaactcttccatactcagttgtctaaagcgatatggcaaaacttactgccagtcctattttggattagtttgtagaatatttgtgtctttacaagtcatacctttacaacagctcttgttatatgaatattctacaaattaactcccatcacctatgtctgctgagcattggaatattagttggactgtcaagatgccatagaggagacaggtggtttctatggagaaaagcagctagctgccagaggtccagctccaactgtagcccccccttcctaaaataaccttgtcaccaggattgaggctttctatatgccagattgtaggttgaggcacccacagtttcaacaagactacttagctatggtagcttcatcagtaactttcagatacacattttgtttcattttcatgggaatgcaacaatattaaccccacagaaagaaatggatgctcagagcattaactgatttgttcaagtcacgcaaccagtacacggcagaggtgggaccaaaacacaggacttctgagtgcctgtgtgtcatgtactccaaaacagcaaagtctttggcaatgtctctcaaaaattctcagactgtatctgcataaaatcgctgtgggtgatttttaaaatgcacgttcctggatgcagtcaagacctaagaattacattctctgagagtggggccaagaatctgcattttaatgaggtccctaggtaattttcattcatagtagagttacagaaaggctaagtcttttcttctattcctaaactttggagtatccgtttttcatcagaaatgcttctgggatctttaaattaattgcctgggttgtcttaggaacaagtcaaatacttatataatattttctacatcctaggtcttgttaattgattaaattctcacaacaaccttacaaggtagataatagtattacaatactcatgttatagataaggagacttaggcacagaaaagctaaagggacttccctcaaattacacacaagatgtgatcctgggccatctggctccagagtccatttgtcaaccactacactatgctagtgctacagcttcaaacaaagaatcacagtcactgaaaagtgctggagagcaactgctcgtggaaatctttgctctgagcttcatggaacagatcagagttcctccaggatgtcctgctccatactccaatgccttcacagctgttctccctgctaacatgccatgtatgccctcctaatctgacaaaacctggacacttcctggatgtccagagtgagcctgatgtccctcatttttgttcccagggcctagtgcacacaagcctcctggcactaattatactaacctatacctgcaaatctaagcctattttccacaggaaactagaacttcctaagggtagatattgagccttatttattttctgccctaagtatctagcagtcagcgggaactccatagatgcttgtggaataagtgaatggtggaatatacagtaaagaatggttattccctttataacagaatttaccaaaagtttctgaatccctgtgttcattgacatatcattaatgtcttgacagaaagcctaaaggactgaaaggtaaagccactgccaactggagatcaatccagtatcagataaaacatctttgaagtcatgatgtaagtcagtgggaaagcttctacgggatctaaaaatgtgaattagacacagcttttcaaggacactcctgttgcacaaaagggagtgtacacgttagagaaggtttgcctcagtgctatcaacatgtaagcagatggggacatgaaacagcttgtgaattcagtccttttctctccagctggcagaagcaaggattttgagaactctgctctcctgtctactgaaggatcatgtttccctgctctgcaatgaccatcaaagccatctgggaaaaacaaaattcttttgcacaagaacatagggagcaacagggaagaacaaagctgcagtactttggttctttggctcccgcttctggaaaactctagttggtattttatctagcttgttctctcagtggtgtagtaaatcaaacaggatagttgcaaaatgttctacagtgttggggaagaagaatttcttacatgcctagaaagccaccagggttgtaaattaaattcctcaaacaaagcagccccaaacacacagaatattagcttccccattttgtgtagttttctaagctcttgagattgtgtacatgttaaacacattcactgccattttcttccttgaaaaagattttgagttttctgtcacatcaaagaatgtatatcaaagaaatacaaaatggaatttgtgattagtagaaacagagcatattaatttttccttctaaacaataccctaagatgaaaacaggctaaagccattatgctaatccagtgatggaaggcacagattaccacacaaataaacaatgtgtgttacagaatacagactagagtgtgcctcacaattatattttatggtggaatatatgtttacggagcttttggcctggtcatttaagaaaaatgtccttaggctgggtgtggtggctgaagcctgtaatcccagcactttgggaggccgaggcgggtggatcaccttgaggtcaggagttcaagaccagcctggccaacatggtgaaacccggtctctactaaaaatacaaaaattagctgggcgtggtggtaggtgcctgtaaccccagctatttgggaagctgaggcagaagaatcacttgaacctagcagttggaggttgcaatgagcccagatcgcgccattgcactccagcctgggcaacaagagtgaaaccctgtctcataaaaaatgcccttaagtttgtaggtctctacaagtttcatgtgaaatatggagttctgtgaaagccatatctcatggaataaatcccaatcaatgtctttgaccagaagttcaggagtgagtgccctctgcctatggtcacaggtttaatcaactccagtatgggccagttatctctgctactatggtctgaatgtgtgtgtctccccaaaattcatatgttgaaatcctaacctccaaggtgatgttattcagtggtgcgggcctttgggaggtgactacatcactagaatgggattagtgctcttatgaaagaagcccaaaagagaaccctcattccttccaccatgcaaggacacaactagaagctgccatctatgaacaacaaagttggccttatctagacattaaatctgctggcaccttgatcttgaactgtggaaaattcagttgttcataagccacatggtttatggtattttgttatagcagcctgaacagactaagatgtctgctctgcccaacagtcaaagaatgtactattatttccttttaacatggatcctatgggacaattaggcaggaaacatagatgcttgttcaaagaaacagcatccccaaaacaaaaccaatctaagaagtgcattcctcatgaagaagaatttatcaaccatattaacatgttgttctctcttttaaactcctattttttgcttctttttattcagttcattctcaggaagtgtgttgtgagaacagatctaagccaatgtaatcatcaatattatcaatattaggttccttctggtaggtgagatacgtgggtctcctctcccataccttactaccaaatttgtcatacgttcaaatgtctattagcaagcagacacagcacaggtaatcagttccatgataattcactgtctctgttcttttcagtgccccccagcagtttgcatcaagagctcaggggaggcagatgcgttgatgttctagtgcaatactcagcattattttagttactatagaacaatcctgcaagcagaatggtctaggctataaacctacagtgatattagaaaggtgaccagatttccagacttgtatcactagattcccaaattttgttcatgcaatagtacagaatccacaaatcttaaactccatttaaccattgtaaaaaaaaatacatttctaagtcttctttgttgatcagatatgttgataattgaaatgtttatggtaactacctcatgcatctttgaaatactaaacactctgaattgaatatcctcaattaggtgcttcagatattggtttaccatctctgagagatagaataattcatgtgtaatacacacactccacagtgtccacatggaagaatttaaaagtaaattacagaaagtaaaaacaagtggaacctctatttttaacattctttcattaaattcagcatcaaaatgagtgattccaggaagtacatgacaaaactctccccacccatgtcaagagtccttagcaaatcttgtttcctttctacagtatgtgaaagcctggggatccagagagcatggatagagaacaacaacaacaaccctgagcattagttccaggtaggcaaataaccatacaagtccatttagtttggaatttttgtgctaaagtttccctaagaggtattgtcagaccaactgagatacatattagttcttcctcagacaagtgcaacaggttcaattcggttgagttaaataacattatggaatacatgcttgtgtttctcccaatctcaccatcaaccttatatgccagctttgaactattggcttacaggactgcattaatcacatgcctgcttaaaaaaagtatttgcctactaataagaaacaaattctttagcctaaaaacaaaacttcaacctacctctatagcctggttggcgactgctttgaccatttcttcccattccattgagaatgtcagtgtgagctagtctcaataaccaaaatgacttttcacacctctccaaggatccacccttagctagctctgaggatgtggtaaattaatctgtctcaccacagcacgtggcagaaagcttatactggatgttggtctggcagccagacaaactgggccacccaaagaccaggagaccccagaccccaggagtaggcctgaggtagacaaagtagctagtcagcaagagaaggcagcaccaagcaaagaaagtccaaggaactctgaatcccctgcgatcctctctgacttaccccgtgaagcctgaaatgtcttgtgccataagcaaccttcttggcagtcccagactcatattcaaagccctcgtcaagtttcctctgctctctatgcccttgatttagactgcagaattggtctggacttgcagtgggtttagtgtccctcccaggtccccagtgacatgtattacatctccctccttgaatgctttaccttgctttttaagtatttactaacgtaactgactcctcactgggctatacatttcctaaatgagcctgggccccattcatcttagtgttcccagaacctagcaaagtgcttagctcatagtaaatgcttttaaaaatgttcatcaaataagtgaataaataagtgcactctagtttagaaatgtaacagcacttcctcattactgcatagcttgttgatctagattctcattatcatgaccctggatagtacccattctcaaactcttccatagtggatcagaagcaagcccttgagccccttccccaacaaactttactggaatgtacttcattatccctggttttcattatccttggtaagtacaacagtcaatctgcacacacacacggtatcttgatgttttaattatcttactaataaattccctgaagtaaaaggcatgtttgtttgtttttcaattttatgacaatgttttatttaaattcttaaaaactctccggtatcactaataaataccatatgcaagaaactaggctagctgggtggggcccaaaaatgatatgatatcatctttcttttcacagatctttttatctacatggggaacaggatatagacccatgaactgaatcaccatcacacgaaccatgcagacagaggattagggaggctttgccggggggcggccactggtcaggtagagatggcatgtgaggatttgaaaagaaagtggtactgagacagaagacataatttaagcacttaaggtcaggaaagtggcagcaagcaagtctaggctctaaaatgctttgcagcaaccccagcagtgagcaagaagaggccgggatcaggcccagtggaaaggctgggtcgaaacaggctctatttaagatcagtggtggtcacccaccatatccaaacaatatgattcttccaacttagctaagggaagggagtaagggaagcagggagggaatgagggaagctcttagtgtaattacttgtagaaatttggtaatatatgtacactatgcaggaaacaatggtttttccttaatatagcaatgcatgaggacatatcactatttttcaaacaaaacccagaacagcatactcaaccctactctcttatttggagctgtgtgaaaaagtaaacttaacttttgtccagaccttctgaataaggtaaactgactcatgtctagaaacaggtttttttctatagtaagagaataattaaattttatattttatgaatatattattaaaaacaccaatcaataaactccaaaggatgagttcaagtttagaccaatgagatagccaccataagatgtatctgggtacaacccgatgtgatgacacatattgtgcagggtactataggcccctagagagcagcagccagtattatccaaagactgatatcagaggctcatgtcaggctgcttaacaaccactgagctgggctgggtattcccgctctcatcaagggggactgtgtccaaatcccacataaggagggctgcaaagtctcccctataccttagacagactgcacacaagtcaagtcctttgatgccaaagtaattttgttactgagccctataagaccactctcatgtccttccccctaaaaagtaagagatataaaatatactttgccctggaaggtccttgcttggagtgaatgtaaatagaaggctttgagtgcaaagacctactgaaaatataaatgttctaataatgatttatttgtaagcctaactcttctactggactgggagctccctgaggtctggtctgaatggtgtctccaaggcttcattcagtgctcagtggacggtgtaggctcagtacatgcttttttgagtatacaaaaaataaatgctacaaggcaggagagtggccctaaatgaaaatttgagttttaaagttgctatggcatataagtacttaagagacactgcagaaactgtatagaatcatgtatagaatcatgaatagaatcaatcctacatgtataacaatttatttgtagacaagatcataggagcagcattgtggatatcaaggtgggctcactttctaatgtcagaggctggtgctcattggagtgtgcctctcagtcacatctagttcttgaaatctgaggaaaaactctatttaaaagtagagagactgaaaaaaatgagtcttggattagctagattcagataattcaatatttttactactaaaccacagagatctagattactagggaacagaaattgccttgaattaaataccactctgggtaagctagtattggcttaatgagctttttgtgtactgggcttaataaaaaattgtattagtcattttatacaaatatagtggagctgatgaattactcataataaagaaaaataacccctaatccattttaataattcccatatttcaaaatacagaaatttgtcctcaagcacacagaatcctagatgataatacaggcccagagaaatgaagtgagttgctaaagtcacataactaattaatgaaggagataagattggaaccaaggtctcgcaacgccttgtctggcacacttctaccacatcagtgatttccaaacagtgccctgtagaagcccttcgaggatcctgggacagcaggtgagggggcctggcaggcacagttcccctctttgcatcatgctgtcttttcatgcagacccttgtgctttagtgcactggtacccagatttgtggatttcatgctactgtaaaaaaataaagaatgactacatacaattactatcatgtcataaaagaagggatattttaaaactcaaaacatttggaggagagaatcttggaataaatagaaattatttataaaacacagcatggttccacatttttctcatttcactaagaataacaggaaaaaatcctcaatgtggaaagtcactgttctgtagaccttcatttgggaagcagtggttttgtggcaagaacatagaatttggatttcaaccacatcacagtagcagtgcatcttgaatgactcattttaatttctaagttttgtttcttatgtataaagttcaatagtaattcctgacacacaccacagtccctcactcccatcctctgcaagagttgctcctttcaaagatatctacttctgttattctcaaaaggtgggctcaggactacttgcatcagaataatctgaggtgcatattaaaaacccaagttccttgaacctaacccagatgaggtttccaagaaatggggttggttttaagtggtttagtttagaaggcacaaagcctgagttgttattttttaatgatagtttacaacatctgctctaattaccagaggctgatggtaagattatgcagataaaattcctttggaaaactgcagcaactataaaaatagaaaacagagaataagggaaaggaagacaagaataaggactaaagagaagatgcgaggagggcaaaccatttattcttaaattagttttcttacctgatgaacaaggactgtgaacgggatcaatgactttttaaccaccccattagcagctaaactattttcaaagaaaatcttttaaggaaataaatcttttaagaaagcaatgtcttctgacaaaggcagagttgctctagtagaagtggcccagagttctgtcccgtcaatgccctatctcattccctccatcctcctggtagcctctgaggccccctatgctagaagataatagaatgacctgcttgctctctgaggtattgttctgattccagagaaggtaggtctaaccattaactaatgctatgtattttaatataatcaacacagaaaatgtagccacccaatcaccagattctccctgaaaagtgattcacgtgcaggacatcttaagcagcatggcacaccacaaacatgatcaataagaaggtaccacacttaattttttagtccattactgttcttcacctaacacagaggttctcaccaagtaatctgctccctttctttcctcaccggacccatggaatctgttgcttcctttccatcctccatggctacagccatcgtacaagtttcaggaaggccacccaaccaccttcttcacatcatcctagccttcagacccctttagtccatctaatatcttcttgccaactcattgtcttgatagtgacatctgaaaacaagttctcaccccatggtcttcatagagacaattccaactcattaaccccagacactcacatttcttagctcctctcattaaaaagcacactggtctaggggtctttttgagtcatcagggtccaagctcctgctccacacctcacacacgtgttcctctccaggctcctatctcaggagatgacagattccaccactcaccaaggtgttgagatcaaatccttatagtcactcttgacatgtttacttctctcaaatccccatcctacccacatgtatgaaacaaggcccctcctcacgccctccaccctggccaccatcatgcctccctggcttgctctctgctcccatcttcttctacttttcttcttgctcagctcactctgctccagctccctagccttcttgctgtcctccaatacaccaagcacattccagtttctgggcctttgtacatgcctgttcctctgcctggaatgctcttccccaagatgtctgcatggatatagccctcttttcattgaggttctgcttcaatatcactgcttcagagaggtcttccctaagcaccttatttcaaagagtgcttctacaactctatctttaccctgcttaatttttcttcataacatcaccacctgaaattcaattatatatgcatcagttgacacatttattatctgattccactctcatttgttgtggagcagcatgaagtctgagtggtaactttgtttctgacccagtgtcaccgatgtctagaatgatatagggcactctgaaggttttcaataagtcaatcactcaattaaacaaaaatctaactcatctttaaatccctcattttatcaactactccttcacatttaatattaaataatgtatatttttaaattttttaaattgtggtaaaacacacttaacaaaatttaccatcttaaccatttttaaatgtaccgtgcagtagcagtcattgcattcacattgtgcaagcatcatcaccatccatccacggaactctcttcatcttgcaaaatggaaactccacatccatgagacaataactccccattcttccttctctagcccctggcaaccaccattctactttctgtctctatgaatgtgactactctaggtacttcatataaatggaatcctataaactacaaatcattatatgcaaaacttgaataattctctttaaaccttgcatcaactcaattcaatttttgactggcttatttcacttaacataatattctcaaggttcatccatgttggttctttggcctatattcccaaaagtagaactgctggatcatatggcaattctatttttgtttttttgaggaactgtcctaccgtttcccacagcagctgcatcattttgcattcctattaacaatgcacaagggttccaatttctgtacatcctaaccaacacttatttggttttttttgatagtagtcatcctaacaggtgtgaaatggtatctccatgtggttttgatttgcatttccctagtcattagtgatgctgagtatctttccttgtgcttattagccatttgtatatcttctttggagaaatgtcttttccagtcctttgcccattttttaatcaggctgcttgggtttttgttgttgttgggttgtagaggtttttagatattctgggtattaaccccttatcaaatatatgatttgcaaatattttctcccatccagtggggttactaaataatttatattcttcattttttaagttggttggttctcttaatctatccataacggtttctactttggacagtgtactcacagagaacagagatggtgcctgttgatttgatccatgcaatgcttaacaaacaatgctctatgcaggctggatggttaaagttttttgaagattatacaacaatatagtgtactatttggtatcacttttctttcaatagtggcagacaaatggaagtacaactgttaattaaaagcacataatgttgcctgattatgagtaaaatgtcccagctcactacagcacaattcctacagcattagtggagaattaactagctttattaaagatttggaggactagtcactttttcatcatcctttaattaaaacctccacatcttccacttaaaagcctttgtttcgtacccattattttcattctttattctggccttgaaaaaccaggatgaaaaacagtaaaagcaaaaacgtttctaaatgagcttttcatgctgtaataataaaaaggcatagctttctaaaatactgaaaaaaaataaaattttaatgttctttgaactagaaggccaggaaaagaaacagagaaaagcagtgtttagcagaacattttggagttcaatgttcttttatattctaaaatgaattaatgctactatataatttctctctaccttcccactcacactaactgaaagataccacagttgaggggtaccagttcaaggtcctaaagtggaaagctattgttatactctagcctactttacttttttcttaacttggaatcattatttattttgaagtaaatggcatgatgcagtggtttgaatgtgccccctccaaaattcaggtattgaaacttaatggccaatgtgataggattaagaggtgacatggtcatacgggcttgttcctcatgaatgggattacggcccatatgaaacaggcattacacagcattcggccctcttgcccttctgccgtgtgaagacacagcattcctcccctctggaggatgcagaaacaatgcactctattggaagcagagtgcagccctacagacatcaaacttgccagagccttgttcttgaaattcccaacctccagaactgtgagaaatgaatttatgttcttcataaattacccagtttcaggtattttgttacagcaacactaatgaactaagacacacggcaagacagaacctccctcaacctcagctccctcctcccgaagatccacgcataagggtgcccagcacagaccctcacaaatatcagacacttaataataaattaataatttaaaaaccattagctagaatttggtggatgttctgggccaaacctcatactgtgtgcttcatattcacaatgtcacaacaactacataggcagctgtggtcacttgatgaccactatacaatgttacacttaactgcatatttctccccataacttgcccaacccaagttacagactttctctcccctaaaaatactagaatatgctacttagggaaaggagaacttgattttttaaaaaatatattgattttggagcctacatttctaaatctttgtatacagtttatagagttcattacatagctaatttcagctcagctgagaagaaatctaaaaataatatgctttttggtttcgtcactgaaacattcattctgtcattgaatttagcctgatgcatcttacaagaagaaaaatctgatataatgtgtgtggaaaagaatttgactgatggaaaggaataaaagtgagccagtgcaatgtctataccagaattattatttgtatgattaaaacataaagacacctgaatttatcttttctgcttctgctgtttcagtctcattaagactatgtttctgctttcttctaaatattgttttccatatttcaaacatctaattaagtaaacacaatacaaagtgagatgatatactgtttggaaaaccataaaattatagagtagatagacttccattataatccaattttcattctgtcataattttccaagagagtttcctttggggttaaaattttctaagcttgatttcagttcaaaattgaatgttttcattcacttgtatgtagaaaagactcaattcagtcttttctgttgatcatatgagtgtgtttcctttaaaagtagacaaggcttaattttgttgatgaaacctatgacagacttctagacccaccttactttcaacttcttgggcacttaaaataattacttaagtaatataaagggtacagaagccaacagagaatatgtttctttgccttagtcctccagtcctaccctatgtacaacgtgcccccagcatataccctttgtatacataggactgttgtcttaccacagaaactaagaactagaattgttggatcaaaaggaatgcactttttaaatagtaatatatgctgcccaactatcttccaaaaagccttcactacattattataatctcaccaaaagcacatagatgagaatacctattgcctatatttattaacactgaatgttattgatctattgaataaaaagttatcttaatataaaatttcaaaattatgagtattttattgtccatttaaaaaattgtatctcttatcttgcctttgaatatttatttttcattttgctgcagtagagctgtaagttattctttcatagaaggttttgtacctctaaaagtattttgcctttatgtttgagaatcctaggttcaaaaagttttccacgagaattttaaagtcttgtgcttcactgtattacagaatccagggcggccaaaaagaagtccactaacagaatcctctttctttcttaggtagattttttaatatataggttatttgtctttcatcatgctgggaaagtgattgacccacttaatctgaaggcacaaatctgtcttcgatttagagaaattatcttatttatttgataattgccttgtattttgagaggactgcttcaatttctcaagtaataatattaataatgataacagaagctaatatacgttaaacgtttctgcttgttttaaatattttacatgtattaggtcatttaatcctcatagaaaccgtgttacagtagcccctccatccttagtttcacttttttgcgctttagttacccacagtcaaccacagtctgaaagtattattgcatgctgttctgagtagcatgatgaaatcttgcaccgttccacccaatatgtgaatcctcctttcgtccagaggatccttgctgtaggcactcattcccagttagtcacttagtagccctctcagttgctaaatcaactgtccttgtatctcagtgctactgttaaagtaacccttatttgacttactaatgggcccaaagcacaaggtagtgatgctggcaatttggagatgccaaagagaaactagacagtgcttcctttaagtgaaaaagtgaaagttcttaatatggaaagaaaaatcatatgctgaggttgctaagatctatgctaagaatctgtttgtcaaattataaagaaggaaaaagaaatttgtgctagttttgctgtcacatctcttcaaactgcaaaagttatggcctcagtgtgtgataagtgcttacttaagatacaaaaggcattaaatttgtgtgtggacgacatgtacagaaatgagttccaattgacagcaattgggtttggtactgtccgtggctttaggcatccactgggagtctcagaacacatccccttggttaagggggcactactgtattcccattttacagatgaagacatcgacagaagctaagtaactttcctaaatgatactattagaagcagaagtgccaagtttactcctaggccaactgtctctaggccccaattatataagccaataactaaaaattgtttgcacagctattaaaacaacaaactatgaatgcagctgtcacactaacctgtccaatccaggtagtctgagtttaaatgccaagaatgcctctgactcaagatccttctgaatcagtgactaaagtcagatgactctcctgtgtacatatgctgtttcaatactcatctaatattttatgttgcctgtgagtgaaggttaccttggagagaaggggaagcaactaaacaaagcatccaatgttcatagtatttcaaacaatacctatcaactttcataaatggtcttattcaatggagatagcaagtttgacattgatattgttaagaactaaagtatatgatcagagcagacaatgtatttacaggatttatttcctgatagaaggagtagaatttttccaaaagaatcagagctgtacaaaggaaaggtgcttccatccaattatttcctacttgtcatctctgataggaacccacctgggggtgatctgcagagtctacctgtgttaaatttcttcacatagagctagctcatcatgcaagtggtactaagaaatgaaaattatatggcttagaaaatggtttagcagaatgccaacaagcagaactatctcatgtgcagatattatgcaaccccaggatttgaaaatagttacctttacccactagtcccatgctgtgtgtagaataaaccaggttgagaatgatcaaaagttaacagattatagcaacaatatagttatagcaacaattgtataaaacaaaactgtgtctaaattgaaagtacctctggctacttttaaatcttcaagaacaggaatttgccaaatcattaaaatcaaattagcataattaaggatctaaaattgttagagtattaatgtgattacatttatttaaacccagttaatgaaaaattactgttacacccttttaagaaaaaaattacattaaattatatcattgggtaccatttagattagccagttaatctcaatataaccaaaatctgtatcagtaataggagtgttagtaatttatatataattagaatgaaagctttttggccataaacaatctggggaagtccttataaaataataagtgggaaaacaaattgtcctactctataaaagacattatgcaaaatataatacaaaaaaactaaaataatataatacttttttttacaagaagtaaataatactttttttttacaagaagtaaaaatagtattattagggtaacagtactgtaggaggttttatactttccttaaatttttaatttaaaaagttttaatctacaatgaactcaaacaaatttacaagaaaaaaacaaacaaccccattgaaaagtgggtgaaggatatgaatagacacttctcaaaagaagacatttatgcagccaaaaacacatgaaaaaatgctcatcatcactggccatcagagaaatgcaaatcaaaaccacaatgagacaccatctcacaccagttagaatggtgatcattaaaaagtcaggaaacaacaggtgctggagagcatgtggagaaataggaacacttttacactgttggtgggactgtaaactagttcaaccattgtggaagtcagtgtggcaattcctcagggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccaacaacgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaacccaacaccgcatgttctcactcataggtgggaattgaacaatgagaacacacagacacaagaaggggaacatcacacactggggcctgttgtggggtgaggggaggggggagggatagcattaggagatatacctaatgctaaatgacgagttaatgggtgcagcacaccaacattgcacatgtatacatatgtagcaaacctgcacgttgtgcacatgtaccctaaaacttaaagtataataaaataaaatttaaaaaaagaaagttaaaaaagttttaatttttaacatgttaaagactgaataaatagctctgttaaaataaagaaaaagaagaaaataaaatggtattattttctatccagtttaacattttggtatatacttttccagtttttctctttattattcatatttttaatttaaaatctgtaactcttaaactataatgttaataacaattctgttcctttgtcacttaacaatgcactgtggactttttttacattttaaaatgttcttctatgacagtggttctcaaagtatggtccacagaaccctagatgtccctgatagatccttttttatggtctgggaggctaagtctattttcataatactaaaatgttttttgccttttttactgtgttgacatttgcaccgatggggcaaaagcaatggttggtaaaactgctataagattcaaaagaaacaaggcagattttgattgttgatgtagtatcaaagaacaatatccaaagttatctgaagaaattattaaaacactcctctatttacaactacttatatttctgaggctggattttctccattttcctcactgaagcatcgtaacaggttgaatagtaatgcagctacgaggatccaaatgtcttccatcaagccagagtaagacactaaaaagatctgcaaaaatgtgaaaggatactaaccttcttgttatatgttttgttttcaaaaatatatttttaaagagtatcttatgttaaacaatgtgttttatttttaaatgtgtaaatatatatacaaatatattaaatatatatattaaaattttctattttcatttctaatacagtattgatggatataaccacatgaacaaaagctttttgaagccccaaataatttttacgagtattaagaagtactgagaaaaagtctgagacgtgcagtttataacagcacttttacagaaagcacagtgatctttttcatggacatgccttaatttatttagccctggaatatacatacatttcttgaaaacgaggactactacgtaaatcctaaagggcctggtgagaaatgtgcacccggtgagtaatgacctgattttggagccacagttcatggtcatcatatcttcccccaggaggagggctgattgaagaagaggatctaggactagataaagccccctcagctatgggtgcctacattcattctcctgctgagtttttttctcccttctcaatattttgtgtcatttttctaggatttccacagaaaaacactgaaagaagttggaatacaatttatttcaataaatcgagtattttcctttagctctcatgaagtctctgatatattttttccatttctgattggcattctatcaggtagagtcctgggtacatgagttttgtcacccaactaccttcctgtcctcactacctctgagtccatcactggtgatgcacacggcccttaatgacatggcccagtttatacgttttctaactctagacttcttaaatcagattacttacactaattaatttttaaaattagtttagaaattaaaaaacatctgcccagagtttgaaagcatacaaattctataaaatgccattctctcatgccttatattacttaacaaattaaatatatacagagttagcctcattaaactcgaatggtctctgggagacctacctaagtaactctgaagcagactatattccctaaaatgtattctgaagtactgaggaattttcattgttatggaggcgtttgagcacccattttttagtaggccaggatatccttgccagaatgctaaagagagtagaactaaatgacagtacagccatgtaaggttctcaaactgtgaacattgatgctgtttattccgtaatttagtgtaaaatgagtgtgggaatctttattagtgattttcaagtgcaaaagttgaatttgtcctccaaaaatttgcactggcttttactgttgtaaaccaagccacagcctccttaatccaacataccctttccgttgtatgagtccaaccacaaacacactttagatcctcaagaaataatttctcaagaaaacatagtggagtaagtagcaacccacttgggtccttaaccaggctcctctgggcctaggataactgcacctgggctacaggcttgtgttctgaagaacaggctcagtgttgctggcaactgctgagttaaaatttccaaccaccacactcctcgtccacagccctgatgtctacccctttcctctcccagaatagttcagtgatttccacaccaggtacagagtctgatcagtttccagggataatattttaccttctctcactcctatgaaaaaaggaaaaaaaacaactgttcgctaccccatcccttaactcctagagggtaaagacaataatgctatcacagactgaagacggtaggtgtacctaggctaggtcttctagggattgtggaaaatgatgcttttagtctctttgcaaattacaatattccaagatgaccacagtaggaatgggtgctcctaaagcgcagatgcctaaggtggtctcttcagtccagtatttgtcaactggcaacaattttgctctccaggagacatgtggcaatttctggagacatttttggctatcacaatggggctggggggtgttgccactagcaactagtaagcagaagttaggggtgctgctaaatacccacaatgctcaggacagaccccaaaacaaggtattatttagcccaaaatgacaacaggttaagaaatcctgtcccagtctgatgtcaaatgcatgcttctggatccatggatttaaatgaaaatattgcttacattacttgatagttcattcaattatttgcattcatgtacagttttcattatcagagatctgagcctggctctaacatctactagttgtgtgacctttagcaaggagcttaaacactccacacctgatctatgaatagggaaaataactcctccacacaattgtcatagagattacactacagagtacatataaagtgcttagtgagtagaggttagctgctgctgctatcattatcatcatcattatcatgaaagacttaataactactaggtgcctgacactatgtttagaaatacaaacacattttcttatattctgaaaatacaagaaagaataaagacttagaacctatcactaaagaactcacagaaacacctagctgagcaaaaacatatgagaagacctatctgactatgtagcaagatccatcttttcatttgcctctagcatcccaggaagcaatgcttggccctcttgggtcttcttataccctgccttccagtacctctccccccatcgttaactcaatacactgtagtacttcaggcactttgtagcaaagagttactctcacaaaaagagaaaatagcaagctagtgaatgacttctcgtggacctcagaaaggacctcagaaatcttcaccaagttcacgattcaggtgttaaaagtttcagcccatgagcagcacacggtcagcacatatcatcaggctacttgctccccatggtatttttgggatttgtcaggtagaaactcttaatttagaagaactaagcatctttcaaggaaaaaaaaatccctgctaaaatattattcataatttattttccttattgtatcaagtgacttttacttatccttcttatatcacctgatacagttccactccttgttctgtgcaggaaagttttaatttgcacatacacattataatttgtaactgtaagaatgactgcagcgtcacattcactagaataatggcctgtagcataaataaataggggtcataagggaagtatatgccttaggagaatatcctttaagctgtgcagttcagaaatgaggttctgtcttgcaccgttctacacattcagcggcaggaaaaattacttggaaggtaaaagccctattaaatgccatctttttttgttgatttggattaaacccaaatgattatttttaagttaatgtaaaaacactgtggaaaaatgaatcatgttttaattgctataatgctgcatcatttacttaaactagaaatgattggtgaatctggtttggtggtatgtcccaaacaagccaattagtacagagattaacctctataatcactctctagccgattgctttccataattttttcataaaatttgtttgcattcatgtttttgaatgaagcaggtaactagccttgcattttagaattttagtcctgtttcatagaaaagtttacaatatttgctttggagaaatttattgctgatttacttgcatgtaatacaaaaatcccatactttgctgagaggcttcaaaccataaaaggacacaagataattactttttggactatttaggaagcagggagtttcacttaaaaaaaaaaactccatggtttctcaactctataaatgcttctttaagaaaaatatacattccaaaccagaatgataaaggaggcacagaagtgtctgcatgacagccttcttccttcaaaatacatcaccaccttccataacatctgctctatcattttggtcactcacaaccttatatgctcagaaagaaatatttgtaagatctaatgtaaaaagtgcccagctgttcacccttatgctggggcagtcctagtggtatatttgtcctgtatctaaatggatgctctatttgtatctgtctctatcaaatgtatcagatacatatggaggatataaggtggattatctttagaccaatttacataaaaaaccaaggagcttcctcagatggaatggaagaaaatggagtgccaaggaaacaatctgcttctaggacaagacacaatgatgtcagaaaaatgaagtaatggtgaaaaaaccacacataggtaaagtctttgaatactgagagactggttcagtgggcactcatgaatcctgggcagagaaactgcaataaatgcagagctaataattcagaatggtttatctgaaatctcagtggggcactagaaaggcatgacgttggcactcatccactgatgggagataatactcattactgagctacacataactgccactagatatggggctctgtcaccatggacgggttatcagttgaagtcacaactcccagctaccaatgacaagtgaaggcacagcaactggaaaccttcccagggtagaaggggaataacttgctggtgattagtggtaaataagaggcctcattcacagaatgtatgtgagacactcactggagtctccagagctatttgggaggaatctgagtgagcaagctgaagccaaagaaatgctgttttgtaactgttactgtgatttgtttttatccccaggatgaagtggcttgggaaatacaggaaacttgcagaagtaatgatgactgcgataatagctactttattttctatgtagttctctgcattgtttctgtgaagtaagacaactatatcaaaatatttcactgaaaattaataagctctcaagtgaaattataaaagatcttgtgatgtgagacacactatccaaaagtactgaaccaggtggaggaaactgctgaaaatcaatgtctcctctattttctcacgatataccacagacagagaacattacctagcttattactgattggaactaaggagtagaaaaagcactatctgatttccctggagtctcagggttgtatggggcaccccctgcatctgcccagccttctacccgggaggaacactcctcaaacatacctggaggcagaagacatcctacagggtacttagcctctgtcctgcaaccacacaatagtcctgcctctcagtgaactggcctttcctgggctaaggacccagcctctccagatctatgactgtcacagtgctcttagcgctagctgatctccctcagcctgtaccagggttcaacccatctgatcaggctgcctctgagcctagccctcctgccaggtgtgtgcacgctgatatagccactctctcaggtaatgcctaacttaacatcatgatatatttaatcctcccataaaatatttccttcatttctcttttatttcatcattttttaaaaaaccatagagaagatgagaaactaaatgtggaatggtatgtcacaggtctgaataaggctagaatgaccctaacgtgacacattttagattgtagacttggggtacacatatataaattattgtagactttggggtgggttaaataacattcagattaggaaaacttcctttcattgcttttatactaaaaattactgtatgaattaatgttgaattttaataaatactttatcatcatataatgaggtaatcatgtgctttttcttctttataaaattagtatgaaaaattacattgagtcaatcttgtgcccctggtttaattccaatttgctcatgtattaactatttaatatattacttgctaatgttttcatcaggattttgtacttatttgacataaagttgttaatatcctcttattatatttctaatgtctgcaaggaactataatgatgtcctcctcttttttcattcttaccacctggctatagttttagtctcttctttttccttgtttgaggttgaaaatgttaatagacttctcaagaaaacatttgcctttcctccccgcccctgcccttttggagacggggtctcactctcattcacactggagtgcagtggtgtgatcacagctcactgcagcctcaaactcctgggctcaagcaatcctctcacatcagactctcaagcagctgggactataggtgtatgtcatcatgcccagctaattttttcatttttcaaggatggtggtctcgctatgatgcccagggtggtcttgaactcctggcctcaagtgatcttcctgcctcggcctccatagtcactgggattacaggcatgaaccacaacacctggctcttggctttgatgatgatttctgctgtacatttatttcttgtttttgtttctaaattttcattattttctgctctcctcgttactttccttcttcctactttgctttagtttattttccctttttctaagtttttgagatgaatgttgtttaatttttagtcttcctttgaacatatgcacttaaggctatacattttcctcaaagatggcattagttgcattttatatattttgatatgtcgacatttcaatatcattcaggtcaaaatattttctaatttccactgtgatttctcctttaacccagtatttatacagaactatgtttcctaatttttaaacatagaaatattcaagattttgctgttgttttcaggattattgttactgtcttgtagcttaaataaattatgatcaacttttaattatttataagttttcaatcctttgaaataattttagatttgctttttggctcacaagtttttttatatgttctatgtatactagaaaaaaatgattttctgcacttgtgtattcaatatctttatgtgcccataaagtttgtcatattatttaaactttctaaatgcttactaatgttttgtgtgtactctcaattcctgaaagagatatattgcaatgtcttactctctgaattttcctgtttctcctcttagttctgtcaatctttgatctaaatagtttatattattaactaaaactttgagattattttaacttccaggtgtattaaagctttcacacttgtaaaatatcctctttgtatctagtaatttttttttatttaaggtcttattagtgttagtgtagctaccatcaccctttgctaggtggagagcattagtatttacaacttatccattcttgtatattttgactttcaacctttttacacactcatattttagatatatctcttgaatgtagcattaagttggaccttatccagtcttacagtcttgtcctttaattgaaacattacatctattgacaatgaatacaattacaaacatattcgagtttaagtctaccatcttagcatctactcagctattctgaaccaagtatcagatctggttcagaaaaacataatttgtttttttccctaacactattcagcatcaacttcaaacatgtattatgaggattaaacacatttatatgagatttgtacaagtgctttgaaaatcacaatgtcctaaagccaacttcgtgttactaaatatgcttctattaaagattttccaaagatctctgatgcaggctctcgaatgcagtttcagacaagttgaaaaaaagaaaaaaaactaaaaacaagtattggcagcatgataagactcccaagatgacccttttaaaagaaagagggctcatgacctttggcatagaaaagtatgttggaaggctctcaggaggcaagggcttggtgagtttaaggaatggtaaagatgccagtgtggtgagaagtggtgagactggtgagatggctatgagctaggtcctgcagagctttgtggggttgttgactttgttagaaatgcacttcccagtatgtagtgcaatatcatggtcaggtttacattttcaattgtttattcagtcagctgtggccaaaactaattagaggaggcaagaatgtaggggagtggacaaggtaaccattcagtcttctaaaggaccccccctcaaaaaaggtggtgcctttaacttgagaaacagaagcagatagctttgagatgcctctgagggtggaatcaacagcacataagaatctcatgtggggaataagagacagggtgatgtcaaggatgatgttggtaattctaaatcaatcaacaggctgatgagaggtgtttgcagtaaatttatatctacagtaaataaagtctaatacttatagaccatttatcaaatctactgcatatcactgttgtcttatttctgttctttaatatttacaaatatcacaagcttatgaaaacctctcatagttccacactctccaaccttacacttcttccctctgtttttttttttttttttttttttttgctaaaaatgatttcagggaccagatgctgtggctcacacctgtaatcctagcattttgggaggccagggcagggggattggttgaggtcaggagtttgaggccagcctgggcaagacagtgagacctcatctctacaaaaacaatttaaaaactagccaggcatggtgacatgcacctgtagtcccagctactcagaagactaaggtgggaagatcacttagggccagcaattcgaggctgcagtgagctatgactgcaccactgtactccagcctgggcaaaagtgcgagagctgtttctaaaaaataagaaacaaaaacgatttccaataaaactgaacagtgcaccacatactatattattcttttcacaaaaggcacaatgaacctcagaggttcagaccaggttgacactgtctctaaaaaaattaaaacatgaaagtttcatcgtattgcattttcacaagaaaataaattgaaataggcagtccttgcaaaacacaatttgtttcttccctaacacaatactcgagtaccgctgctttcaaaagaagcatttctattatacaaccatcatgtttgtaattgaaataataatgtcaaatcattattgggcctgcattccatttaggttttcaagttctgagctctctccaaaataaaaagataaagtttctaatggaatcataagactgttgagtaactgaacatttttcttctttttctagttataaaagttatgtcaaaagaatccctccgaaaaaaagagaacggtttctgaacactagaaaagcttcactcactgtcgggggttccagaaaatcccctcagcaatcaatctgcagaacgtcaataacaaatgatacacttccctcaactgcaaaaacaaacagtagagatgccagaggtccctggaatttaaagcataagtgtcttcttcttttttttctttttttccgagatgaaatcttgctctgtcgttctggctggagtgcagtggcgtgatctcggctcactgcaacctctgtctctcaggttcaagctattctcaggcctcagcctcccaagaagctggggctacaggcacgtgccaccacagccccggctaattttttgtagagacagggtttcaccgtgttagccaggatgttctccatctcctgaccttgtgatccacccacctcagactcccaaagtgctgggattataggcttaagccactgtgcccggcctttttttttttttttttttctaatgagacagtctcactctgtcgcccaggctggagtgcagtgccacgatcttggctcactgcaacctctgcctcccaggctcaagcaattctcaggcctcagcctccggagtagctgggattacaggcacctgccaccacacctgcctaattttttgtattttagtagagatggggtttcaccgtgttgcccagggtagtctcaaactattgagctcaggcaatctgcctgcctcagcctcccaaagtgatgggattacaggcgtgagccacggtgccagccataagtgtcatcattcattcagactgctgtaatacaatactgtacactgggtggcttataaacaacagaaatcaatttctcacagttccagaggctgggaagtccaagattcaattcctagtgagggctcgcttcctggttcatagacggctgtctccttgctgagttctcacatggtggaagggagctctctagggcctcttttataaaggtacttgtctccttgatgagggctccggctacgtgacccaatcacctcccaaaggccctaccacctaataccatcatcttaggggtgaagatatcaacttatgaatttgcaggggacaaactttcagtctgtaagaacgagtatgcatgagggctgagaggaggggagtatgtatgttacacatggggacatggaatggggaagggtgtgaaggaaggtgaaggttgttctttcttctactgtttgttatagtgatgcttctcctggggttgagtggtaaaaagaggaaggaataaagagaggaggggaaaaattgggggatcagatagagccctgttttccaaacatcatgttttgagctattagtgaatggatcagaaacataaattgttttggtaagctagaacagaagctatcggaatatactgtatgtaatagaggtaacatttcatgaaatattttgtttcacatatagatgagtgttattgtgtgggtatatgtaaatttttgtgtgttgatttatcatataaaatgcttttcatattacggtttgtagtaaaaaatgagtcactgaactagagtatttaaggttccctgcccctgcttcccacagtacaggactgttatgttaaagacctgatgttcattttttacttgtgttttatgcctttagaacaaaatagtaagttttttctttatttctgttacccataatgatgcaaagaaaaaaaaacccttgcttctgacttttcagaaatcctgtcttattgttctcatttcatgccatgcattgatttcctgttaaatagttttcaaatctcaagccatactagatcactgagcttttaaagattatgaaaatcatctttctcttttatctcttttgtagatggtttttaaaactggcatgtgatgtggctttatttaaaaatacattcccatctacattattgtcttttttctttttcttttttttttttttttttttggatatgtagtctcactctgtctcccaggctggagtgcagcagcacgatcttggctcatggcaacctccgcctccagggttcaagcaattctcctgcctcagcctcctaagtagctgggattacaggcatgagtcaccacacctggctaatgttggccaggctagtctcaaactgacctcaagtgatctgcctgcattggcctcccaaagtgttgggattacaggcatgagccatcgcgcccagcctaagctactgtctaccagaaaaaaaagtacacagtgaatcagaatcactttcttgctgtataaacttggaaagttattcattctctctgagtgccagtttcttgggctgtaaattaaagctaatattatctccttatctagattgttgtaaggagtggagatgattcatgttaagtgcctgaccaaagttaggcactcactaaatgatattttgaattataataaaatgagaacccaagcacacaactatttcttagtaacctcatatataagcaggcctcttgttgtctactgccttgaagagcccatttaatctcctctcaccccaccaagggccaaaacatggcccgacacacagttgatgcttgataaaagttgacagaattgaattaaggggcggtgctgttgtgttttcctgatagagtacacttattgccaaaataattatagaaatcaagttttatgcccaaattagctcattaattttaggctgggagcataatcacaagagaaccgcctatctcccaaatgatccaactacaaagagaacaaaagtcaagcttcatccagtaagcgtcaccttacctggcagaggtttagcgcatctctctgctctgggaagaagccaataattgaaagcatctgctggtcaagacaagcagaacatttaggctgaagagggagtgatatttttgcttatctttaaaaggaaagaacgagttgataagagagaacagtggttttgctctgaaaccagcctgacaaactatattgaacacagaggtccgtacttattttctttcaaaaacttcctttcttctgctcccatttatacataaacaacacatatccctaaactccatccattgttttatcctcgaaattcttagccccaattggcctcactggcagcacatgctctcctgaccacacagctgcgtccaagggaggtaggggcacaaccttcaatggtatctctgctatctcaaaggaatttcagatatcattaaaacaatgtgtctgcgcctctaaataaaacaggccagtcatgtttcagtaaactgacagtcttctctaaaggaccccgaggtgtacgaagttactgagttttcccatcctaccatcttcaaagtgataaagaaaatgcaattgttatgcaactagcctttccagctgaccctagggtggcatttgctgtctactcttaaactacctcacaaaaatcatctttttgtaaagattctttgtttcctctctcatacatgcataagagaccccggggtggaggcagtgttaggatggggagggatggaccgggctcctgggaatggcctccatcagaggcctggtctgtgggccccagtcaccgtgaggggtcggtggggagtgtggagcttcccaggatcctgcctctctccctgttttctgccaagcagcaggaacacacaattcattaaagcaaagccaaaggtcatggactgagaaatagcaagaaacttccagggacttgttgattttggaaacttaatgtccacattgtgtaacagtgtgcatgttccccagggggaagtagattgctatttatgtcagaaagatgtttcagaagaagatgtctcctccaagcaaatagtatatgtctagttgttggcatctactatcctctctcctcttttattcaataaagtgatccaccttatctgagctacacagacctctgataggtgcaggggaggatgttggagggggtgccatttcgataggttggcattttctctgtaatggcaggaggcaatagaactatttgtttatgtttcaaacataaaataatgaatcagcactcgaacaagtcttgaaagataaaacgttcagtgttaattgaatctctatattgtgccagataatatttaagtgctaggaatacggtgctgaataaggtccctgccctcatagacaggtgttctagtaggaagagacaaaacagacaagctaaaacaaattttcaaagagtgataagtgctatgaagatggttaaacatggatagagactgaatggctgtggagggggcagatttcagcagatttagggaaggcctctcagatgagttggcattaaaccaaaaagtaaaggaagagaaagagctgccaagccctatcaagagcatcccaggcagcaggagcaaatgccatgcagtgatgtggaggacagtttggctgtgtgcctggagcctggtcaactacaggcacgtgcatgagaagaggtcacagggcagagcagtagggccagaccccacaggagcctggggatggtgggaggagttcctatgtcactctaactgtaaagggaaacactgagactgcaatcaaataaatctcctttgccgcctcactgtcggagccctgcttaccacatctgaaggatccatatcttccagagctctgcagattttgacagcagagatatgctcctcacacccccagcttctgctttttcattatttgtgactatcaaaacagaattttgatgacaaattatttataaataaaccaatcattaaaatatgtaagatctctcacctatcaccatacatctcacttaaccattctcatgcatcccaatgacttgaacaaaaagaaacagaaccagaaaatagtcaaaacagtacaatttaatctaaattatccttctcacaacatcactgagattgacttgccaagtcctgttcattgtcagattggattctctggaagtgagtgccttctgcaaagtatctcagacatggataacgcaggcaggactaaactgcttttcttcccatttgagttgccaatacctccctctgggccaatcgaggattattgtttcaacaatacatgcaagctaattgtttgttaagccggcccagccaaccataaaatcacaggagagtcaggcctggcccatcctcttgcctctgaactggatcacagttaatatctctgagagttccaccccaggttcacagaccaactggggaagatggctcttgagcaaactctgaattttgtttccatgaagaaaggtttctccaacataatcaactacaatcacaatttttgaaacattcacattcttaagtctgtatctgctttggtttccttaaataaaaacaagccagagataaaagtatggaaataaaatagtttcaaacagagagccctgtggaagaatgcactaacttaatatgtacttccagataaatgacaagatacatgtataagagaagcaaacttctacaaacattcattaacaatgtgtgaagataaaagttatctttgatagaaaaaggtaactgataaagacatcaaagagaaagatctgaaagtgaactttctacatactcaccagataaaacatataaaggggcaattttggtttgttttattgttgtaggtctaaaggaatactttcattttcagtagtttgtcagcaaacagcacaggaaactttactatttgaaatgagtagtctgagttaacaatagtgaccagatattataaaaccgtgttctgcctaaatatatccacaaatcttcagatggcctacaaacccaatattgaggctaaaaaagacatgacctcttgagaggctcttctagaaagtgggactctctggtactagggatatagcactgtgaaccccaaaagggagacagctctgacccccagtgcaatcaggaaagacagatgcaagccctaacttagtttacaggtttgatgtccccactgctgtgggcattcctgtccagaaacccaagtcctccccaagagagtggctagagagtatatgcaaacacaataaacctttcacagaaaaacaatgactttctatgactagaatttggccaaaggctcttcttttgagtgttagtgatataaaattctgctctaaaataatagttttagaactaagcttaaattcctgattatttgaacacattagaaaaagaaaaggagtttctatttcagaaggcatagttatttggaaactgccacagtttctttttaagtcaaaaataacaaaatttcataaaagcaaaacaactaacatccctctccctgaccctccaaagaaacctttcttagaagtattctagttccacacaatagaaaccaaattcaatgtggctgaagtaaaaacagggatgtactggcacacttaatggaaagttcaagggataaagcattcaggtatgggtagaactaggtgcttagactatgaggacctttctccatctcttaattctgctgccctctgcattggcttcatttttaagtaggttatctttaactggaggcaaaatgactatcaggacttccagatttacgttacatcatgcagcaacctcagttttataaaacacaacgaaacttcttctgggagttcaacaaatgtctcaggattgggtctccttaatctggctgggtccacatgccatccctgtggtctgctattcctgtggtctgaatggccagccctggtggcctattcctacagatgtaccacttggattccataagctaagacgggacgacccaaggtgcggctggcaggaaaggaatacaggctgacagatatcactaatggaatgtccatgtctctccctccacttacctgtttcctcctctttcaatcaaaagcctatcaaaactgggttcagatattaccttctgcaaaagcgcttcccaaattccatggaattgtttacttgaaaatggttaatttaaaaaaaacaaccaaaaaaaaccctcttcctagagtctctccttttggtgtaaagccctttctgatcctcccacaaactctgtttccctctaacactgaatttattatactttttgaaactttctgtccatatgtttgtcttaagcataatttcccaaaagacattttatccttgccatgtaggaaagtctttggcacaaaatagtaaaaatttatggaattagactgttgttgttgacagagacagttcttctctctcagagtgtatcaatcagtccactgtaatatcagtcacattgaatttattctgaaatatcaatgaaacagtctctagcaaaactcccacctttaatgtctctatcttgtaaacagaaatctgaaaactcagcaactgagaaatgcatttttacctagtcaatagaattcaaactcagacaagaatagcaaaataacaactgctaaaagtactttaaaataactcattaggaagcacaagtccctctattcaacaaaaaaacgagtaaaataactaattcatctctaacttcatttatattttcagttcatcttctgacttcacaagaatggaagttttgtattctactatgatcaatacctcatgtaaaaatagttacggcacaaaaatgcatgacttttcagatgatgttatttttaacattgctgaaatttaccattacttaaaatatactaactgcatcagtagattctagaggatactcctctgtatcttgcaaatgtatatatgctctgagcctaatgctcttatggctcctcctcagtgtccaatgaaaatgaggtagatcctaaaagaacccagttccaacatgtctggtttcagaattatccacttcaagttgaactcctgtgatcaaggccttaaaagctgtactgaattccacattcaggtcccactggttcaggagacactagtatcaaggctctaagacagcggctgccaatctttttggcaccagggaccagttttgtggatgacaatttttccacagatggcagcagggggatggttttgggatgaaactgttctacctcagatcataaggcatcagaatctcataaggagtgtgcaacctagatccctcacaagcacacttcacaatagggctctcgcttctatgagaatctaatgccttcggtgatctgataggaggtggagctcaggtgataatgctcactcgcctgcctctcacctcctgctgtgcagccttgttcctaacaggccacaaactggtattggtttatgacctgggtgttggggacccctgctctagggtgcaggaaaaggtgaactaatattaataaagggaaggtaaactaatatgagctgtgtgaggcatggtgctgggtatcctacacacagttggagccccacaatatgctattgctcattcaacacggtgtcttcctccagtgtccatcagcagttgggtgtcatactggagggacaatgggctgtgaggacttcccaagagatggtataagtagggagagaaccacatttgctgttctttatgagaaattaggcacatgtcaagaatagttttgcctacacatctttctcatcttctacttgactgcagataaggtatatccaatccttgcttgagataagatgtgactgcactgctcagtgcctcagctatcacaaaaactctgagagggttaaattattactggcccaatttataggtgagaaaacagtgcctcaaaggggttaagtaattttcccatgataatgtgctcaaaaactacaaaaactctcctccttacaaagtttctaagacttatcttcagggtatgtggacatagcaaagaagttgtactttgtattgagttaaagaatcaatcatctctagccaatgagccttttgtgacattacgatagcaatttagatcagcagtttacgttattaaggaaaggagttcgtattacaaaacatgctgcttcttaactgtttaagagtttagaccataagtaacccatatttagagagcaaaaccctggtgtcattgtgctttttcccagtaacatctttcaaatattatcatatccaagagacaagtattttttttaagtaattttgcataactcttaaaaagatacacaatcctaaacttaacttcactgggatttttaaaataaaataaaaattacagatgctgtttcaagatatgctttctcaaatacttttccaagtatagcatacctaacacagaacatagtttacatttgtccatggtgaggcttcaaaatggagcaattagatcaagttcaggggataatttattttctaaaaattatgtggcctttctttttaattctatttatgtgatgtatcacatctattgacttgtatatgttaaatgatccctgcatccctgggatgaaaccaatttgatcacgatgtattatctttttgaggtgctgttgactcaaaagttgttggaagaaaaaataataataaagagagaaaaaaatgaaaattatgcagaatatttctgcttcaggaaactactgacccattttttatcttttaagataaaaacatttttatacaccaaaaacttttatcttaaaaggtacattataatttagtcaaatctgatagtcatgggcttcataagctgcaacaactgattattacatttgataatacgatgactgaaaagcaaaagaacatttggtatcttaatatcaatttaaatttcacccgatcatgatggcaaaattgcccacaaagctgttctagctgttccttacacctttcctcttctacagcacactcagccagtgcaggagaggatgggcccagcacaattgtgtccacacaccacctcagacaagatgaggttattttgacttaaagggtatgtggtaagcttaatgaaatgatttaaataatctttacgcaggccttaatttttttccatttgcttctttagtttagaaaacactggttttatgaggagctgggtttcgttctcagcttctctgtattttaatgtcctgctggcctgacctggtctctacctgataccctgatgtctgagtcatctccaacctctccaggaagaagcagggacctttcgccctgtcactctgagaggtttctgatctcttaccaaccctctttgagagccctgacttaagaaaaaaaatgcttgaaaataaaacaccgaagtattcattgacagtttcaacttcattgtgggagacattctctgatgtcatgaaaggagcatgccagggaggccacccatcaattgatttttgaaattcctagaagccatagaaaagggctcacctctgctctaggagataaacagtacttcataagatatttattaacctagaggctcttaactaaaaaaaaaaaaaaaaagaaaacaatgcagccttttagtatattcctagaaccctcctcattcccctttcattccttagcttattccctcccttcttctttctcatttacacagaatcttagggtcagaagaaaccttgctggttaaataatttagctcttctggctatacattctcctccctttttatttctctgcatctccatgtcccagcttgcttctcctctcctctctgcaactgttcttccccctctcatttgttctgaaattgctgctgcctacatggtaggcactcctgggtatacacagtaggaccaaaataagcctgacatgaatggttttgcctgggtcattaactgaggtccaggactgactacccaaaaagaactacctaaccttgtagtcctctgcctgtcttaatacatgaaggtaagactaggcaatcagttatttgttgagctaatgaatgaacaaatgattgcttatccaagcaaatagcatatcattttctgttaaagtgaaaatacagccctaggagaattagggaggagcttcactggtcacagatatcttattaccaattaatttaaggatattgctccttcctaatagaagtagtcatgataaaaaatgggagtttgtaataatattgaagaggaagaggaggtaattttggaacctgggatattctgtatggggaaatatggggagtggagatgggggttgggaaatctgagcagtcagaggcaacctagagacaccaccggtacctaaagacaggtgttaggaggcaccagaagttgggaatggcacacaaaaacgaaatacagcagcaaaattcaacatgaatactattatttaatgtaggtttaggtagctattgtcataacaccaattcatatgtgctgaattgggaaatcttgcattgagcagtcaataaataataactaaagttaatagtgaatgtaggaccatcaccattttgctactttacttctcaaaacaaaacaaacgagaaaaaaaatgctatcccataagacagactgggcttgacacttggttgctctgacaacgaaggcccaaagaaaaagttcctgttttactggtgtcaaagtactcaccgcttctttaaaactggctcacttaaatatatctgccttatccctttttgatgtcatttgtacgattcacttttgctttggtttctggttttgcaaattgttagttcctgcagataatgacaagtagagggattaaaggaagtgcaggataatgaacaaacaaaaagcatgatataaatcaggcacacagtgatgtttacttaaggctgatatgttggagaactgactgttgttgttctccattctagtcctagagtattgtgagaataaagtatctttctttctttctttctctttaaagagggagtttcacttttgttgcccaggctggagtgcagctgcgcgatctccgcttactgcagcctctgcctcccaggttcaagcgattctcctgcttcagcctcccgagcagctggggttacaggtgtgttgtcaccacgcccagctaatttttgtatttttagtagagacgggattttgccatgttagtcaggctggtctcgaacacctgagttcaagtgatccacacaccttggtctcccaaagtgctgggattacaggcatgagccactgcgcctggctgagaaatcacaaagtatctttctaagtgcactaatgctacttggggaaaacataaataattacaggtggatcctagataaggagacattccttgttacttccaaaaaaattccataatctttggagattccaaagagattttccatccctcccgaatcatatggaatgcgaaaggcaggtatacatgagaatccatgtacacattgaatcagaaggaaagactatggcaaaaatagggagccacattaggcacttaacagcagtctgggctaaaatcctatttctgcctacagttaccttgaaaggaatcctttgctgccctttatgtaaatgcaagtgatttaaaaacatagttagatctgtatagtgctatacaatttacaaagtacttgggcattcattatctcctttgatttttgtaattgttttgtatctccagttccaaaatgagaaaagtggtacccagaagacttgtgtagccagtacaaaaacatgcagtaactggtttcaaagctaggactccaatcaggttttgtttttatttttgagacagggtctcactctgtcacccaggctagagtgcagtggcaccatcttggttcactgcagccttgacctcctgggcacaagcgatcctcccacctctgccttctgagtagctgggaccacaggtgcacaccaccacactcagctaatttttgtattgtttgtagagacggagtttcaccatgttgctcaggagtctggtctcaaactcctgggctcaagcaatccatctgcttcagcctctcaaagtgctgggattaaaagtgtgagccacggtgcctggccctaaccaggttttttgacccctagcccaatattctcttaaactcttaagcaatgttttcttattttcaaaactgaactaattatatcttggatgagaatactttaaagacattctaaaaatacaaagtagctttaaaaataacaaagtgattcttgcattcttatcctgtctatctaagagctcaagtgtcaaatgatatcttcctttctattggtatcccaaaatagtaaattataaaaaaaattgggaacaacttgcaaacccgctaatatcccaaagctttcatgagtaaaaagatgttaggattaaggagaagctacagaggaaaagtgctatcagaaaacatcaccttagctgtgtcttaacaatcacacaaagacaactagcatcagccgtatatgtgtcctcaaccatctgtgttctcaacccttgcttttttgccttgtagcaaactttgctaatttcacagtactgtacgatacttcttggtattatgtgaagtactctatttagacatgttgacttcactaattagtctataaatacttgacttttagccactgctttggtaagtgagataattgctgaggaaaggccaaagcatttacggtcaatcagatgaggaaaaggggaatatggtctttgagctgagtaaaatgtaaaacattatgtggcaaggcagaagctattagcaggatcaatatctctcctagtaccttaataaatcatcacatcaaagccccgacagaggatggagaaaacctcagtctacctacatggaagcttccaaattggaaaataaaattccatttaaattacaaagacccaattcatgtacaatggaaatggcaagctacaaaactagtctccaaatcctggatgtgctaagagtttagaatcattagtgaagggagaaaagcagaaagacaaagaacactgctactctctgggttgcacattcataattcgcaagttgtaaatatgtatgaatctgcccactgcagctagggatgacatactgctttttagagatagcacagagcagagaaatcaaagtagaggaaggtttggccattataacttacctcctcccacatttaacagttctcaatcttctcaaatctccccttacttaaattgctgtcttttggggatggcttcctaaaatgaaaagaacttcgataccaatgaatgttcaatgtatagcaaaaagcatcccatggtgagctctcactgtaacatgggacgtaaataattgtattttttctaaatctttaatcgctcccattctctttgatgcttccaggaaaacaagcaagcaactaaaagaagttactaggctaacttgcccagtttttttttttttaactctagaactaattatttctcttttctaatatgtagtaaaagacaaaagaaacattttgcagagattcatattatagaacattaggctttcccttaaggatacgtatttcctcacttacagagatgatagtgaatactgacactattttgactccaccacagcttttgctttgcagtcatactgtttaattaaaaataggtttttttcttataagctcaaattactctactgtagatctctcaaacttcgtagtaagttgaagctgagaactaagaggtcacatcaggaaatttatttagataggtcataactggcaaatcagcaacaaaagaaagcagggcttctcaacatcttgaaacattcattcatgattaattatttctttcattccacaattatctattagacacttgagtatcatgcttgggcttgatgataattatatcaaagaaagttcccagaaggttctattctcaaaaaaaaaaaaaaagtctgaccatctaagtgggtacataagtcacccaatacttaaaatgttagctaacattagaagatgtaaattatataaaagctgattgtcacaagtgccatatatggctacgtgccaaagaagggctacagtaaacttttataaagaaacctctattggcagggattaccagggaagggactaggggagagggtaaaagacctgagctacatagaatttgaataagtgaaaaagaaaaggacacatgcttcaatcagtaggaaaagcctgggcaagccagtgcaggcacacagtgcagtgcgaagcaggagagagttcacagtgcagatcagtggtaggtcaggacattagagtcccaccccaacacgcaggaaagacagtggctggactgcatatcttaaggtaggaaagtttttacttcagatgggagaaaaatagagagtcaggagaattctgataccatgtccaagtccaagaccatttggggagtcaaaactgtacagaaagaaatatcttctctagaagcagcagatttcatgtatggccagaaggtggtaggggtttccataaagcggtctgaggctatcaggaagcctgtttcttatagaaaaggggtttcagaagacccagggacaagacacaatttcaggaaaggggcactgggaggatggttcttttagcagaaacctcctcacaggaacagggatgagtgcctaagggaggagctcctgcctgggagaggcaagaaaggcagaaatgagaagcagggtggctctgacttatcttcctggtctaaatggaacctagtgtcttgctggttcaggagcctcattctggcctagaaatagcaccccacttccacctcaccagccaggttccaaccgtataagtagttgagctgaaaacaggagattcattttgtgtggtgcatacccatagttccagctactcaggaggctgaggcaggaggatcatttgagcccaggcattcgaggttgcagtgagctatgatcatgccactgcccttcagactgggtgacacagtgagatcttgtctctaacagaagttttaaatttttaaaaaattcattttgtggttgtaagtacaaaaaaaacctcaataatgatgagaaaaaagatatacgaagatttgttggttaggagatcatagctgatagggtgtgtactacttactacaactgctattctcccacactcacactatctcctgtcttaagaagtttaagcaaatctaggcccagtgtcccactgagggaaatcacaagaggacttagaggggtcccatccatgagagctgcaccatgagtacatgctacttggaaggctgcttctgtggtcattctgagagctgggaaaccaacctggtgctgagctgtccagaaggcagcatctgctgattctggtaccactgggaagaacaggacacatctttactagggaaccagctgctagtcaacagctgccccttctgctccccaataagcacctttctgattactgtcagtttttcagcagaaaggccatcagctgttgtgttaatgatggggcttcactggttggaagaattttgcagtctccagtctgaactattcctctgggtgtccttattcaagcagcagttaatttgaaaacaattagctggttgttcacttccttaaggcaaagcaatactggatgggctaccaggttggactaagattccagcagaacactctgaaggagccaggatatttctaggatgggtctgctttgtgttggcttcaggaaaagtctagcatttctaaccctgatcattgggaattagtcactatttcccttagttgctctggcaggctttcatttatttttgcctgggtgacaaggagacacttctacatttcaacattaaacagactggacgattcatttgttttcttctttttttcactcttccaggtaaagggaaaatggatccttatggtgaattatagatgagaaatcaatgaaagatacagagactaaagagaagtagagttttataaaaagcaactggatttgttttataaagtagcagatttccttttacaggctggccaacataatctttgggactgaaatatctttctgataagagtatgtattttctgtcactgaatcctctacttatatcccctgccacacttcatcctgttaatgaggacaaaacaatatgaggaaagtttttctgttttcctcagtctcccaattcctcacctctcttctctgcaaaccactcggcttccataacaaaaaggatgacacaaacagagtaaaaatatgttaccagagactttctcagttcatggcaatattcagtcagctaaatctggcaaactcatacacatctggcctgctggcaagtctgactagaattcagctgtgcctgtacaaggaagcaggggaacagcatttagagttagacagccctatggcctgctgaatcctcaaatatgcaaggggcttattcacaaaatgcttcacaaaaaatggctcctccaaacacatgcatacttatttgatgtttttatacttttttcttttcagtgctaagccatcttctttagttagaactatttttatcctttgtcactttataaactgcaatggaattcagtattccatgtacaaccttaattttctgtatgacatggaaaacaatatgggaatcagagggacttaaaactaagtctatggagcccaattcccaaattgcagatttaggtcttactgtctctcaggcagattagatgacttctgaaaagaaatacttatttaaatatgcttattttattgttattgaggtatgcataaattatcccgttatagctatccaaaactgtgaacaacagaacaagaccccaaactgcagagaatatatcaactcagttgcaaaagataagacagtaggaaaggtgccatacagaacaatattgggagttagcatcatgaagaaggttagcaagatgtgtttataatacaactttcattccaacagaaattataacatgctaagagcatggacctcgaggaaaaaatatctattttggtgggctaagtaacttttggaaaagactaaaacacaaactcctttagtaaaatgctttaatatactctaggccttttctttaaaagtaaggtatgattaaactaaaactttcaagtagttcaatgaactaagcaagaactgttggcttccctccaaccatagtcccacttgctagagataataaccataaaagtttcatgtgcagcccacacataaacaagcatatacagctgcatatttacacacgtgtgtatttgctggtacaggcctaaaatatggaaacatttgctattttattaaaaagtgctcataccatatataatattcatgcaacattgttctgtatcattgacatagatgggtttgttctttttaatggctattttatgtactattgaacaggtatgctataatacctatattcctattggtatgcttttaggttacttctgagttttaacaattaaaaaatacgcaatatgtcttcttacaattataactttctaacttgtatagatagaactaaaacttctccaaaaattattattccaagctacactccttccaacagagtaacaatttctcaccaccactagatagcatcaactgtttaaattgtgtccaatggacaactgaaaaatactctcttattttaatttttgccatcattaatgaggccatctttgcttggctgttatatttttctttgaatagcccattcatattctctatttgttttcttccactgagttgttactttttactaattgagtcccttgtttcacagagaaattagcccatcatctgtcatgtgtactgcaaatataattcctaatttttcatttgtctattggctttggttttgttttggaatgaggagacagtcttctagaaaataagacatattaaataatatattggtaattgtaaagcacagattgtatggcgccagccatcatgtgctttgttcaggtgtcatgcttatcttaggtaacaaggtcaccaggattaattagtgaaaatcctgctgagtttcagatcatctcagtggccctctataaagtgttctcactcacctggcagcctcctttcttaatctcagttggaatctcaaccacaaagtggttgctccttgtatctagaagtcatttaaaagacagtaatcaaaatttctgttctcttttatttgttcctctgcttccctatcaataattctgggaggagtgggagagagaacagtgcgtaatcaaaaggcagacctagcaaattattattttattgataaaataattcagcaaattctcaatattcctgcttcacagtgattaccctagattttatattttagggttttgcacctacctcttatcatcaccccactaactagagtgtagtctgtgtaggacaccgattagactcacccctggtttggcaggcaaagaatgccaaggcaaaagcacagccgacaaagctccctgtacttgtgcagatagagaggcagagtataccccggagctgagctgcaaggtacaaatcctgaccctcctacttgataactgtgttactcggagtcagttaacctctcagagcctcagattcctaatacatatgatgcatataggaacagtgccatcagaataagaagagcagctacatcacaggactgctatagggtgaatggagttatgatgtaaagtagtgcctgggatacacatagcacattttaagtaaatgtggcatatcaatatagtaattacatatagcacaatagaaaagttagagtgtgatgaaatccaataggctttacaaaaatcaagtaagtattagtactacataaccacagaaaagggaggcccaaaggaacagtcaagaaatgcagcaagggccaggcacagtggctcatgcctgtaattccaacactttgagaggctgaggcgtgtgagcccaggagttcaagaccagcttgggctacatggtgaaatcccgtctctacaaaaatacaaaaattagccaggcgtgatggtgtacatctatagtaccaggtacttgggacactgaggtgaaaggatcactggctgaggctgcagtaagccataataacaccgctgcactccatcctggacaacagaatgagaccctgtcaaaaaaaaggaaggaaggaagagagagagggagggagggagggagggagggaaggatggagagagggaaatgcagcaaggagaagagatggggagcaacatggccaaatagaagcctccaccactcatcttcctcataggaacaccatatcttgagtagaaagatgaaaaaatgaaccaatgcaaaataatagttataacaacttttcaagatatagacagtacaataacatataaatagaaacaataaaaagttaaaaagttggggaatgaagtttaaagtgtagagttttttaatactcttctctttattagtttgtttatgcaattagtgtaagttgtcatcaatttaaaataatgggttataagatatttacaagccacatggtaacctcaaataaaaaaatacaatagatacataaaaattaaaaagcaagaaatcaaaatataccaccagaaaaaaatcgccttcattaaaaggaagacaggaaagaaggaagagaagaccacagaacaaccagaaaacaaataacaaaatggcagcagtaagtccttacttaccaataataacactgaatgtaaatgaactaacctctacaaccaaaaggcacagagtggctgaacagataaaacaaaactaaactaaacaaaaaacaagccccaatgatccactgcctgcaagaaacatgctccacctataaagacacacatagattgaaaataaagaactggaaagatactccatgcccatggaatccaaaaaaagaacaggagtggctatgctggtaccagacaaaacagatttcaagacaaaacctataaatggagacaaagaacttcattatataataatctatgggtcaattcagcaagaggatataacaattttaaatataacagtggagcacccaaatatagaaagcaaatgttactagagctaaagagagagacagaccacaatacaataatcactggagacttcaacaccccactttcagcattagacagatcatcaagacagaaaatcaacaaagaaacatcagatttaatctgcactatagactaaatggacctcatagataattccagaacgttttgtccaatggctgcaaaatatacactcttctcctcagcacatggatcattctcaaagacagaccatatggtaagccacaaaacaagtctggaaattttttaaaaaaaataaaatcacatcaagtatcttatctgaccacagtggaacaaaactagaaaccaaacaacaagaggaattttggaaagtatacaaacacatggaaattaaattatatgcttctgaataactagtgggtcaatgaaatgattaagaaggaaattgaacaatttcttgaaacaaatgataatagaaacacaacattccaaaacctatgggttacagagaaaacagttagaaaagggaagtttatagctacactataaaagaagaaaaacttcaaagaaacaacctagcaatgcatcttagttaactagaaaaggaagaacaaacctaacacaaaattagtagaagagaataaataatagagaccagagcagaagtaaatgaaattaaaatgaagacaatacaaatgactgatgaaatgaaaagttggtttttcgaaaagttaaacaaaattgacaaacctttacctagattaattgagaaaaacagggaaagacccagataaataaaaacagatgaaaaaggaggcaaaggactgttagaggctactatgagccactgtatgccaatacattgggaaacttaaaagaaatggataaagacacatacagtctaccaatattgaaccatgaagaaatccaaaacctcaaaagacaatcagcaagtaatgagaatggagccataataaaaggtctcgcagtaaagaaaagcccaggacctgagggcttcaccgctgaattctcccaaacatttaaagaagcatatcacttctatttaaattattctggaaaaaaaaaggaggaaggaatacttccaaactgaggaaggaatacttccaaactcattctacaatgccagtattaccctaataccaaaaccagacaaagactcattaaaaaataaaataaaaaactacagaccaatatccctgatgaatattgatgcaaaaacccttaacaaaatgccagcaaaatgaattcagaagtgaaagatctctacaatgaaaactataaatcattaatgaaattgaagaggtctcaaaaaatgaaaagatattccatgtttatggattagaagaattaatattgttaaaatatccatactacgcaaagcattctacagagtcaatacaatccctttcaaaatgccaattacattcttcacagaaatagaaaaaaaatcctaaaatttatatgtatcaaaatatctcatgtgccccataaatatatacactatgtacatacaaaaattcaaaataaaaaactataataaacagaaaagaaaaaagaaatgcaatgaggaatagacggaatttgaggaggaggcctaaaataaacaaaatcaagtattgtgtgtattctaaaagaggagaagagccttacaaaaacacttacctcagggacaatgaataaactagtgggagtgcagtgaaaggctgtgactggatagtaggagaggattactttaaaaatgcagattgccaacatctcaaactctgtttatttaaatgaaaatgtttacttattctttgctctcaattaataaactgaatcagctattatcagagtagtatttcaaatgtgaatctttagagcaaataattttaaaaaagaaacacctttcccacagaaatactgatgtccaggatggagggctttccaggctggtccctgcagcccctgactacaaatgggaaggcagagtaatgatattgtactatcatcagtcccattcattccttcactcagtaagcatctgctgaatgcctaccaccagtccatcactctcttaaaaaagaagtggtagtggtgaacaaagagaaacaaggtctctactctcgtgaggcttctactttagggtggggaaggggagaagcaatggatacagagcataaaaataaacagatgagtaagattaagattacttgagacagtggaaagagcaataaagcaaatcaaagcaggtgctgtcatggggtggaaggcccctctgaggaagtgatatctgagttgacagctgaatgatgaagcagaagataagtaccaggaagtccctggcagagggaacagcaagaacaaagacattatggctggaaagagcttgatgtgttcacagaacaaaagaaagggcagtgaggctggagtcaagtgccagagtcctaagcaaaaagtaattgtgaagtccaactttgaacgtcaagcacacatttctcccttcgttctgttgactgccagagctttagcagctcctcagctctggacacaaaatgcatggtgttgagctcctcagaagctccagtggcctggggttctctctcatggatccaggaggaagccttgggatcaagagcctgatgtgaggaaagggaaaggactaggggagggaaggataaccagggtggtcacagctccagtacccacaaagacgctctttagaaagtaggggatttcaatccatttgggagaatttcagttaagtttagttaattttttagataaggaaagattcttgccttttgtttccttagtttgtctgtgagcttccaaattagcagtttggacaaaatcaggaacagcaggaaatccaagggtgagctatgtataaatcaagaccaggaaaactaggacagttgctggtgcatcactaaccttttaagatttatgttaaaaaacaagcaagcaaaaaccccaccatgccatcctagtaaacatcccttaggatcattctgaaaaacaaaacagatccactgatggatagaaaatgaatctcactggttatggcagtttttaacgagatttttctatttgtttggcctaatttttaaattcttgatcctcgtaatcaccatgtgggttgcagtagcaaaataacttgtgactgatgataattaagaaaaggaaatttaagaaatgcatgttttcctgagccaagtttcaactaaatgtttttgctactaaaattatgctttcttacacaaatgttgaatataagtaagttgctctggggatgttagtgtttacattttttcccatttgttatttattagcatgaattaatatgccagtttgtatttgacacaagattttttttaattcttgcaataataagactacatttctctatgcagtcatattgctttcttgaaaaggatgattatctcacagtcaatgaacttggtgacaaattataggtattttgatattgcaggtatagtaattttaatgcaacccatcaatgcatagatcaatgaattttatatttattatatgatatatattctactgtactagtatttctaaggaagatgaacacccaggacaaataaatatattttatttctgagtttggaatatacaaattgttattttcagtggcaatagcatgtctatcttctgttggaatgttattttaaaaaatacttctatctgcagcaatacagaaggaacactggttatttgggagataattatttctgaaaaaaatagagcaaagactaaaagctaagaactttgagttatttgtactaaatgttatctagtatcatttgagagatgaatgattgtaagatattgtctccacgctcagaagagaaggtatagatcttcgaaaaatttaataatttactgaattatattctaaataagtttaaatgttcacacatgtgaaaatgctttgtgaattaaaagctaccacaaaatttaagggcatgccattattattttcggagttagtttatcatggcaattcttatagctaaagccccatcaattcttcttttttcagtgaccaggtccagatcatcaaaataagaatgagcagaacaatgagccctcccagaggaagagacagccaacagaaaatgttattccatccaagaaatcaatttgtttattcataatttgaacaaagtatttccatgccaattactgattggtctctccaaggtctttttgttttttaactcaccataacagatggaggaaaatatatatacaactaaaacctgatagcataattagtggactggaagttggggtaaaaaccacataaccaaatccttaacaggaaggtcaatatcaagacatattcattatactttgaatggttatcaaaatacatgtgttagtgcaaatcagtaccatgtgctttttccctgtcagtatttgttttttatctaatttacctatattattatttttaaaatgtgatcttcagcccagtgagttctatcactctcctctttatctagtcctcttataataattttcaatgtttaatatgctttaaaatgggacaaatcatatccaggaaataaactgtttaccaagaggaactttgttaaaaaaagataaactggctgaaatgattaactgtaaaagttcatttcatccctgtctacatgtggcttgataattaattaatcttatatttatgaaaaataggggaaagagaatcataaatgttcataatttagaggaaaggaaccgagacacagagaggtgagtaccttgcagatgagggatcagtgcttaatctacatgtctactctgttcccacagtctgcaaggaagagaaacagaatttataaagtagatttgtaaatcctgataacatgagtcaggatatgattatgtaacttcaaatatctttgcatttaacaagctagaaacccagagcttgatatttgttgaattgcatacatgccttttcctggtttcttgtttacaataaattttgtggcaggatatttagatttgtgaattctagccagactgctctctaatgagactacagcttgtttgggttttaaagctttatgacatttatagatgtttactttgcatctctaaaaaacacagaaatgctcccatactataaaaatactgatctctaaactttcaaagcataatgcaaaaaatccctaggtgacgaacctttgtgatagagtaatacttttttcaattctttgacaagtggcactattatttataaacttgagttacacaggatagtatataactacagcaacaatattttgataaaaggtgtcagataaatgctttgcctgaaaaggctaatccagaaaacttttttccccttcctcttgcatgaaacctcttaagcagttgacaggcacgagacacattgcccacagagagtggcacacactgagaacacacagtatctgacttaaaattccagcttttgccaaagaagagttgtcttcagcagccgtgtcagggtgccccgggaaaaaagacagagactcctctggtcttttctgtcattaagtgtgagaaaataatactttaaccaactagtgtggaggtgattacctcctccaagaaacattttgataaactggcccactccacttgagcttctaggggttaagccagatcacaagctgagaggagggagagcaatgcaaataagaaataacccaaaatgaggcatccctagcacagttaccaattctagcttcagcctttcttttatctagagcgggtcctacaactccagagtttttttttttttctgggtctgccaaaattcaagttcctacactaatttgttgatttgggtctattagtataattattattttcatccccacatttgaaactcattctatgagactaaacagaagaaggcaaatggatttcatttcaaaagccaatttttatctattactagtggctgtctttggggtctgatttgagcagaattctgaggctgagcatggtgagaaagtacaacttaatgatttcatgatatctgctagctacggggatagggtcagatccccagggcttgcagcatgtgtaggtaatcaaaaaaatgtttgttgaatctttggttttatgcaaaatggctgaggtctctttggaaaagaagctttaaaaacaaaagtaatagaaaatcaatggctgtatacccttagatagaaatgcagccatccgctcacttaccttttatctgaaatacttcaatagcccttcctcacctctttccaagctatactgatataaaaatgacctttctaaattggatcatggttgctttttccatccctggttccttattctcataaggctctcttaggaagcatatcacataagcatataaagatcacctagggcagacagatagatagataaattagacagagaggtgaatggatggtaggtaggtaggtaagtagagatagatagatagaactagggcactttcattaatcaatttgctggttattctctgcattctgttcccttgcatcaatacctcagactctttgctatggctcagagacctatgttctcttcttgaaacctttgacttcattgtagctcacagattaagataaaagagactcccagtgacactctcagaagaggaagggtcccctggcattactgcatgaagaggcagattgagacgacaactcatcctttattagaatcttttccttagaatataaagggcaagctccttagtggtttaaaaaaaaaactgtatttctccatctggtccctgctgttttgctcagcttcatacaaccaatcatcattctccaacaatgagccttttaaagctccttaactacaccacgatgtttctaaagttctgcttctcttcactggtgtttttgcttttttgtctgcttgacaaactctgacttggttttgaaaacccagttcataatcatcccacaccacaccctggaaaaagttaatcattcccttctctgggttagctctgcactgttcccataaatatttctatagttgcacgaatcaggtgctttgttagtttaaattagtatctgtgaactggttgagagcaggaactttgtcttaattttctgttttcttagcacccagcatagtttaggacacattcaatataactgaggatacctttaagattttccattagggagaaaaagggaatagtgataatattatccaagaaaggaaaatgaaaaacaggagcagactgcattgtgagatgccatttgtttcatttggagatagtcacgtttcaaagtcccagttagatgtaccacagaagaaattagagggtttgggaaatctgggcttagagttaggaaaggggtttggagctgaagatggtcatctgagagtcagcaacacataggcagtagcggaagccatagatgcacatagaaatgaaaaactagaaaaagtggcaagaaccctgtagttcactaaaaatttggccccaaatttaggagccaatgaagaacatgtggatagatgaagactgggaagaatgataaggaagaacctggaggacctcagaggccaaggacattaaaatttcaaataagaaggggtatcgatcatgttagcatctcataatggttaagtgggatgaaagctaaacagatgagatgaattttctaatatgaagaaaggggtgtgcagggcaaagcacgacatcgagagcaatttcagtggaggcaaaagcccgggatagaacaaactgcagtcagtcagagtgaatgagtgcctttcatccagactcattacagaaactgtggcttaagcaagaagccctcagtggccatctgggtgagaagtggaggggaagagggatggaaaggtgtggtgagaaggaatcagctaatgggcaaagcaggaaggattctactgtttgcacgacaacattttacatattgtatattttaggcaagatgtccctaggcaaatggttccataatcccttttgttgataaatgcctattccctcatttctcatgtttctataaaggggaaagaacatcaactccaccagaagatacagtctctggcttctcattcacttcttcttgggaaggaataatttatctgatttttgagtttgggagaagaaattgaacatgactagctcattatcttcctcccttaaattcataaaaggcacagaatctcctattctgttatgctttaagcagcctgccacagcagaggaggatgacggctgtctaccaatgcctgtaactgggggctcagtttacatagaagggagttgtattaagtccaagtggtcacagatgtaagtcacattctccaattcggtcatgctggtaataaagcttatggtatacactccatctgtctcactctcatgtttgcttctcaactagatgtgaactcaaggtgggaatcgggtgcttaattattattgccttaaaaccttaaaagtaggccgggcgcggtggcttacgcctgtaatcccagcactttgggaggccgaggtgggtggatcacctgaggtcaggagtttgagaccagcctgccaacatggagaaaccccacctctactaaaaaagaaaaaaaaaaatacaaaattagccgggcgtggtagtgcatgcctgtaatcccagctacttgggaggctgaggcaggagaatcgcttgaaccctggaggcagaggttgaagtgagctgagattgtgccagtgcactccagcctgggcaacaagaatgaaactctgtctcaaaaaacaaacaaacaaacaaacaaaaatcaaaccttaaaattacacttcaaggaggttgtttaaaaatagagaaatataagacctccaattcctcatctgtgaggtgaaggggctgaagtggataatctttaagtccttcccagcaatctctacacgtctgtttgctattgtgtgtgtgtatatatcagacaagcggtggggcggtgggggtggtgcatgcgcaaggagtcagacaatcttaggtaaaaggaagggaggattcaaagcaggagcaggcagtcaccggggtagtgagcagaaaggtctcctaggctgaagaaaaattaagagattagagggcaacttacttatgaagagcattttctgagacaaaaatgaaggttgctatatataaacaaaaatatatatatacacatacatatacattataatacatagagataaacaaaaagcaaaatactgaatcaggctggaaaaaaattctccccaattcaccagcccttccatgctcacataaaccccttccctcattagattataagattttgtacctttgcacctaaattttccaagagaaaaaatgaataggccacaaaatgcctaaaagcaaatgctaggaattgtttggctcaaataacaaaacagagacccttaactaagctgaggacagtggaatattattttgccttcttgcctgttggaagcactaagaagacatttccaattccaacgttccatagaccaaaaggcttaggtgaagagggtttccaggctcacagctcaatgaaaacaatgatgatccaggggagtcatggcactcatgtcttcaacactaatggatttcagctgattcatcagtgaacatttctcagaccaaagtggaaaaagcaatttttgtcttctgttaaacagaaatctcagtcagtcttgcactgaattctttcacagaaaatctctgctcttctgccttttcagacacacaaggtctccagcgggtgctctccagagatggaaggaaggtgtgttctgtgcagtgcatcagttgctatgtgttccattgtggcaattgtgattcacaagggcatagctgagccaccacagctttcagctgtaatcctcctggcatctatccctgctgttagagggataattatctggttatccctgaggccagttcttgccattttcacataaaaatcacctcttgcataagacatggaatttaaaatcatctcctcatacatatcattgagtcacttcattacctctgggacatatataaattatgcattcttcgattctctttaaatttttagaggctcatagggacagtgaaggatctcattggtactgaaaatataaggcattccagaaagaaacaataacttgtgtgacattaactgctactagtgttccaaaggctccctgcttggtcaaggaaatcacataaagcatggagaactaatagcaggcttgcatgctaatgactgccggtctgctagtgactgaatgtcactgcctcacatcctcatgctattcatttttcttatctcagtgacttctcccttcacaggactgatttacttctttaaattggcaccattctgagtgtctgcaaccaagaaggcactgaaaaattagaacccacatgcccttattcccatttatttctccaatcccatgcctcaatattaagagagttatttgtctgtaccatggaaatagtgttttatgaattctctggagcttgtttgattttacctttagatgcgtccaagactcactaccatacgtgcattctttaaattctttaaagagagggcgtgacattagcatgaataaaatgcagtggctgtcacggcaagaatgaagaaatgtgtgtgttctcatgccctgccattaagatgaattcacagatgtaagctggcaacacaacacagcacaacacaacactggcaacacagacatccatggagggctacacatttcattccatagttcccattcaatataaatatggctaacattccttaaagattcaaacccatagtatattgttcacctccaaactggaaaaaaacctagtcctgtcacagaagtgaattcagttgcttgatctttacagctgctgataaaagtttgaggagttcacagacttatgggaaaagtgagataaacttcagtatccagcattaaaggctttccaaggcaaaatacattgtgcaatattaatttttcaagttaaaaattggaggtatttgaaaaccattgcttccccaaacaggaaggaaaaccactgtttgggtggtaaaatgtgctaattctgtacaaaatgcctttaagcccttgacctaatgaggttagtgacagggatatggatgactagaacagaaaatgaaactcagaaagaattttgttcatgaactgccatatttctcctgtcatttagccaattttccctctcaaaattacaacatggactgcaaatcttcaaggctaatgctgcatatgacagactaagtgctatttaaaatgtaataatatatctgtcaatctgataggaaaaaacaagaggccacgcgaaggacttttcaggtagacatgggtcctaaaaggttataaagacggtaatcaggaaagcaagccaccacacagcttttcccgtccaattagtaaaagtgcagtattgtcagcgagttctacaaatgaaagaatcctttcagcctgagcactcaatggcgtatacccactctattaagtgaccttcattgtacaatacattaatttctactaaaattaatgttttgggttaaaatcaatgcttagaggacattaatggaaatgatttaatatgtgtgtcatgcatactgtttcaaaagtttttaatctttgtaatttgctacaaaccaaaattatatgagaggtggaagaacactcagaattctaaaactcccactgctgactaaaacataccacttttgttttccactttcatctcagtcagggcatctgtgctattttaatctgccatgcctgaattatcaggaaagagaaaccactggtttcctacaaacatactttatcttagtaggacactttccctctagactctctgtgtggatattttcaaggattcacagcgagacactgggtgtgtacgattgaggttatttaagattttcccacaatgactggcatccatgtggagagacaccaaatgtcatgcctcttcttaaccagttctgaggcggggaaggtagggaaggaaaagcagtgcgcctggggagatggcatgacaaaagagagagccacattctgcttaggagcttattgctttaaaagttcacctaagattgaatttaaaatttgctttaagcacctataatgaaagaacattttagatcttgggagaaaaggtacaagtgtccagcatggagtgaatcgcttggccctttaatatttaacttcactgaaaaagaaacctcgtgaagtcctcttaaaagaacgcaggggactgcacaggactttctcaattgatggcataatgagaaccattaggaagcttgactccattttacatcttaaatctccaagtcctccttgcaaaaggaagcaaacagtacctgcttcccaagtgagacttgagtggaaagtcggccaaaatgagacagttttcagaaaacaaatttcagttaagtctcaggaagctacactactactactttctctattctccatgccctgctcctgacagatgggaaatacatcaactacactctgggcagaggtaagtgacacagaagatttccataggtagtgttcaggtcacaccttcctgaacaacttgttttattaaactgttcctaagaagaacctctgccttcctgttgaccttaaaatcttctcaagaggattataacacaagatgcttttatattgtggttattaacagctaccatttatcccagaggctcaaaacaataggatgaggattgttaccagaagaataagacatagattcctcggtaatttagcaaatttccagctgtagtactccttgcccagtaaaatgcttggctagccctttggtattttactccaggttcctcttctgtaaagtcaaccaacacaagtggcctgacagtcatgatggtgacaagggatgatgttcactttgattgtattttggaggtaaatgcctgggcaaagaatataagaaaccacatcctagcaatatgttgtaatacataagtttctaaaaactaaaaaacaactaaaagaatgtacattccattgaaatgtactggcccttgtagtctaatgagaaacgtaatagaagacaatgaaacaaaaagtattttcttcaattaataacacaactcaggaagaaatgttaagaattaaggaaaaggactcataaaaagcaaccagagttaattgtttaagaagtgcatatctaaccccatcacttgcctacttagattggcaccaaatccttaacacagactgttgtaataggacaacagaagctattaaagggtttcaaactgggaggggagggaagcatgcaatcttcctacttctgtcttcctacttctaagactcaatccacttgccgctattttctgctttctctaggaaagcttcccacagctgacgaggaaattagattccctatagtataatcttgtaggactgtatactttttcttgacacttatcacacttagaattactttttcaatgtttctctttctcctcagacctgtgatgagcaatatggcagccacatgtagctattgagcatttaaaatgtgcctagttcacattaagatgtgctgtagtgtaaaacacatgccagatttgacaaacttagtacatactgctactgaaaaaaaaaatgtggccctgcagaaaccttgattttagcccatgagaccaattttagtcttcttagctttagtaacagaagagaataaatttaggttgtcttaagacactagtctatcgtaattgtaacagtagcaatagaaaactaataaatgtggcttccagaaagattaaattacatatatagatcacatagtatttctatggaacagcactaggttagattataaactccatgagggcaggaaaatgtctgttttctcagctgctccatgttctgcacccagcatgcttcctgacacatatagtcagtccaaaatactgtggattaaagaaagaaatttaaagaaggttttaccccctttataattcgtaattcaatcactattccaataaaaaattattaagcgtttactatgaaccacacattgtgtaaggcactgaagatacaagtataataagaagtggttgccagagaatgggagagaagggaataagtagtaactgcttaatgggtatggatgttccttttagagtgataaaaatatttttttttttctttttttttgagacagagtctcgctcagtcgcccaggctggagtgcaatggtgcgatgtcggctcactgcaacctctgcctcctgggttcaagtgattctcctgcctcactctcctgagtagctgggatcacaggcatgctccaccacacccgactaatttttgtatttttagtagagatggagtttcgccatgttggccaggctgatctcaaactcctgacctcaggtgatctgcctgccttagcctcccaaagtgctaggattacaggcatgagccaccatgcccggcctcaatattttcaaactagatagcaggaccagtgtctggagagggctgtctccacttccaagatggcaccttatggctgtattcccctaaggggaagaacactgtgtcctcatgtggcggaaaagacaaaagggcaaaagaaagaaaagaggaattccctccatcaagccattttataacagcactaacccattcatgagaatgaagccctcacaacccaaaatcctcccaaaggaccccacttcacaatactactgctctggggactcggtttccaacacatgaattttggaggagtcctccagaccacagcattaaccatgcagattgtagaaggaggaatattgcagacagaaagctcatttatagcatccctagatggctcttcaaactcttggccttctctattaactgacaactttctgcttccttgcccctatcctgattgacagttcttagagagtaaagcctgaatctttgaagtcatagtcaccataattacccagagtcacagagcccaaggagcaaaaagctgttcaaaatgggaaactatataaaaaaaaggagaatgggatccagaggcttgatcaactctatgggcaatcccacaaaatatgcatgtaatatataatcagagagaagaaaggaagaaaaaaactaggtttgcttagactttacctgacgacacacgacagccatttgaaacgatctggcttctaataaaaataagacatagagccctaaacacaatttgggaagaaaaccaagaggtcatcaaaatcacaggatatacatgacagtggatagggccacttggcttctcctgtggctgagaaagatttaaaaacaacctgggaatatcagtgaaatttatttcaactaagaattgatgcaaacaactgtacactagataaaaaagaagtggtaatttgaggaaaatgtattatatttgtgctctagaataattttgtttataaaattttttgacacatttgaaaacttttatctctaattcttaataatgaaatgctaataattcatacttaatatacttaatgacaaaatttacctaatacttaatataatgaaatttatcctcagttcatgtgttatcttctcagaaaggccttcccttcataagtagcgtcactcaagaggtacaatcaaatccccttgctttatttcctgcagattattatctgacacttttttgttcacaatgcatccacttttctgcttacatttgcctcctctctctagaatgtaagctctgttagagcacagctgatatggtcttattcactgctttgtctgcaaccacccttagcagagtgccaacccttagtaggtatctttgtagaatgaatcaatgaacacaaaatcaaaatattattgcttgacttaattccacctttgatctcctcccccaatgatatataaaactttataactggaaaatttgttaattttatttctattctagaagtcttactagatttaataggtattatagagttaattaagcaagtgggaccagaaatcatattcctagataggaattcttgttccttcattttttttttccttctgcttgtgtggccttgggtaagctacttaaccttcttatgacttagtctcatcattaaaatcaagggattaatattaatattagctatgtcatagggttgcttgaagactcaaagtgtagagaatagtgtctgggacctactaagcacacattaaatgtaaattccataatgggttgaagtagtaaatgaggaagaatggtggcttaacaaaatgtgggattttctatcctctcaaagaaacagatggttttaggagtaagttatctgtacccagaggtgttcaaacagaaataattatccacttgatggagatattagaaagaagatttatgtatcagaaatccaattacattagataacttttaacagctccctttctactcttgcagtgctaagctcccattgtgaactgaagctgagaagtacacagtacacttcccagatgcaaagacaatgagcatttcagtctccaatatccagcagatgcatttctactattttcacaagggattcagtgtcttctccatacttgcagaacttcctgtttatctttcactatccatgtctatgttattgatctccccatgagaccacaaggaatcagggtggaggaacatgggaaatggagcacaggcattctgggagacagaacactgagagctatgcttgctcagaaggctcatggtaaagaaaattgaaggcaaacctgaaggggaggaattgcaaagactttgagatcttcaaataagtcaaaaacaaaacaaaacaaaaacactacaattcttaattagaaaggaagaacttaaatttatccaaactcaaagcagcccatattctactgtaagtggagggatatgacactggaaaccaactgacatttcccaaagtggtcctacagtaggaaagagttcaaggtgttcttccagatgcccaccaatacagccagcaaggagggtaggggtagggtggtgagggctgtggaaaggggtgcacccacatgcaagcagatagtaatcatgcctttttaaaaaagaagagagacctgaaaaatctaaatccaggtgcagacttgagaatgagaatgagtcaatgggcttctacatgtacatcatcagaacattatctgggatattcatgtccttgacctgtacaaaaaattccaaaacacctgctataccagaaaagatcagttaaatgacattctactttaatatttatgttaactgggttttatcatattcacattgtctaaaaattagcaatttatgtgtacaaagttagttgacactcagccatttggggtttttttgtaaacagtggacacttttgtcgccaacaagtaatgttacgtagcattcacagacatagtatgacttaattctcaccagtcgtaaatttggagcagcttctctgtgaggtattttcaagtgccgaccagaatagctgcactaagaacagttcttgtatgctcaggtgaatacctaaaaatacacacttattcttctttctacagcagtgaaagccattttcacctcccctacaaaagactttgatgtcagtgtgtgtcagcctcagttaagctgttgcaaatcctatatacacatttggggcagttctttcaaattctgatgagctagccaaaaattgcttcaaaaatgttacagtccttcctcactgtttgcacgcaattattggtaagctcattctgagttcaaagaacttcaaagtttatttttataggtaaggttacagcctctcttaatagaattctcattttgtactgtatgtacagaaatttgcttgagtctttagaagtttattttagaaacttgagaagttttaaatttacacatatgttatttagtaagtcatatttaaattcaagaacttgtcaatttaatatagtttgtcctttaggagattaattgaagcaggtggtaatgaaagttaggaccttgtgttgaaatatgatagatgaatttattttaaggctattggaagagctagtttatttgctataccttgtattctcttatacctaaacatagagcaaaatggagagatactcaggtatctgacctaagttattttagcactacctgattctttttttttttttttttttttttttgagacggagtctcactctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcagcctcccaaagtgctgggattacaggcgtgagccaccgcgcccggcccactacctgattcttaatggcttcctctggcatcaatatttcatcagttttattccatccccaaggaggaaaagtccatttcttacatatacaattaaaaatcattttctaaaaagcttaagtcttagcacaagacaaagaattatcatacaagtgacacaaaaaagttttaaaaacattttccaaacatcagcggttattgattacgagtgatactttccctactctcctagtgggtatttttgattgtcaaaatgagctggaagactctgttggcctttactgtgcagaggagccagggatgcaaaacctcctgtaatgcacatggcagccatgaacaataaaggactgtgccaaccaaaatgtcaacatggggatacaagagaaaaatacagaaaccaattaatagcaggaattatttacctctttccatttgtgatcaatcaagtagatttaaaaaaaggaactatacagagtatccaaataacctaactaaaatggtaaatcatatatagtatgttctacatgcatgtatatatcatatctgcaccctggaaacacagaacacaccttcttttccaatatctacaaaacaggcacaaaatttgaaaatctattatgccacaaataaaacatcaataaattccccaaaaaagaaaagtatagaaaacattcttgtatcatgatacaataaaactatcaatatctaacaaaactagaaaaaatatgtcttatcttctgaaaattttaaacttccctcataattttgaggtcaaggaagaaaaaaattaataacatgcagaaaataacttttaaaaaaaatccacaggatagctaaagtcatgctgaaaggaaaattcatagatttaaacagttgattaataaacatgaaataataaaaactaaattaaacattccatccagggagttaaaggaaacaaaactacagaaagcagaaaaagtaataaatatacagaaatataaattaactgaaagtgtcttatttattttcaataaataaattgagaagctggtacctaattagttcaccaaatcaagggggataatgaaggaggctaaaacaattacacaaaataaaaataataagagccagataataccaacatggaagacattttatttctttttctttttttttggagacagggtctcactctgtcacccaggctggagtgcagtggtgccatcatggctcactgcacactcaacctcccaggctcatgggttgctcccacctcagcctcctaagcagctggaactacaggcgcacaccaccacacccagctaatttttaaattttcttggaagagacggggtcttgctatgttgcctaggctaaagacctttttaaaaattataattgattcctttgctcaactctgtgcaaataatttcaaaacatggataaaggagataattttctagaaattattgtatgtcaacctacttccagaagagagagaaatattacactaattatcacacaaataaagaagattgttagagttatcccccaaactggacacacatgcacagacagacagacagacagacacacacacacgcacgcacacacacagcctagatggtttcatagcacaacttgccaaacctttcaaataacaaaaaattccaatgccatttaaactccttcaaagcataagggaagaaaagactaggacagtttccaagttctttttacaaagcaatagtaacattgataccaaaacttgacagattgtaccaaaaagaaaattatggagcaaactcatcttggaatagcaatgctaaaattctaaattaaatattgacaaatagaatccaacagcaattaaagtaatacatcatgactgagtgaaatttattttattcaggaatgtaaaataaattttttaaaaagaccaaaaacttagaaataaatctatcaacaccaaattactcattatggcattcaaagccttttatagatgacacagttttctcttccacattaatcccactatttcaatgacagtcaaacactattactcactttttcttgtacttatgctatttcctatcccttaacctccgctaattttgtatctatgtttggaatgccatctgtctaaacttcctcccagttctaaatatcctatctacccataaaacccaatctaaatattaactcaaaaaagcttatttgattctccctacagacacctttcttctgctgaacaaccaaaatgctatctttcttgcagcactcattatatattttttaaaaacatcaggtcttctattgtcatcaagtaaacacttgttattttcagccatgtattacagatatttgtgtaaaggctctacatctcctatcagatataaacttttcttttttttttttttagggtaagggccatgtcttatgtacctttgtattctaatcactccaagcacaaatctttccatacttaaacattttgacgcacgagcacaaaaaaacccagattgtaaaagcaaactgaagacttgcgaagaatagtttccccttaaaatgtaactgcatgtgcacaggatgaagagttagaatctgaaaatcagctgggcactagccatgcctgccctgctacctttccatagccagaatcacagcagcatgaactgcactcaagctccagaccaagaaactctaattaccttcagcgagcaagtaaactgacagtaacagctattgcaggaggcaaaagcagctacaaccttcaattccaggcacggaggtgggaataaggaaagaagtcgggatggaactgttggtttcattaggttgttggtttggaagcaagtatttcacaaacacacccatccccccactatacacatccatccgcttcatattttcatttctcataatgccaaaatattaacttgtgttctaatatttcagggaagatgtataagctagtgagagtcataatgtcgagtttcaaaatgcatgtataatttgttatgcgtggcagggtgaacagtcctatcagaaatgcacctgaaggtttgctaggaacagaatattaaacagagcagagactatgggatctaacgtgataaactgacattaggttagaacagtacaaaaatgccacattccaaccactgttgatacacttctggagaagtggactttcaatataaagcagttattctaggtgcaattttaatagcaatgaaatacaatgaaatgacaaatctctggttcattctgaatacaagagttcctgcttattttgagaccatgtgaatcaaagaagtcgacatcaccagcactttgcttgtaggctaatctagtagtgacttttgatttcctgctccccctgttgatccatccatccacagctttaagaccagcctgactacaatcattcttcatgtcaccaaaatctccatccgcaggcaagaaggagatacccagctgtcccagtttgttaccccatcgcaagcacaaactgggatcactttctccaccccaactgtggtaggctgaataaaggcctcccaaagatgtgaacgtcctaatccccataatctttgaatatgctatctcataaggcaaaaaggattatgcagatgtgattaggttacagatcttgagatggggagattatcctggatgatcctatggactctatgtaatcacaagggtcctataaagagggaggcagaaaaatcagtgttacagtggcttaatgtgagaaagacttgactggcaattgcaagttttgaagatggaagggggccatgaagcaaagaatgtgaacagcctttaggagctagaagaggaaagaaaaggttctgccctagaagattgggaggcagggcagccctgctgacaccttaattcagcccattgaaaccggtttcagacttctgacttccagaattgtaagataacatatttatattgctttaaggcactatattggtggcaatttgttacagcagtaataggaaatttagacagacaattctgttcttggtctatagcaccacctcaaagcatccttattcattgatcgctcacagttaaccaccctgccacttgacttgccaagacctattgattctgtctcctaaattcttttaagttttgtttttctgtttttgttttttgagacggagtctcacactgtggcctgggctggagtgcaatggcgcgatctcagctcactgcaacctccgtctcctgggttcaagtgattctcctgcctcagcctcccaagtagctgggattacaggctcctgccaccacgccccattaattttttgtatttttagtagagacagggtttcactatgttggccaggctggtctcgaactcctgacctcatgatccgcccacgttggcctcccaaagtgctgggattacaggcgtgagccactgcacctggccaagttttgttttatttttattaacaaactaataacaattgtttatatttatgggttacaatgtgatgttttgatacatgtatacattgtgaaatgatcaaatcaggctaattagaatatgtatcatctgaaatatttatcatttctttacggtgagaatgtgtaaaagcctatcttttcctaaagcgtctatgttccatccatctttccttgtctccacagctactctctgagagaaaacttcagcctgtggctccttactgttctccctacgtctgctcaggccactcccttcgccaaccccaagctgggcaggccattcaccaaactgccccagagggtctttctaagacataaatctgaaatatctcaagacaaatggcttgccattgacagcagaatgaaaatcacctttctttacctgataaaatatctttcacagtttgacacctacctaggcatccaactgtaatgtctgcttcctggtcaaacttgctgcttgaccagcatgacattcatacctggtgcttcaacatgactctgtgcctttgtctgctgttctctcactgctcctctaactgacaaacccctaaatatctttcagtactaaaccaactgtgttggcgggctcttgacagtgagctccttgagggctgggacctctcttcatctctttgtctgcagtggctagctgaggcctccctctgaatgaagaggagggggcaagacttcctttctcataaccgctagcctaccttctttcctgccacattagcttacttttactttcagctcatatttggctttggaattactttcagaattagcagttgatacccgcccagtcagacaccatgtcctcacactcctgtgttttcagtgagcaggtgcaagatttaagaaatagtaaaagaggcggtggctcacgcctgtaatcccagcactttgggaggctgaggcaggtggatcacgagatcaggagatcgagaccctcctggacaacatggtgaaaccctgtctctactaaaaatacaaaaaaaaaaaaaaatttagctgggcgtggtggcacgtgcctgtaattccagctactcaggaggctgaggcaggagaatcacttgaaccagggagttggaggttgcagcaagccaagattgtgccactgcactccagtctggcgacagagcgagactatctcagaaaaaaaaaaaaaaaagaaatagtaaaagaacaatcagctctgatatcctggccacttcatctaatgctaagaccttcattttaaaagatagatttagggtaagaagcacttgtcagtctcaattttgctccagatgaggacccacgcaaaactacttctatgctttcctttcttggttataaagaattccactttctttcaattttcagcatagataagttttttactttcaaatcatccattacttttctctggcccatctccaatttcctaatattgtgtttaaaatatggagctcaaaattaggctctaacatagaccttatcaatggtgaacacagtgagtaaatttcatggttcttgtgtactacatacattctggttaatgcaatcccagatcatgttcaccttcttgataacagccctatattgctgacacatatccctgacaggtgagaatggctttttacctatagagtacttacatgtcaattccaatctttatgatggctaggatagtctatcagtatattttttctggaataataaaaacatcacctattgcaaagagctgtctaatgcactgacagtatagctcatcttgacttgatgttccacttcataattggaaccattagactgaaatcagagcttctgaaaattctctgagttttatttttaaacatgttatatatttatgtgggtacataacaatttcattcaaagtaaaaataaatacagttattcttcaactattagttgatacaacttcactttagaagccataaatatcagaaacaatgatttagataaaccatgtggaaatagttttaggaggtatcctccaattccatttatggaattctctttgcattttccaaaaaaaaaaatctataacaggaaagacagttgaaggcagagactgcattttaagttatctgcctttctaacaaagcaatggaaagggagacccaaattatgcttctgaagtgaaacgggataagcttagcaaaaaatttcatctctaattaactccttaaaaaatttcagtccagattaagtatatttctgttaattaacatatatagttaatttcattttctcatattgacctagtaaaattaaagcatacaaatacatctaaaattttttgacatactttcatgacagattgaacattatcttattaaagcaaaatgtatagataagtgctttggagtgaaaacatctggatcatagtcttagtgcattcaatcactataagatcaaaaaagtcacattactctttaagatctccatttcttttacatgataatgacaatcagtaatcgtcataacgcttacaacaatctactttttccctctgatgtgagtgtggctgagaaatccatataacccttaaaaaaataatgaataagattaaaatacaaccctgtaatgtggaccagtatgatctctaaaatacaatctgacacttcaatatagggaagttgaggttggaatttgaagttgaaagtcctactggagcctcattcccatacctcctagacatatggcctctgagccgtggtttcctcattactgtgtcagatagactacactagtttcaagtttttgttcttggaggtgaaattctgctcagatcctcaataaacaaatgatgaaaacagggctgctctggtgatgccaatgtggcagatgtggggcacttcgcatcctaacccttcattctatggccccagcaaaagttgcatggaacaaaattttaaaaccaatggaagcgatttagatatgattgttttcaattatcaagtcttggtgtctcttaaccatatgcacttgccagaggtggggtgagggagaagtggtattttaatggcaaagagcactggtacagatttggacttctaatccttggtaggctaaatattcaggaaagctctcctttcataaaacatttgcatgatggataaacagctaacttacagataaacacattgctgagctctccagaaaacaagggaagctaacaaaagatgaaacctacaaactaaaacaagaatgctaagcaaaccctgaagttgggccttccatgcaggaaaaaaatgaccaaaccaggaacccagagctttggacattaatggaaaaaaaaaaaaaaaaaaaaaaagcaaagggtctgcagaaagtagtgctgttaagtctgagaccctaaattcaacgggtactagaaacaacctcaccctcagtgaaagagagcaccaaaagccaatagcctgttgcagaggaaacagataggaagcctacctgtccctgcctactctcaggataaatatagcaagaaaataattgtctcccctcagaatctacaacagaagaccagatctcagatggtgtgaagtttatattacttggggtgtcaggaaaactctaggccaaataataactattatcaagatagggtgtcactctgtcacccaggctaaattgcaatgacacaatcatagctcactcagccttgaaaccctgggctcaagcaattctcccacctcgacctccaagtagccagactataggcgaatgccactatgcccaactaattttttatttttcatttttttggagagatgcagtctcactatgttgcccagtttagtcttgaactccaggcctcaagcaatcatcccatcttgtccccagtgcactgggatcacaggcatgagccaccatgcctggcccaggccaaataattaaataaaagctgcccttagttggctacttattgaagccctggtaccccaatgaagcacaggcaagtctattctgcaaaaaaaaaaaaaaaaaaaatccttaatatacatccctcataattcccacagattaagttcagccaagtatgagctcacaagcaaacattaatatatgtaggtgaggaactaagccaacagcaagctacaaatttgcttgatggcctcaggtattagcattaattgacatagaacagaaaatcgttatgctctaagtggctgaataaatgagaggaaaaattttttaatgatcagaaaatatccaatcagacaaaaaaataacaaaacagatgattttataaataaaaaagaaagcttttgaaacaaaaaactgaatgatgggttacaccacaaattagaactcacttgaaaaaaagattcagtgaactagaacaaagacttgaaggagcaaccccagattgcagcatagagtgacaaagaaaacagaaaatgtaaattagaggttatgaggcatgaatgatcgaaaatgagaaggaacacattacaattaaaattgtctttatccaaagacaccataaagaaaatgaagagttaatccacaaacatggtgaacataaaacccaaaaggatgttacatagaatacattgaaaaatgggccgggtgtggtggctcacgcctgtaacctcagcactttgggaggccaaggtgggcagatcaggaggtcaggagatcgagaccattgtggctaacatggtgaaaccttgtttctactaaaaaaacaaaaaaaattagctgggcacagtggcacgcgcctgtagtcccaactactcggaaggctgaggcaggagaatcacttgaacctgggaggtggaggttgcagtgagccgggatcacaccactgtgctctagcctgggcgaaaaagtgaaacttcatctcaaaaaaaaaaaaaaacattgaaaatgcctatgtatcaaaagataaagacaacccaacagagaaatgcgcaaatgtcagaaataggtatttcaaagaagaggaaacataagtggtcaaaaaaaagtatgagaaaatgttccaatagtaaccaggaaaacataaatttaaaccaggaggtatcatttgatactcaagattgggggaaattagaaaagttgtggtttccaaatgttgacaagagcacagagtattgaatacaggtgggaatttaaacttaacaaccactttacacagtaatttagcactgtatttgaagatacacatacccattggctaattatttcaatgactagatgtattatttcccagaaaaccatctgcacctatgtcttacagatatataaggtcttagcagcattatttgtagtagcaaaataaaaataaaaaacccaactatgaacaattcaaatgaatcaagagatcattaaaaacttctgaatagtcatacaatggaatatttcacagcagtgaaaattaattaagtgtagctacacaaattaatacagataaatctcagggataaaatgttgaataaaagaaaagccaaacagagtatgagtccctctatataaactcaaaaacacataaaacaatatattgtctacagatcacacatgtagaatacaaccataagacaacataaaaggcacagaaaggaggtttggtgggagagagatgaggggcagcaaactggagaaaagtacgtaggagacactccatttattggcaatggtctttagctgggcagtgcacacacaggtgttttgtctttctagtcttataatgtaagtacctgttacatgctttcttttatatgtatgtaatgttttgttaaaagtattaaaattctaaaaagagcattggagttgggaacgagcagcaaaccccagggaaaactggagctttggccagatttgtctcagacccctcccacctgcattttgtctcagccaattacagctcccatccacgaatactgccaaaggagtatgtgataatcctggtgttggcaaatagaagttggaggtaacttttcccatggaaactttgaaggcaaaagaccagcctggctttgacaccctccccaaaacagccctgtgccaggggacaccttctcacagcagcccacacacgactcagctccacaatgggggtgactggagggccagcctgtggaccacttacaagagcatcccagagcccctctagagggccagttacccctaatgatcacaatgctttctctatatttttcaccgtgtgtgctcaacaagctcctagtcattcaccttagttgaaaagacaaataatttgaccaactttttgactagatataaaatgtgaaaggagtccaacaatgcatacaagtcacacttcttatattactatttaaatgttagtgacttctgaatttaagaattgtgttactatttgtcaactaatcaatatgtttactgaaacactcagtccttataagcataacttagtgcatactgcaataaaaaatttaaaatcttgagcatctgggacatgtaaaatatgtgattaagtaatttatgggaacattcatgcagctttatttatagataatttaaaataccatcattgcattttttttaagtaaaaacaagtacacaaagaatagaacaaagaacagcttgatttattcttgtcagtaatagaatatcagtatctattagaatgtgatttaagttaattcctcaaaattagtttggttggattttcaatgtttttacatcagaatgcaaaacttattggtatagatttttctatgctgtaaatgctatcttaatgaaatatagaaggaagggaaggaaggaagaagaaattaagctttttctaaagacaggctatatgattcaactaagccaatttaacttaactgcattgatatttgccagattgctatcctcctctgcagaggaaggccctgaaaacactaatgttcatcacaaattctcctaaagtcacattaggatctgataaaatcaataattctttggcacattaaaaattgatctcaaggagatattgccttataattattcctttgccagatacccatacaaaaacactttcataaattgttaaggttttacttaatattctgcatccttgaagttctcaaaaatatcagtaactatcacgttagttattcagcagcaacgctgtgctagtatttcatatagtaacagaatacatgccaactaattccaagaactgcttgtataactggattaaaaatttcactaataattattgtagagaagaccagcagcctagagtctgacaaagattgttgtctggagtgacttctcatctgtttaccttcctacaggctttggagaccatttcactggcaatgaaggaattctactgattttgcccaaaatgcatcctcaggcctacctcctttcagggagaaggaaccaaacgaataaatgatcccatagcctacatcagagatcagaaataaaatggtttggaattgagggtgagtggggagagagtgaccttgagaagccactgcaggagggcccttctaggtctctgaggcaaccacaactcctccagctttgttttcttggttattctgtctgcagcgaaacccttaaaacaaaacaaaacaaaacaaagaagcccttcgaagctcacctgagaagtgactagaattaaggagaggttatggagtgttcgtactcagcaggaattcgaaaccatggaggtagccaacaagggcgccctcacccctgagggtccatttggatttgcaattctattcccccacccccaccctgccacccaatctctgtacacacacacacacacacacacacacacacacacacacacacacacacacacacaggcactccctttgaagcaatttatcaggctttcttctggggaaagtcttggagtaaatattagttttcttaacttatccttcttctattgacaatgacctgttttgtaccaaagaagctactgagtaatggagttatgaagcacgctaaaactgggagttcatccaggtaaagctatctgggattttgtgccagagtctaatcctcttgccctctaggtctggaggtatctctacaaggtcagggagatgtgctcctacctaagtgattgtctcttactgcgcccaacaacgccaggccccattgtgctcggaggagtgaagggattacaagagggcaaaataaactcttccaagatgcacagatacttcccttctaatatctctgcaccatccagagatactagcaaggaaggagaagttccctttacaatttggaatgcagtatccaggaatgtggtataattctttgatttgggtgataggtataaatagcagtggtaaaaacagcaagttacttctgtctacaaaccgaggtcaagtcatcccttcttaaaaaactgttagctggactgttcctgtctggtgtaatagtgtgaataaagattagtctgtacacatacatacaattcctcaaaatagtatcttcatataaggagagttatatttgtataaaagaacgtgtttgaaaattacaggcaatgtagcaacaattcctgaattattcttttgtttacttagcacttcagttcaaaaggctaattagttattttgtttaagctgaggaagaggggctgaggctgacatggaacccaaagtaactatctttggtttatatataggtggttaggatatatcaggcgctgtgtagccctccctttattatctcactgaattttcacaacaaccctgggaaagaggtattattatctccattttgtaagtgaaagaaacaaagagggagagaacttacttaatgtctcatgggctcatagctaactattagcaaagccaacattcaaacccaggcctaactccaaacctcacgaccgaagttgaaccaatacttattgggagatggtgcatgaggcagcagggagattcctggctcccattttccttcaagagactctgctgcaaggagcatgggtgatgaacagcctccagttgccatacctttgcatcaccacagctttcactccaagaccaagattttccagggcttctctcagcccatgtctaagcatgcgctaagaaggttgtcagaagtgaaaggctcaggcagtttatcagagaggcgggtggagatctggaaggacagtgctgtggatctcagatgcctcagagacaccagggctcccttggggtgaacccacagctagggagagatggtgccttagggagggaaagcggcatacctagatcagaaggagcttaatgtaccagattttaagaggctgttaagtgagaagggaaaccgggacccaaatgaggtatagatattgaatgaatagaagtttgtagagtaatagcaggtagaacgaattatttacattttctttttctttggtgtctcctgttttcttcttcctccttgattatctaactctaatctccttataaaaaacatactcttgtcctttttctttcatcctccagtcagcagaaaaacataccaatgaacattttatttcttttttttattatactttaagttctagggtacatgtgcacaacgtgcaggtctcttatgtattagactttatgttcgttgttctccatacagattaattgaacattaaaatttttctttctcaagaagagttaactgctcttttaacatgtatcatggccctcaattaacattctttcatagggtcatagggtcaatggtaagaagagggtacacttttcactttcatcagaggtattttcataggaaaatactggctaacaagatttatcctataaaattaaaacactagtgaaaatcaaattcacttagaaaatatctatatacaatttcacttactaaaagagctaaaataaaggctaaggtttttcttaaagcaatcaacttcaggagctacttgcaaattagtgtctgttcttttctttaccagtcattagcctgaattggtacccaagtcatgttacgagaaaataaagacttacacagaccattttaaattctgtagtctcaattaccatatatgctcttattaattgtttctaagaattcctcttcaaaatgtgtgcaagtaacgcatcatatggaaaggcaactgagttttcatatacggcttaaaaatacaaacttcagaaacacagatgttataccaaattctcacttgcttactcccagctaaactcaatctctgagctttaaaaagattttctaaactgctaaagattaaaaaaatgacattatacattcacatctggctctgtcaccatttagggcatgttaacatagattttaaacatctggggacaggggaaaagatctatcgggagcttttcactaccatgacaactgaagtgtactgttgctcaaatagttcagtctctgctcatctacatttaacaccaccacaggccttccatttttcaccacttaaaaacaacaattatcataggaaataatactcatatgtagaaagttcctagggagagtgtttctttcatttccatcctgctttaatcctgtgggtaggacagatccttcctctttgcagcaatgcagttaaaccagtttatattttctggcttttagacatggaagtccttcctatatttttgagtcactcaagagatggctcttaatgacaaagtcttaatggaaatggtgaaaataacctagcattatttttttctataaagcagcatcctttctgtgtgttcaaaatttaaccaacattctaaagagcatagaatatgggcaataaaaattataggtttcatgtgttaatgttttctgaatggcagatgtacaacatactttagacatactatttttcatttattcttcaaaactacctgtagttagtattattactttggaaaattaaactatggagagaggtacaacattcacacaaccatgtattaagtgcctatgcttgggcaagtgctgtgctaggcaacaggaatgtaatggtaaaaattacagcatgccccaccctcatggagtgtatcagtctgttctcacacggctctaaagaactacctgagactgagtaatttatgaagaaaagaagtttaattgcctcacagttccacacgcttaacaggaagcatggctgggagacctcaggaaacttacaatcacgtcagaaggcgaaggggaagaaagcatgtcttaccatggcagaacaggagacagagagagagagtgggggaagagctatacacttatcagataaccagatcttgtgagaactcactcactattatgagaagagcaaaggggaagtctgcccccatgagccaatcacctcccaccagggccctcctccgatacgtggggattacaattcaagatgggatttgggtggggacgcagagccaaatgatatcatggagcctaccatccatggccaagaaagggaaacaaagggccactgacaggtgggaatggaatctaaatctgacttcaaagcaaaaaccaaaacatcaggtctgactgacttctaaaccaaaagccttgaagtcacctttgactcacctcttcctgtcacacacaatacatccaatccatcagcaaatcaggctagctctggcacaaaatcaatccagattacaaccacatctaaccacccaggtcaaaatcacaaccatctctcacctggattattacctccattcctaactaatctctccatctctagccctttctctatttattctgttctcaagagacagccatctgggtcttgctaaaatgttttgtcagacatgtcactcttctgctcaaaaccctgcaaagtctcccatctcactcagagaaaaagctgagtccttacatcagcctgcagggccctatacaatgtactgggtcactgtatctcccactgctcactttcttgctcactcttttctggcccacagtcttctctattgttcctcaaacatatctggcctcttctcatatcaggagtctgtacttgctgttccctctgcctagaactctcatcccttccgaatggtaccagcttagcaaggcctatcctgcccatatttatgacagcaagcctcctccagcatgccctattctcccttccctgcctcatcactctctgcagtacaaatcaccatctgacatacactttacatgttgaaattgttcactggctgcctcttgtgtctcccggctctacagagctgactgtgctcatctcttcccagctcccatccattgataccatattgctagcctgaaatcagctgtgatcagcaaacactacaaaataggcctttaaagaaaaaaaaaaaagacagccaaattagtgtatagcactctcctcctaagaacacatagccccctccaacaagaaaatatgctgcatgaagcagagtttttgtccattttgctccatgctttctccacagaaccttagtgcttggcacatcataggaacaagataaatgtttgttaaatgagtgaacatttctcctatcctcaagcagattgaaagtactagtatcagaactccaaaccttcattttcagaactgctctaagcatgttctgtggtttagaaagcgtggccattttcctgaacctactccatctgttcctaacgggggctcctctccacttgcatggtctatgggcagaagacacaaggattgccagtgccctccagtctctgcacatgcctctaactcacagacggcaaagcagtaaattgggaaaagcctgacaaaactgttttttcatttttattgtaacttgttaaaacaaatattaaactacagatgatacagtgtgctatgttcaaaactgtagaaaaatgtgtgttaaaactatgggtcatgtttaagaagacccctttaaaaacacgttgtttagaaagtaaaaattttttttaggatccaaggagcagtttaacagaggctctaaaggaaagagcaaactgataaggatctgcagaggaaacatgttattctgtcacatacatggaggataactctttggtaagtaaaagagaaagaatgtcactgacccacgtaaatgtgttaacagtgccttaattcaattgaagtgggaattctagaatgttcgtgagcttggtgaacatgatggagggaagaggtctgaattctgtggtgcaggtgggagagtctgtgattaagataacaatcaaagtattgaactaggagaaaagagggaagaggtttaatagaaccctccaccaatcatgcttccttcaggaacacaaaattggacaactattcacacccaaaaagcacctttaaaagaaccaaaaatcacagtacctggttttaaatttatatcactgaaagaggcactgaagaggatataaaagacaatattgaattcctgatgccaccccttcctcattccatggcagtacatcccaccatcgctgcactctccctcccctaaacacacttgggaaagggagagtgcagtgatagtgggactttgcattgaaactcagtgctgccctgtcacagaggaaagcaacactaggcagaactcaactggcacctacagagggagcatttagaccagccctaaccagagaaaaatcattcaccccagtggtcagaacttgagttccagcaagcctcatcactgcagactaaagtgctctacagatctcaataaacttgaaggcagtctaggctaaaaggactacaattcctgggcaagttctggtgctttgttgggccaaaagtcagtggacttgagatgcatatgacctagtaagacaccagccagggcagccaaaggagtgcgagtaccgcccctccaccaaccccaggcagcacagctcacagctctgggaaagactccttacttctgcttgagatgagaataaggaagagtaaagactttgcaagtccaagttcaggacttgcaacttggatactagctcagccacagtagacaagggcaccaggcaaagtcctgaggcccccattccaggccctagcacctgaatgacatttctagacacattctgggccagaagaaaaggacccaatcttgggtaattcatcacatgctgactaaagagcactttgaccctgaataatcagcagtaggacccaggcactactcactgtgagctttgggtaagactcagagacatgctggcttcaggtgtgacccagcatattgccagctgaagtggctatggggaaggaccccttacgcttgagaaaaggaaagggaagagtaaaggagactttgtcttacagtttaggaaccagctccgtcacagtggcacagtgggatagagcatcatgctggctcttgtggttctcaattccaggtgttgactcttgcacggcatttctggaccagcactggccagagagaagttcactgccctgaagggagagttctaggctggctgtatccaccacaagttgaacgaagagcccttgggtcttgaaggaacaatggtggtagccaggcagtactcactgcagacttggggcagtggtaaccatgaggagagactcctctgctggtggaaaggagagggaagattcaggaggactttcccttgtggcttgggtgccagcttagctacagtagaatagagaatcaggtagattattaaggtttccaactctaggccctggctccaggacagcatctctaacctgggggggatctttctgccctaacaggaagaacacaaacttggctggctttaccacctgctgattgtagagccctaaggccttgagtgaacacaagtggtatccaggcactggttaccgcaggccttcggcaagacccagtgctgtgctggcttcaggtctcacacagcacaatcccaataatggtggccacagggatgcttatgtcacccctcttccagctccaggcagctcagcattgagagagagactctgtttgtctgggagaaagtaagggaagagaagaagagtctctgcctggtaatccagagaattcttccagatcttatccaagaccaacaaggtgatagctctctgagtctgcaagcgtcacagcttgggcttgggttaccctctaatgcagatatggctgcaaggaccaaaaacttataacactaacatcttttcaaatacctggaaaaccttcccaagaaagacgggtacaaacaagcccagactatgaggactacaataaacacctaactcttcaatgacaagactggacgaatacccacaagcattaagaccatccagaaaaacatgacctcaccaaatgaattaaataaggcaccagggttatatccaggggagagagagctatgtgactattcagacaaagaattcaaaacatctgatttaaggaaagtcaatgaaattcaagatagcacagagaaggaatttagaatactgtctaattaatttaacaaagagactgaaataattaaaaagaatcaagaagaaattctggagctgaaaaatgcagttgacacactgaagaatacattatagtctcttaacagcagcattgatcaagcagaagaaagaattagtgaccttggagacagacttattgggaaatacacaaaggagacaaaagaaaaaagaatcgaaaagaatgaagcatgcctacaaggtctggaaaatagcctcaaaagccaaaagcacaaacctaagagtcattggccttaaagaagaggtagagagaaagagagataggggtagcaagtttatccaaagggataataacacagaactttccaaacctaaagaaagatatcaatattcaagtacaagaaggttacagaacaccaagcagatgtaaccaagataaggtgaccaagacatttactaatcaaactcccaaacgtcagggataaggaaaggattctaaaagcatcaagaggaaagaaataacatataatggagctccaatacgtctgctggcaaacttctcagtggaaactttataggccagaagagtgtgaaatgacatatttaaagtgcttacagaaaaaaacttcttatcctagaatagtatatccagtgaaaatatccttcaaataggaaggagaaataaaggagaaataaactatacaaacacatggaaattagacaataagctcctaaatgactagtgggccaatgaagaattatgaaggaaatttaaaaatttattgaaacaaataatatttttagaggaataattttattgtagaagagtcttatgtaagcataagagcaaagaaagatcccaccaaataaataagcattatatatgattacataaaacataacatttcaaaatacatgcacacacacacatcacaatatacatgacagagaaaagactaatatctttactatatgaggatattttataaataataaaaaaggtaaatacatcaatagatcaatagaaaacctggcaaaagatataaacaggcaactcactgaagaagagctagaaataatatatggtaaaatggatggcaaatatatgaaataattttaaaaccttatttgtgatcaaatgaaaatttcaataattccaacacatttatcatatgatatatatacacacaatttccacatttatcttataaaactggccaacatttttatttttaatgaatatgcccagcacttaataaaaatgtaggaaaatgaacattcatgccagctcatggaaatataaattggactaaccattctaatccacaatttgacaataaatataaaagccttaaaatgtattctgtatgaagtaggatatacgttaggatatcagattctcctagggataataccaagggtttgaggagatgatattcactacagcatcatatgtaactgaaaaaaaaggatagggcaatctaagtatccagtagccaaaatgtccaaaccaatcatgaaatatgtgcacaggattggaataatatgaagatgacacaaattaagtagtagacaaacacagtgaactatggaaacaattgacagtgtatttctaagggaaaaagtatcaaaaagtacatgctatcattcatttagccaacacatcgagtgctgaacttaattatataaataataacagcttatgtgtatatgtaaagaaaatacagaacagacataaggataataatattacctttaagtgttgaatattataatgaagatgatggaaatcatccatcatctcactattgttcactgtaataaacgtgtaagactttggaaatcagaaagtaacaagttataaggaagttataaggtgtcatgctttaccatatcttacttttttaaacatgccatgctctttcaatatgtcatgctatattgtcatgcttttccccataagttataatatgtcatgctttttattttgcaaaatcccttctcctaagagtttaataataatgataccaatgggatggcaaaatggttccagctgcttttttttccttttatttattttatttatttatttattttattattattatactttaagttttaggatacatgtacacaatgtgcaggttagttacatatgtatagatgtgccatgctggtgtgctgcacccattaactcgtcattcagcattaggtatatctcctaatgctatccctcccccctccccccaccccacaacaggccctggtgtgtgatgttccccttcttgtgtccatgtgttctcattgttcaattcccacctatgagtgagaatatgcggtgtttggttttttgttcttgcaatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgctgcaataaacattcgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaatagtgtaaaagtgttcctatttctccacatcctctccagcacctgttgtttcctgacttcttaatgatcgccattctaactggtgtgagatggtatctcattgtggttttgatttgcacttctctgatggccagtgatggcgagcattttttcatgtgttttttggctgcataaatgtcttcttttgagaagtgtctgttcacgtcctttgcccaccttttgatggggttgtttttttcttgtaaatttgtttgagttcattgtagattctggatattagccctttgtcagatgagtaggttgcgaaaattttctcccattttgtgggttgcctgttcactctgatggtagtattgaaacaaataataaaagaaaaacaatacaccaaaacctcttggatacagcaaaagcagtactaaaaaatttttccccattcagtgcaatactagctgttggttggttatgacttttattgtattgaggtatattccttaatacctagatttttgagggtttttaacatgaagtgatgttgaactttatcaaatgcttattcagcatcaattgaaatgatcatatagtttttatccttcattctgttcatacgatgtgtcacattgattcatttgcctatgttgaactatctttacatcctggggataaatcccacttggtcatgatgaatgatcaagtttataagatctggaacatgacatcaatgcccactttcaccactgttattcaacacaactggaagtcctagccaaagcaatcagacaagaaaaagaaataaagggaatccaaattaggggggaataagtcaaattttttggttgcagatgatctgatatttggaaaaacctcaagactttaccaaaacactattagaaatgataaatttcagtaaagttgaagaatacaaaattaacattcaatgatcagtagtgtttctatatgccaacagcaaacaatctgaaaaagaaatctagaaagtaatcccatttacaacagctacagataaaatgaaatccacagaaattgtgtatttcacaaaaatgtgaaagatatctacaatgaaataaaatacataaaaatatgtattttacaaaaatatctacaatgaaaataataaaatactgatggaagaaattgaagagaacacaaaaaatggaaagatatttcatgtgcatgggctggaagaatcaatatggttaaaatgtccatactacacaaagcaatctacagattcaatgtaatccctgtcaaaataccaatgacattcttcacaaaaataggaaaaacaatcctaaaatttatatggaaccacaaaagatccaaaatagccaaagctataccaagcaaaaagaacaaaagtaaaagaatcacattatctgacttcaaattatactatagagttataataaccaaacagcatggtactggtataaaaacagacacatacaccaacagaacagaatagagaacccagaaacaaatccatacatctacagtaaacttttgacaaagatgtcaagaacataccttaggggaaagtacagtctcttcaataaatggtgctggaacaactggatatccatatacagaagaatgaaactagacccctattgctcatcatatacaaaaatcaaataacaatggattaaagactaaaatctaagagctcaaactgtgaaactactacaagaaaacactggggaaattcttcaggacattggactgggcaaagacttcttgagtaataccctataagcacaggcaaccaaagcaaaaatgaagaaataggatcacatcaagttaaaaagcttctgcacagcaaaggaaacaatcaacaaagtgaagagataacccaaagaatgggagaaaatatttgcaaactatctatctgacaagggattaataaccagaatacagaaggagctcaaacaactctctaggaagaaatctaataatccaattaaaaaatgggcaaaagatctgaatagacacttctcaaaagaagacatgccaatggcaaacatgtatatgaaaaagattctcaatatcattgaccatcagagaaatgcaaatcaaaagtactatgagatatcatgtcaccccagttaaaatgtcttttagccaaaagtcaggcaatagtagatgtttgcaaggatgtgaaaaaaagggaacacttgcacactgtttttaggaatgtaaattagtataaccactagggagaacaatttgggggctcctcaaaaaactaaaaatagaactaccatacgatttagcaatgccactgtgagttatatacccaaaagaaaggaaatcagtatttcaaagagatatctgcactctcatgtttattgcagcactattcgcaatagccatggtttggaagccctcaacagacaaatggataaagaaaatggggtacatctacacaaggagatactattcagccataagaaatgagatcctgtcatctgcaacaaaaatggatgcaaaggaggtcgttatattaggtgaaataagccaggaatggaaagacaaacttctcatgttcttacttatttgtgggagctaaaaattaaaacaattgtactaattgatatagagagtagaacaatgatcaccagagactgggaagaatagtaggagcagggggaaggggagtagttaatgggtacaaaaatataattagatagaatgaataagatctagtatttgatggcagggcatggtggctcaggcctgtagtcccagaactttgggaggctgaagtgggcgaatcattgagcacaggagttcgagaccagcctgggccacatgggaaaaccccatctctactaaaaaaaatagaaaaattagccgggtatggtggcatgtgcctgtagtcccagctacttagggggagtaccgcttgagcccaggaggcagaggttgcagtgagctgagatagtgccactgtgctccagcctgggtgacagagcgagaccctgtctcaaaaaatacatatatatccagtatttgacagcacaatagagtgactacagtcaacaataatttattatacattaaaaaataactaagaggataattggattgttcgtaacaaagaaatgataaatgcttgaagagatggataccccatttaccctgatgtgattattatgcattgtatgcatgtatcaaaatatttcatgtaccccttaaatgtgtacacttgctacgtaaccacaaaaattaaaaattaaaaaaaaaatcacagagtattggattaggccaaaagtgtgcatacagagtttgtgcttattgtgcatagagtttccttctttattaatgaagctttctgtttttcctttctttagagttatcaatataccctaagtaatttatttgtaaccgcatagtttgttggtaaaaagttccctacaattttccttattttcaaatattaccaatggcagtaagttaacacattcatgggagcaaagctacaaaaatgttaagtctggccatatagaaaaccctggcttgatgtgtgtttagtgcttaaaaatccccaaatatatgagatacattattacatatcatctgaccaacaattttgtagagcaaatattgcaaatcctgaatattataatactcattatatgcatgtagataagtataaaaactgaagctcacagaggttactgctcaccaattagggcaagtacagttgctgaagtcccagcctgcagactcaagaccctactgctctttctaatgcatgatgctgattctcttgaaggtaagtttggaatcttcagaggtatgtgttaggcatgggtagatataaggattctctgataaaacctctggtagagacatcctgtgaaatgtctgtggtctttgtctctgggtaatatctgtctaatcctctcttgagctcagggagttgcaatggcttaaggctggaagcaccaagtcactgagcagagaaacatccaggaacaggcatgcatgtatgatgcagaatggctgggaatcattccatcatgtgacaccactttacgatatcttcctttgttatgtgttcctgaaaaatactttagaaacatatcctcttcactaaagacatttcagtaattgactccttaattcaataaatgaaagcatcattattttgaggtctaagaatgggtacgagcatggggagggcaaagtgtcatttctggttgaatttcctgagaataagaacaccggactttaaacaatatgatatgactttttccccgaaactgaagttatttctatcctatttaatgtcacatatattttaactattatgtaaaaaacattgtgttagatgtcaaaggatataaagatgactgagatcatttcttccctcaaggaatcgccaatccaatgaaaagatgaaactcatctttctagaatacattttcccgtgtttatctttgaaagagtacactgaatattatacaacttcttcttgatgactgagggacatcattccaagccagctgatgttctgggccacaacaataagcacagctgcagctagaaatgagtgtgacaggagctcagggctactggtcataggagttaaccaagaactgccttctgccatctcaaattgggtggatgaggggctggatagataacagatataaataccctgatgtcatgattgctttttggtcttttccctttttcctcccatcctatatatgaaccaaagacctgcttcatgactaatgtgctttgaaccagcacaaaaccgccattagccatcagtgaggtatacaggtagcaacagctgaagacctttcctgtcgggcaccctgcagagtgtccaggtctgacctaaatgttactccttattgctgggcctcctctaacgtcagtgtcagctacccacctcctttcatcacttgaatttctaaaccaactggcatcaccccttctaagctctgccagttattctgctattcagaactctccgttctcaaattacaatgtgtataaaatgtccagcacagtgcctgacacagagcaggcactcagtaagtgctagagcccctttccttgtattttatagtctaatctttgatctgacatttttcctgtctctgtgtctttttacgatcaggtggatatacataggtacttctttatggttagcaaaccaaaaaatcacaatccattactttctatttgtatgtatctgtgaatgaagctttttttccttttacccctgcataagatacttcttaggttatctacaccttaataactcatttgcaactgtatagatagcttaaaggttcttttttattttcataaattttctccacccagtggttataatttaataaagtagtcactgtggctgtatttatattttgtaagtaatttatgttttggtacaatgaataattctggatgtgagttatgtgactgtgaatatacagtttgagctttctagaatctcttcactaccattctgatgctgcctcctctcatctaatgacaacaacctcatagaagagataaaagtctaagattcaaatctaaaaggcaaagcaattataaagtatagcacatgtagcatctaattatttttccacatataatgtcacacatgcaattggaaaaatgttcttttgttatttgtaacataaaccatgtcattttattttattttcacttccttgcagactctcattaaagcttgcacacatattattattccattgaaaagtaataacttcattattatggcataacaattaatgtaaggtgtatcaacacaaatatttaaaaggaccattacaaaagtaagaaaaacattaatctactactagggacttacttcattcatgtaagaaatttttccatcttctgtccatctggagaagagcaagataaattaatctttggttccaaacatttttagagttgttttatcaggaaataacttcctattttcccaagttttgaaattttgcaccttctcataagtataaaagaatctcagcatttcactttgacccatttcaaatttatatggcagatttccaaatgctgggaattgcaaagtgcctgttcttagcacatgatatctaccatctgccctggccatcaggatagggtccagatagttctccaacataatattgtaaagtcaaagtgctcttggcatttatgtaatatttttgcaacattttgcaggtgataaataaattgtaactttttcaaactgggactcatctaattacatgcatgggagcacttttcttgtgctgtgtattcaactgtgtatgcttgtacctgctcattcatcctccacacccaccccacacaatctgtccaactgagatttgatcatgtgaatgctgagaaaggctaaaggtttggtacccattcaaaatgatatttttaaagtacttattcaacatttattagatggagttggggaaaacttattttccattaagaaaagtatgtctctctttatgcttagttaacgaacaggattagttcacgcactaaatgaacatatcacttttatttgggtcagtctttcatttcacaattttgtggtttctcattaagggacagcattagttattcatattcaggagggcagaggtaactctcacagatatggttacaaagttacaaaatagatttcaaagttcttttatttactttcatgttgttaaaacatttcccatagttttttttttttttcagttcagttttatgacttaccgatccaggaaaatgcttggaaagcacagtaacaacttttaaacttaatattaaaaacaaataaaattgctcattgccaataaatatacctatgtaaaatactactcagtgtaagaatttcaactgacagtgacctgtcaaattcaggcaattctaaaataggatggtggtggttacactgtgcaaaatattcaatagagagagttcaggaatgccaataattttttgttattattatcaaaacattcaataaagatagttcaataatggcagcaactcttactgttatctccctcctatcccaccttgggggccttgtaataaattttgcttgcaaattgcctaagtgttatatgtggaaagctaagttaacaggtgtcatgtttcccatttataccactgatgttccaatgcaaggtgcccggggaaactgccatcccttaatccagctctgctcacccagacatacacatatacccatcaatccatctgttaggcattaagaattacaatagtataaagaacaatcctttggtgtacatatttaaatgttaaatatatactgaagggtttgaagcaaggatctggcaaacacgactgcatcacacatttggttcagccctgtctggatgtcagaatgcatccgtcattttggatttatgtataatgacagaaatcaagtcacgacccatgtagtctcaaaaggctacttagatgatgatgaagatccacaatactccctgaagtactgctgattcttcaactccattaagaatatacatctctgacattttaaatatcttaagtcagtgattttggccatctaggaaaaacaatgttgcagcatgtaatttaggtaatttcaacagagccagttcaatcttaaatcattatttctaatgcattctggcaatactttttttgtaaagtgaaattatacaacacttccagaaaccacagaatgtgacttaacaaccaattacttgtacagtttgcaaaacaagtaaacctcccagcagctgggagcttggctgagaggcctaggcttgcccttggcatggtaccttgctcttttctatgagttcacattgctttctagcctgctaatgcactggccttatgaacacagattccctaaatgctctccaagagtctgatatcacattcagggttaacacattttttcccttgttgcaattcagcagttttttacagtcattcatatccaaccaattgctgtcaacaggcatcttcacatatgaatgttaatagcatattattaaagagttcctggtaatttgttttgtgggtagagttgatgaggggtgactataggaagggaagccaaaggaaaaacatttcaactactctggaagctgacctctggaaagcagtcagagagaacagatgaaggagccaggcaagctctttttgaataagatggtgtgtattacagctaggaagagccaacagagtagatctcacagtgaccagcccagctaacagcagttgaaattgttagtcatgaaaatacagatgccccctgtatggattaccctcatattttctcagtcactagtttgagagtatcatatttgagagacagagtttttcttgataattgagaaagatcaaaaagggaactgaattttcattggcaaaaagactacataaatagaagcaacatctttgttggtgcctacttgtcatcagctagaaaggtccgattttttttgcaaaaaccttaggaacaggattcagggtaccttccaaaagcgaaaagtaaaggcagacttcagggctcctagaaagtttacatccaagaattccctataatgtaaacttgaaaattaatgctttttcctccacaagaacttgtttcaaaaagttagtctggtaactcattctcataaattgttcttagtatttttcttgcagattttcatgatatggttcccaaaataaatcagtagcaagcattatgatctgtgccttccacttcagcatagtactttgctccataaacataatataatgaacatttatgtatcactacctttcttacttttctttactcacttcatcatatcaacaaaatgtatttgatacacagttgcaaataaatattaagctttacattttgtaataaatatttctgagtaataaaaatgttccaactgatcaaaaaatttgatatttgatgatggcatttgaagagatgcatgtttattagctcaatttagccatttcacattgtatacatttttttaaaacgttgtacatgataaacacatacaatttttatcaattataaaaaattttgagtgttatatttgagtgataacaaatttagatgagttaacagaatacatacatacctccttaataaattttattgtttactagtccatcttcaaaagttcatcatattaactacagtcagaaattggttcccaaagttcattatatttattacagtcaaaaacagtttctaggaagtctattgtatttatacaattaaaaatgactcaactattgggtacaaggtttcttttaggatggtgaaaatgttctaaaatgatggttgtacaacctgaacgtaaatgaaaaaattatgtactgctgaactgtacactttaaatgagtgaattttatggtatgtaaattatatcccaataaagctatttttaaaatgggtcaatcaaggacactaagagttgtttatttgaaaagttcaaaaaaattgacaaaccattagctagatcaagaaaaaactcaaatcaaatcagaaatgaaagaggagggattataactgatgccacagaaattaaaaggataagaggctactatgaaaaattatatgccaacaaattagataatccaaaagaaatggattaattcctagaaacatacaacctaccaagactgaaccataaatagaaggtcttaacagacctataagtagtaagaagattaaatctactaaaataccaaaaattagccgggcatggtggtaggtgcctgtagtcccagctactcgggaggctgaggcacaataatcgcttgagccccggaggcggaggttgcagtgagccgccgagatcatgccactgcattccagcttgggctacaaaataagactctctcaaaaaaaaaataaataaataaataaaggaggtatatctcattttacccatttcattccacaataatgaaaaataaaagtgtcagctgtcctaggaatgcagaatataaaaggtggggcaacagggcatgtggtgctttccttagtttactttgacaataaaaactcctatctctgttgctgctggaatagcatttattggaaatcagcctctcaacagtcctcacccatcaggaacaggaatctgccattagcttgacagcatacagagcaccatatcagggttactatgggaagactctattgtggcatcagaaacacaaaaaacactggatacagttagtttctgttgacagtttcagaagaaaatcccacagattggacaggctgcctgctgaaagggttgtcactacacacagcatgccctgaaccctggaatgaagttacccctatctgtgtgatcaggaactgaacaactctgaggctctttttctaagctcttagattcctgcaagaacctcacacttacctcctcacctggctttggacctcaagctaaaagtgcaaacagtctgcctactttccccataaacatttccccaaaataaagggcttttttttttttttttagcacttgcttacttgtgttctcactttctctgtcttcctctccctccctccttctctccctgctcactgtcatcagctgggtcccaatccagtttctacacctacattcatgactaatgacccaccagcagcccctaagagccactaggctgtaatgaacattttcctaccagttacatgtggtaggtctgggaggagccccccatttccaatgagggtatgttaaatacagttagaatgatgcgggatgtggactctggagccttgctacatacaaaatgtggtctgaggaccagcaacaaggcatcatgtgagaacttgctaagtatgcagaaccttagaccccaccccagaactactgaatcagaacatgcattttaacaagatctcttggtgatctgaatgtacattaaagtttgaggagccttggtataaaatttgaatatattttgagagaagactgtggaatttggtgggggatggggaagtggtaggattcttatgtacagggctatttacagagaaaacaaataacattcattaaatactgaataatttactttctttaaaataagaggaataaataaatccaattactatatgtatagggccttgagacatcagtgagcttaaggaatcttcagcagtaaggcttaaatacctattcttattctttgtattttaataaatctgtttgcataagagctttaaattgtatcagtgacaagtaggtatgttttcataatggaataatagtgagcaataacgccccccaaaagaggcggagcaaggcataagtaaacaaaatgtatgtgtgtcgcatacatttcaacaggtgaatccagcatggcatgatggaaacttaagttccggggcccacacaggccccttccaaggaccaggaactaactttgcattcaaaattttgttctctcttcttacagacagcctcaaaaattacataatcttaaaacttcacaaaacctggaaccatgcctgatctaattaatcatgaaaactcttcttaagtttattattattattataatactttaagttctgggatacatgtgcatagaacgtgcagttttgttacataggtatacacgtgctatggtggtttgctgcacccatcaatccgtcatatgcatcaggcatttctcctaatgctatccctcccctagcccctcaccccccgacaggccctggtgtgtgatgttcccctccctgtgtccatgtgttctctttgttcaactcccacttatgagtgaggacatgcggtgttcagttttctgttcctgtgttagtttgctgagaatgatggtttccagctacatccatgtccctgcaaagtacatgaactcgtcctttttttgtggctgcatagtattccagggtgtatatgtgccacattttctttatccagtctatcactgataggcatttgggttggttccaagcctttgctattgtgaacagtgctgcaataaacatacgtgtgcttgtgtctttaagtttgacattatatatatatatctatatagatagatatctatagatctatagatatctatctatctagatatctatatagatagatatctatctatctatctatctatctatctatatatatatatatatattttttttttttttttaggacggagtcttactctgttgcccaggctggagtgcagtggtgtgatctcggctcactggaacctctaactcctgggttcaagcaatcctcccacctcagcctcccaagtagctgggagtacaggtgccgccaccacacctggttaatttttgtatttttagtagagatggggtttcgccatgttggccaggctggtctaaaactcctgatctcaggtgatcctcccgcctcagcctcccaaagtgctggggttacagacacgagccaccatacccagccgacatataatatttttaaatcctttcaatacactgggaaacatttagaattatatcactatcattcaaactacaaatgaaaataacaatttaattgacacatgacctaggaataattctgctcatgtgtaagaaaaactgtttgtaatgatatggttcatatcttactcttctttccatgttatcatttaacatgattaaatttaacaaatatatcgtttgttgacatttctctctcttcccttcttcttttcctcctattttaacttaaaaacctaactactgcagaggtggggaggtactagaggaaatatccaaaaatgttcctcaggaatttttgtttaattttgttttattattttcctcaggtttgaaactcatatctacttacattttttaaagaatgcaaaaggtaaaacaagtaaacacacacacacacatatacatacatacacatattaaaaagataaattctggtgacattttagtgactagtatttcaaactatttaggtaagatgttaacagtgtggttttgagagttacatgtgagtgtatgtatgaacatatacataactgtatgagagagagatctagaaattgctgtcctgcccaccaaaccactgatacacctttttcatacagttaaagtagctgtgcctcatcatgagctagaatgtattccgtatgtatggttatcaatataaacaatctgccaatgctgggcattccgtgtgtttctgattttcattttataaatgaagctgctatggatatccttatgcacgctccctcttgctctttccttattttgtcctgaggacaaatccctgttatgaaaattgcgggataaaactttggaacacaataccagtgtgccttctgaagagtttcatcaatttacagtacaatcaaaagacaatttcacttttaaaacatcatttgctaatttgagagacaaaaaagtctgtttttgtttatatgcttactttttaaacttttaaagtaaaatacacatacagaatagcacacagcttgatgagttgctgttaatttattcctttttatggctgcatagtattccatggtttatatataccacggtttctttatccacttgttgactgacaggtatttgggctggttccacaatttcgcaattgtgaattgtgccactataaacatgcatgtgcaagtgtctttttcaaataatgacttcttttcctctgggtagatacccagtagtgggattgctggatcaaatggtagttctacttctagttctttaaggaatctccacactgttttccatagcagctatgctagtttacattcccacaagaagtgtagaagtgttccctgttcactgcatccacgtcaacatctactggtttgttgttgttgttgttgttgttgttatggccattcttgcaggaatgagctggtatcccattgtggttttgatttacattcccctgctcattagtgatgttaggcattttttcatgtttcttggccatttgtatatcttcttttgagaattgtctattcatgtccttagcccactttttgatgggactgattttttcttattgttgagttcgttgtagattctggacatttgtcagaatgtatagactgtgaagtcctttgtcagatgtatagactgtgaagattttctcccactctgtggtttgtgtgtttactttgctaactgttccttttgtcatgcaaaagctcttcagtttaattaggtcccagctatttatctttgtttttattgatttgcttttgagttttggtcatgaaatccttgcctaaaccaatgtctagaagggtttttccaatgttatcttgtagaatttttatagtttcaggtatcaggtttaagtccttagtccatcttgagttttgtataaggtgagagatgaggaaccagtttcattctcctacatgtggctagccaattatcccagcaccatttgttgaaaagggtgtcctttccccactttatgtttttgtttgccttgtcaaagatcagttggctgttaagtatttgggtttatttctgggttctctattctgtttcattggtctatgtgcctatttttgtaccagtacaacactgttttggtgactatggccttatagtttgaaatcagatagtgtgatgcctccagatttgttctttttgcttagtcttgatttggttatgagggctctttttttggttccatatgaattctagaattgttttttctaattctgtgaagaatgatggtggtattttgatgggaattgcattgaatttgtagattgcttttggcagtatggtcattattcacaacattgattctactcatccatgaacatggaatgtgtttccatttgttcgtgtcatctattatttctttcagccatgttttgtagttttccttgtagaagtctttcaactccttggttaggtatagtcctaaattttttttttttttttttttgcagctattgtaaaagtggttgagttcttgatttgattttctagccactgttggtgtatggaagaactactgatttgtgtatattaatcttgtatctggaaacttcgctggattcttttatcagttctagaacctttctggaggagtccttagggttttcaaggtaaacaatcatatcatcagcaaacagtgacagtttgacttcttctttactgatttggatgccctttatttctttctcttgtctgattgctctggctaggacttccagtactatgttgaagagtggtggtgagagtgggcatccttgtcttgttctcatcttgtcagattctcagagagaatgctttcaagttttccccattcagtgttatgttggctgtgggtacgtcttagatggcttttattacattaaggtatgccccttgtatgctgattttgctgagaattctaatcataaaggggtgctggatttttttcaaatgcttttttttgcatctatttaaatgatcatgtaatttttgtcttaaattatgtttatgtggtgtatcacatttattgacttgtgtatgttaaaccatccctgcatccctggtatgaaacccacttgatgatggtggattatcttttcgatatgttgttggattcagttagctggtattttgttaaggattttggcatctatgttcatcaaggatatcggtctgtagttttcttttttggctatattctttcttggttttggtattagggtgatgctggcttcacagaatgaattagggagggttccttctttctctatcttgtgaaatagtgtcaaaaggattgggtatcaattcttctttgaatgcctggtagaattctgctgtgaatcgctctggtcctgggcttttttgttgttggtaatcttttaattacaatttgaatctcactgcttgctattggtctgttcagggtatctaactcttcctgatttaagctaggagggttgtatttttccaggaatttatccatctcttctaattttctagtttatgtgtgtaaaggtgttcacagtagccttgaatgatcttttgtatttctgtggtgtcagttgtaatatctcctgtttcctttcttagtgaggttatttggattttctctcttttcttgattaatcttgccaatggtctatcaactttatttatcttttcaaagaaccggcttttttttcctttatcttttatatttttttggtttctatttcatttaattctgctctgatcttggttatttcctttcttctgctgggtttgagcttggtttgttcttgtttctctagttccttaaagtatgaccttagaatgtcagtttgtgctctttcagtctttttgatgtaggggttttgggttatgctttccttttagcactgcttttgctgtatcccaaaggttttgataggttgtgtcattactgtcgttcagtttgaagaatttttaaatttccatcttgattttgtttctgacccaatgctcattcaggagctggttatttaatttccatgtatttgcatggttttgaaggttccttttggagttgatttccagttttattccactgtggtctgacagagtgcttgatataatttcgattttcttaaatttattaaggctcattttatggcctatcatatggtttaccttgaagaaagttccatgcactgttgaatagaatgtgtattctgcggttgtcggatgaacttttctgtatatatctgttaagtccatttattccaaggtatagtttaaatccattgtttctttgttgactttctgtcttgatgacctgcctagtgctgtcagtggagtattgaagtcccacactattattgtgttgttgtctatctcatttcttaggtctattagtcatagttttataaacttgggagctccagtgttaggtgcatgtatgtttaggattgtgatattttcctgttgaacaaggacttttaccattatataacatctctgtctcttttaactgttgttgctttaaagtttgttttgtcttatgtaagaattgctaccccagctcgtttttggtgtccatttgcatgaaatgcctttttccactcctttacttaagtttatgtgagtccttatgtgcgaggtgagtctcctgaaggcagcagatggttggtgagttcttatccattctgtggttctttcaagtggagcatttaggccatttatattcaatgttagtattgagatgtgaggtaccattgaattcatcatgctatctgttgcctgtgtactttgtttcgttttgtttttttgctttttaacttgtatttttgttttataggtcctgtgtgatttatgctttaaagaggtcctgttttgatgtgtttccagaatttgtttcaagatttagaggtccttttagcagttcctgtagtggtggtttggtaatggcaaattatttcagcatttgtttgtctgaaaaagactgtatctttccttcatatataatgcttagtttcactggatataaaattcttggctgataattgttttgtttgagaaggctgaagatagggtcccaatcccgtctagcttgtaaggtttctgctgagaaatctgctgttaatctgataggttttcctttataggttacctggtgctcctgtctcacagctcttaagattcgttccttcatcttaactttggataacctgatgacaatgtgcctagatgaatatctgtttgcaataaatttcctgggtgttctttgtgcttcttgtttttggatgtgtaggtctctagcaaggccagggaagtcttcttcaattattcccccgaatatgttttccaagatcttagaattctcttcttcctcaggaagaccaattattctcaggtttggtcatttaacataaccccagacttcttggatgctctgttcctattttcttattcttttttctttgtctttgttggattgggttaattcgaagaccctgtcttcgagctgtgagtttctttcttctacttgttcaattctattgctgagactttccagagcaaaaatgtgtccaaagcttcctgaatctttgattttgttttcctttaagctatctagttccttgaatattcctcccttcacttcttctatcatgttttggatttccttgcattgggcttcacctttctctggtccctccctaattagctttataactaacctcctgaattctttttcaggtaagtcagggatttctttttggtttggatccattgctggtgaactggtgtgatatttttggggggtgtcgaagagccttgttttgtcatattaccagggttgtttttctggttccttctcatttgggtaggctctgtcagagggaaggtctagggctgaaggccattgttcagattcttttgtctcatgtggtgttcccttgatgtagtactctcccccttttcctatggatgtggcttcctgtgagccaaactgcagtaactgttgtctgtcttctgagtctagccacccagcaagtctacctggctccaggctggtaatgggggttgtctgcacagagtcctgtgatgtgaaccatctatgggtctctcagctgggataccagtgcctgttctggtggaggtggcagggatggggatcagggatgcaatggactccatgagggtccttagctttggtggtttaatggtctatttttgtgctggttagcctcctgccaggaggtagcactttccagagagcgtcagctgtggtagtatgggaaggaatgggtggtggggtggggtcctagaattcctaagattatatgccctttatcttccgctactagggtgggtagggaaggaccattaggtcggggcagggctaggcatgtctgagctcagactttccttgggagggtcttgctgaggctactttcagggatgggggtgagactcccaggtcactggagttgtctacctagaaggattatggctgcctctgctgagtcattgcaggttgtcacggaagtggggaaagtcagtagtcacaggccttacccagctcccacacaaaccgaagggccagtctcactgccaccatgcccccctcaacagccccacgtctgtttccaggcagagagcaatacgagtctgaaaacctgccccaggatacctgcctccaactacgaaagaaaagggtttggttttttgcctgcctgtggagtctgcacaccggatttgcgccctcctttgaattctggccaggaggcttctcatcccgttcaaattgttacaaagttcagctagagatgtccttctccctgtgtggttttaccccctgctcctctcctgttggatccccatggtgccaggcaggaatggcctgctaggggacccagtgagttcccagggcccttctcactgtttcctctactcctgtattttgctcagctctccaaactgactcagctccaggtaaactcggaaacttcttccacgaacagaccttcagcttctccagtgggagtgtgtgttcgggagaggatggtctcactttcacggttggggcactcaacagttttgcggggtggtatcccgggtccacttccttcagagggtgtgtgggtcctcttgggatggctggtttgctcttgcggtcgatctggagctaaaattcacagtgtgagtccccgcacactgctctgtccagagatgcaatctagtcctgcctcccatctgccatgatgatcccgctcctccttttcattgttgaacactattctatgatatgtgtatatcataatttgtttaaccatttgcccattgaaagacatcagggttttttccaatttttgagtattgtaaataaagctgctatgaatatttgtgtacaaatttttgtgtaaatgtaagtattcatttctccaagataaatgcccaggaatgccattattggtctgtatgatagttgcgtgtttagttctttatgaaactgtcaaatcatttttcagggtggctgtaccattttacattcccaccagcaatgtagggatttagttcctctgcatcttgctagcatttgatgttgtcagtagtttttattttacttattctgattcatatatagtgatactcattgtgattttaacttgcattcttgtaatgactaatgatgttcagcatctcttaataggcttattggccatctctatatactcttcagtaaaatatttctttgtgtctttttcctattttttaactgaattgttttttactgttgacttttgagagttctttatatattctagggtactagtcctttctcagatatctgctttgcaaatattttctccgaatccatagcttatattttcatctactcaccaaggtcttttgcagagcaaaatttttaattttaatgaagtgaaatttttccttgctttgatatgaagtctaagaactttttctatttttagataccaaagattttttcgtatttttccaatagttttatagttttgtgattcacattaagtccataatccatttcgaatttttacataaggtgtgctactgagaatgaagttcatttttttgcccatggatatcaaattgctccagaaccatttatttaaagagcatcttgtctctagtgaattgaatttgcacctctgtcaaaaatcatgcaaatatgcacttctgttcatatttgtgtgggtctttacctgtgttctctattttcttacagtgatatatctctatccatcaccaaccacagtcttgattactgtatctacataatctcataaaattgcctagactaagtccttccactttttaaaaattgttcaaaatattccagttcctttgccaatccacaaaggacttagaataattttgttgacatcctcaaaaaatattcttgggattttgataggaattgctaccaatatctacatatcagcttggggagaagtgacatcttccactccataaacatggtatgtctctttgtttacttaaatcctttttatttctttcatcagtattgtatagtattcagcatgcatttcttatacatgttttgttatatttatgcctaagtaactctttttagagcaattgtaaatggtatcatatttttcaatttctgtgtcaatgtgttcattgccagtatatcaaaatacaactggcttttatatgttcagcttgtatcttgcaaccttgctgagctaactccaggatttttttatagattctttgatatattctatatacacaatcatgccatctgcagataaaaactttttttcttctttctcagtctattgctttttgctccttttcttgccttttggcactctgttgaataagagtagtgagattgaatatccttgccttgttctcaatcttgaagagaaagcattcagcctttcacctttaactaaaatgttatttctaggatttttgtttttgtagactgtcatatatcgagtttaagaaatcccactattccttctttttttccaagaattttcatcataaataagtgttgaatttaatcaaatgatttttctgcatcaatcgatatgatcacgtggcttctttcctctaacctgttaatgtggtggattgcatagattgattttcaaatattgaaccagcattgcatctacaaaataaataccactaggttatggtaaacaattcttttatatactgctgaattctatttgctaatatttgctaagtatttttacttctctatttatgattgatactggtagacagttttcttttttgtactgtttttgtctggttctagtatcaaggaaatactagcttaataaaataaattggaaagcgttgcttcctttcctattttctggaagagactctgtagaattagtattaattattcttcaaacatgtgatagaattctccagtaaaacaaatagggcctggatatttctttggggggagttttaaaattataaatcatatttccttagtaattacagtactattcaaattacaaacataatattgggtgagttgtggtagcctgtgtttttcaaggaattggcccatttcttctaagttgtcaaattcatgtcagtgaattgctcacagtattatcttaatttccttttgatgtctgcagggtcttcagtgacatatacaatatatttggtgatacagtaatttatgtatcctcccttttttgtcagtcttgctagaagctaattgatctttcaaataaagagcactttattccactgattttctctactatttttctgttttcaatttctttgacttctgctcttatctttatctccctttttctgcttcaagtttaacttgttttgttttagttttttggggtgataaattattaattcaagattatttcctcatttttaatgtatgaatttagtcctataaatttccctctcatcactgctttatctacctacaaattttatgttgtgtttccattttcatttagttcaatatatttttatgtccccgatactctgacccacgcattgactaaaagtatattatttagtttcaaagtgttggaaattgtcctcttatatttctgttatctctagcttgatttatttggatcagagaacatactctatacggtttcaatggccttatattaagggtttttaaaatcactcaagctattatcttttttgggatatagtccacaggcatttgaaaaaatatatatattctgctgttattgggtggactgttttataaatgtaaatttgatcctattagttgatggttttgtgagatattctatatccttactgattttctgtataactgtcctatcaacttttgagaaaggggtgttgaactctccacatataattgtagatttgcctgtttctcctttctattctatcagttttcacttcacgtattttgtagctgttgtctcgtgcattaacatttagaattgcaatatcttcctagtagattgacctttgcatcattatattatgtccagctctgtctctgacaattttctttgttctaaagtctactttatctgatattaacatagccactcttgaattccattgattaatgtttgtatatcttttctgcccttttattttcaatgtgcatatgtcattatatctgatgtttcttgtagatagcatacagttggttcatgtttttaatcaccctgacagcctccgtcttgatcgttttagactatctgcatttaatgcaattattgatatgttagggcttcagtctgttatcttttgtttttttgttctgcttttcatctctgttttttcttgtgttccaagtaagttaatcattttagaattccattttgattcacctatagtgttttaaatgtatttcttatattttaatggttgctctggttattacatatatatgtataattcagacagtctattagtatcattttatcagtttgagtgaactatagaaaccctatctactttgaagtctctttgccttcccccacttaaaatatagttgtcttaaatatttcctctgcatttatttacaacctacatcagacagggttataatttttacttcaactaccaaatatatttattaaattcaaaaggagaaggaaagcttaatgtttacccatgtttacacatgcttttgtttactgtgttctttcttcctttctaatttcccagagtcccttcttttattgtttcttttctatttagagaactttttcaaatcgcatttctagggcaggtttaaggtgactaaatcccttcgtcttccttatcctgagatggtctttatttctccttcattcctgaaggataattccactgggtttagaattatgagttgataatttttctttcagcacttgaaaaatattgtgccactttattctgggtttcattgtttctcaggagaaacacgctgtccttctaattgatttttcctgtgtcattttttttctcactttcaagaatttttcttgaatatagttttcagaagtttaattataatgcatcttagtgtaaacttttttgtgtttattctgtttggggtttcctcagcttcttgaatctgtaggtttatatcttttccaaatttgagaaattttcagccattatatcttcaggtacttttccagcactgctctctttctccttccttctgggacttcgatgccgtgaatgttagatgttttgttataatcccacaggtctgtgaggtgctgttcattatttgcttatcattattctctttactctcatcattgagattggaatttctattgttatgtcttccagttattgatgccttcctttctccccttcactatgctgttgagtctatctgctgagcatcttatttcagtttctgtattctcagttgtaaaatgttcatttagttcctcttcatatttccttggtgagactttctatttctttgctgagctttctatttttgcatttatttcaagtgtaattgctagtttaagcatttctaccatagctgctttcaaatccttttcagataattctgacagtcatcccaatgttggcagctattgactgtctcttttcatacaatttgaggtcctcctggttctttgtataaagagagattttcaattgaaagctgaacatttttatattatgctctgagaccttgaaccttatttaaaccttctgttttcactggcttttcctgaccttgctcccataggggaaggaagaatgccatctcatattgccaggtataaaggtccaggttccccacttggccttcgctgacacccaagtgggaatttattttaactgctggatatggttggggtttctagatctctctgtggcctcctcagacactgatgtgagggtagcaccatgaccactaggcaatggtaaaagtcccaagtctccattaggtctccaatatcacagccccagcaagaaggggcaggggtacataatttttgttaggtagaagtggaaatctaccatctgatactgcagcatgaatgaggagaggggacaagtcgttaccaaccagcagggatgaaagtcctcgctccctactttgtctctgatattaccccacaggagaatagttatagcctctggaaagtgaaagaaagtctagcttctgcactcaggcttccctggcacgggtaagagtggggccacaattatttctgttgtttggcaaagagattagtgtctaaaagtgttctgtcttgctgcaatgtccctttttctacatttctggctagagagagtaggcttcactgggggctttttgtctgtgcccattggtattcccagcttgctagcttcttcagtgtcaagtcttggatatgtaagataagaagacaacacagggaacttaccaccaggttattcctctgggtctcatgtccttaaccagtctacttcctcctctctgcctttcagaatcttgtgtttgttctatatggaatgtccaggagttttcattgtatttagtgggaggaataggaaaatcacatccactccaattactcgaaagtggaattctgtatttttaattcacatagctgttacctaattgccttccatacatgtatcaatttacatttacatttcagttgaaccaattacatttctgcagagttaacactggtttacaccactggttttcattccagaaattgctcttggccatctgtttttgccctcacatctgccattttagagtcaacttaagaactttttttatagaaaattcttcttacagggtagaaaagaagtaatggtattcaggagtgagcttctagtagatgccttcctttcacttgcctgcctcccacctagccctagttcatctaatttgaaggtgattagtggagcttttctaagcctcctccacttaacaaaagtgaacactacgcagagttctgagaagggaatttttattccagttcctggtgtcttctattttattctaaatcagattatattaaacaaaacttccctgaagtttgaggtattttattgggactattccctaatcccaccattctcaccatgtatgcttatttttgtatgttttagtcagtattttgggagaatgtggtggactgctatcattcaaataagcattaagtggacaccctttataggcagcttcttttcaggggcggaaataagccattgcatgtgtaagaactaaggttgagcaacagcaattttgccagatgagtatccactttcgctgtttagtccctcacacttgattacaccacatctttattttctgggcttgtttgtatggtagtccttaaaccctactttcaacactggtgtgaaaagagtattccaagaataagacagcagtaactaggaatccctatcatttaagatagaaatacaattaaaacactctcccctcaattaaagcttattgccattaatacacagtccccagaagggtttttgttggttttacttcaaaagctgaagctcctgccctttactacaaagaaacatatacacatgaagtaaaaggattaccttgtgagcctcaatgtagaatagagggtgtgtgtacagatatactgcaacttctcaaactaaaaaaaaaaaagatatgtaaatacttctgataaaatatttacttatactagaatatttcatacaaaaaatacataaaaatggaactccacataatactatctagctataaattactgtaaaatgttttttggaatattttattctagtctcttcctaggcatttatatatacatacaaccacacacacacatatatatatatatacacacacacacacatatatatacacatatatatacacgcatacatacgtgtgcgtatatgtgtgtgtgtgtttgtgtgtgtgtgtgtgtatgtaatacatataattagatgggctcataccgtaaataccactttgaactctgctttattcacttaacataatgtattttcccatttggttaagtggtctttaaaaacatgagtctttaatgactgcaataataatattctgccttctgaaggtgccataacttaaacattcttctatttgtgggtatttaagtttttacatttttgccacttttaataacactgcaatgcatgtccttttccataaatctttgagtttattttcctcagggtagactgctagaatttggattactgaattgcagctactagctgcactaggctccctcccacagcaggaaacctggttctgggttagggccaaattcactcttggcctcagcactgaaaagagattgcagattctgcacccctctggcaagacactgttgaggttctctttagaattcttatttcctgtcagtggtgcggccaggtaagcctggggctctttcagcttgcacaaagtgtatttgctgcttctgctccgagaagaactgctaggaatcgggaaactgagtcagatttgtatgtttcctctggtttgtactctgccagtttgagtcagtagaaaggtaagaaatttttttttgcaagaacccctgtctgctaattaattttagaacaaatataatagtttccataccacgaggaaacagtatctttaaaacaaaatcgggaacacaatatctacacgcaagtaggcttttattattttttcttttattcttttttctttggctaaaatttaggcactatattgttttaccacattatctgatcgtgatgcttcatctctgatcacatgttgctgtcattaaggcatttctgaggcttttctttcttaatctggaaagttattaaattgtaaaaacgtggcttgttgtatactaccttctaaaattattaaagaacacttttctttaaaacaagagtgttctccattgccgtcaagacaaacagcagtaactttacacaaaagaagcattcatctgtcaccctactttaaaacacccaatattcatcagctgtttgcccttcttggagcagcctgagcaggaaaggattaatgttttatccattcatgccctttgatcaattttctattgagatgttaggtttttttcttctgaatttgagaaagccctttaagtactgattatattaaccctatgtctatgtctgtcatatttgtttaaaataatttttcccacttttcattgccatctgatctcatagatggtgaatttttttttaccattcagaaatatttaaatttagtacattatataatgttgtctactttagcatttgttttaatttcaaaattaggacatcatctcaacctgaaaatcatatatattcatcaattatattttctttttttaatgtatttctttttctagtgtattatatatatagccttataagattataataatgtatttctattataatcttaattttttttttaaatggagttttgctcttgttgcccaggctggagtgcagtggtgtgatctcagctcactgcaacctctgccttccgtgttcaagcgattctcctgcctcagcctcccaattagctgggattacaggcgcctgccaccatgtccagctaattttttgtatttttagtagagatggagtttcaccatgttgggtaggttggtctcgaactcttgacctcaggtgatccacctgcctcggcttcccaaagtgctgggattacaggcgtgaaccacagtgcccggcctgatttttataattttaattgttttattataattttaaacagtaataaaataccatttttgagagatttgagttttcattggttttgattcaacttttatcatatactaaattatttcatacattaggtttttataccctgctagctgtaccactgtgatgtctgttgcttcttagactgttcactggaggtgtatcatatatttaatatcttgtaaaacaagtattttcttctgctatcatttactttttcttttcctcaaaattttaagtagctcaccctatttgttcttctaaatgactttcgatttgacaattcaagtttcaaaatttctaaatgaacttcagagtcaacaatttgagctagattccaatttcatgacaaatataatgtttatagcagtaaagatgtaaaaaggcattcaaactcactactaaccatggaattataaattatttgccatcaaataagtaaaacattttaaaggttgataatgttcaatgttgatataaatatgggtaaaataggcattttcatagaccattgatgagaaaataaattggtagagttattttagaggaaatttgccagtatctatcataatgcaaaatatgagtatcatttgatccaataattccccatctaggaatctgtctcatagatattcttacacatgtacacaaagatacaaggtagttcaccacagcactgtttgtaaaaatcccgcattgggatccacaaataagtccacgtgtaggggaatgataaaagtaaattattaagtatccataccaaggaatgttgtagagctattaaaaataatgaagtagatatatgtataataatatggggaaaatcttttaagatatattattatataaaaaaacaagtttcagagtaatgtgaccaacataatgctatttacattttaaaatgtgtgtatgtgtgtgtgtgtgtgtgtgtgtgtggataggtgggttgatagtgtatatatgtatacatatatttagaaggataagaacaaaaaggatagtagtatttacttttggggaggtgaggttagagagtaaaaagagcttataacttttaaatctaagtatttctatagtattgagtactatgtaggtatttctcttaaaagttttaatttcaaatatacaaattgcacataaatgtaatcttataatgagtaagtgaaaatttaaaatatatttgtatattttaaatttaaaaacttaaaagcaacacctacttactattaatatcacctttacctggatcaccactttgtgtgtctgtatgtttatttactgttgaactggcagaaagttattcatatttgaaccggccaacagataatatgtgtactctcctgctggcaaaaccccttgggtggtagcttctgaatctctttctgggttccatcctatagtgcaagttggtctgcacacttttaatgtttagcaagttttcatcctggactaacctaagcaactgggctgaggtgtattatttcctattgttgcatatttatttactccaaactcccatcaaagagtacaaggaaagccacaatacatgcacccagtgctagacaagctcttcctgcttccagttacatacttggatggtgtgttacagaggagagggagatttaccacctacgatggatttcattcttcttctccagcacgacctactaaacaaggatagtaaatttctgggagatgctgtctatgtagatattttaaaagggtgttgtagagaaggagctctgcaacaatatatggaacaggtcaaaaagcagtacccacaggagacggctgcccaggctttctaactgctacagaaatccagtgttggctaatgatagttattctcaattcagctccatccatcttgtaatcagcagaaattcctctagaaatcctgcaaaaggccatcagtcttattttctaccaatatgtttttatctttttatgtcatcatgggtatgtaagtggaaaggtgggagaggctgcctcagggtctatcagccaggtgatattataaacatgttcttttgtaattaaaagttcaaacataaaataacaatgttaatgggcaaaagaggtcataaacacagaagttgtaggtgggcacacaccactcttagaacatgtttctacatcatggtggctgtatctgctgcttactaatcaggcatggtggctctccagggtattaattcccccaaggaccaagaacccatttattgtgtatgtgtgcagggaacaggggaacgtttctatggcagctgcctggaagatcagaagcaaggggagagaaaggaatgaaggaaagcattaacgaacacagaaagcctgaaatctgggtagaaataaaggtagacagtaggggataaaaaggggattaatacctgtgaagtgataaaagagaacagactccaaaagggggtataagagaaaaactctgtaagtaatcagtgggaaatggaagctccactggaaaagtcattcagcttagttttattcagacttaaaaccgggatttggtgccaccagaagagagtaggtaagcatgaaagctgaagcaatttatcaaaattatcctttctactgatgagcatttctttcaacaaatgtccgttacaaaaagcaaagccacaattgtattaattactcagcacccggtgctgtttcctatgaagaaactaaggaaaaaaatataatataaaaagaataaatgtatgacttttttggtctttgacagagataaacgtgctagaaggaaatcttccactctatttgaaatgtaaaaatacatgttcagctcatatatttcctgtaatttccacatgtgagaagtgagaatgtctaaaattatccaatataaaatatgatgtatatcaggattttgttggatcttgtcagctactcataggcagataaggcaggaaaggaagggccacaacttgcattagacttgcagttaaagagacagagagataaaggagagggagagagagagagcgagcgagcacacacatgcactgaaatgggcaaaacataatgctcactctgacctcaatccaggggcaaaagaacagctagtttcaggaactagggcaagatgcagaaagggggccagcagttctcataagccctctcgcaccagtcagcacacaactatcaatcaatggggaagaagcagggccctatcatgggactgaccttctggggaaacgcagccccaacacagccagaattgctgtcagcacagctaggtagggcttcattcctagagtggggaccaaataactaagagagttctgtcctacaccacctcaggctgcctgaggttggagaactcgggcacagaagttttgctgtaactaagagacaacaagtgggcagagctgatgatgggtcaagagcactgggtcccatgctcatggtcacgcaaataatagtgacatacagcaaatactataaaagggcctcctgttattggtagtagcaggacatcacatccaatttcaaacgataacatcttcttgaaggtgaagtttttgcatttaaagtctggttaataactgtttcatggaaccatgggaagataactctggaagagccagcagattatctagtgtctgcccaggttccagtgtaacttgctgtttgtctttgagcattatcattaaaccttacagggtcttgattttctcatcccaatagtctccctggcctccctggaaaactctgtggcccacgaacttttgtcaggaagctcttcttacaaatattctcttagcaaaaattatcctatatttgacactttcaattattcaacaaatctagaggaaataatcacattacaaaatagatgtccagaacattccaccttgtttcacagaaatcctgtggaaagtagacatggcaacagcataaccaacggcacgggtggcagagatccaggaagacaagtcaggaaggaacagtgctaaggagaggaggaaatcagccactgaagaaattctgggacacagcaatcaatcactagcaaagaaggtgcagctttgagaatacactaaggaaaagggagggagggaagaagagacggtaggcaggcaagcgcatattctatgttccatagtgcactagggaaaacaggaccatgaatgaaaggtttggaacataagtcctgtcatagctcaccttgagatttcaatcaagttacaactctttgggctttgggttcttttctgtaaaatgagaaatcaggattggtgagatgacagttaaggataagtggacttcgtacacaatgagacaaatggagtagaaccacattctatgtggacctaattttatggagaaaactgtacctttcaaatggttctgactgggagtgctgctatgaaaagcccagcgtgttcagcccagagctccctactttttatggaattccaactctgacacaacactcatagcttagatttagtcagaatcaacttaccaagcctcaaaatgttccacagaagcttttgtttttattaatctattaagactttacaaagtttccttctctttggttagaaatgaaaaaagtgggttaatctcatgtcttgtttcaaccgggaagccatgacttaaggagagcagcctatctgccacagatgataccaaaaattaaggatactcaaaaacactggtcccaaatcaatggcatgtccacagcctttgttccctgaagatctgcagctcataaacatccaggggaggccaggtctcctctctgtccttcctagttgcagatactgatacagcagaaggcaaagttagaacatgtatggattagattgttctgatctcaggacaatctagttgccagaaagaattcaagacttaaagaatagcactctaacaaattctgattatctctgctttatccactgagattttcaaactaccttttcattgcccatgcctcccccactattaaaaacagctgtcccaaaattttacagtataagtctctaattgttccctaacaaataatttgaaaatgacagacacatttcaccttcaccctgccaggatttcacaaagttgagaatatgggtttaatttgaaatccatcattacaaaaccatcctcatccggcaataggaaagactcccattataattttctgctgggagtcattagaaaaagccaaagcaatagaagggaaaagggtccgagagcacctctaacttacaaaagtacaacccactttgttcaacaaataaaagcagagcctgctttgttcaactcgtcctctaagaggatatggactagaaaatctttattgctgcagcctcattctataaaataggactgtatttacccatctttctggatggccaagaaataatgatacatcttgtaaatataggttggttacttcaggaagggataggaattaatttcaaatctatcacatagtatcaagctatttcccatgagatttcataccaggccacagcactggaagccataatttccatatttattgaaaacagcatctcagccaaagtggtacattgtgtcctcatagtgaaacctcacccaaggaaatggaattaacttgcactatcatcataagtgtctagggtttttttttttccgaaaactgtaatatttgaccccctaattcagagaaagtttccttaactgcactgagctctagcaaagactgtaatttaagaaactgattcctaacctagtaaactttcttgccagcaaaccaaaaagtttaaatctgtgcagtgcatagtaaaaggtaacagaaccaaacagctggatttttaaaatatccatgtgtctcccagcagcattgcagggtcttcatttatttatggttacgtattttattctccaaggctgtttcacaatctgtttatataaattgtgtgtgttaatgcatgtgtttgagtggtggggggcagtgcacagattcatctaactttagactgtgatgaaataactgatgataaaggatgctatgcatgtgtaatatatctaaatattggattttaaaaccacttttgatggatggcattacatgattaatttttgagacttctggctcagattaaaacttcctacaaatctaaatattttgtttttgttttcctttcttctaggaatattaatacaattttgggaatgacagcacagaattggcatgaatattagtactttcaccacaaaacaaatgtgacatatacaggccgggcgtggtggctcacacctgtaatctcagcactttgggaagccaaggcgggcagatcacctgaggtcaggagttcgagaccagcctggccaacagggcaaaaccctgtctctactaaaaacacaaaaaattagctggccatggtgggcgcctgtaatcccagctactcaggaggctgaggcaggagaattgcttgaacccgggaggcggaggttgcagtgagctgagacggcgccactgcactccaacctgggcggcagagtgagaatccacctcaaaaataaaaaataaaaactgtgacatatacaaaccttttcactaagagaaaaaaattgggaaattaggcaaaattgattaatgagaacaaactgtttattgtacaaaactcttaagaacctagtattttcttaaaaagttttgccctgaagatacattgacggtctaagatcaccagtacctgattcaattcctatttatcaatagacctggattgaaataaaaggcactgatgcagatagcctcagttaggagcaggcacttaattattggagttgacaattatgccctcccataatgcatttttggtgtcactgaagagaccaccagcattcatgactctaagccaacatggtttttatgttttaaaaaacacatacttcacatgtatatgtgattcacttagaatttttttcaatgctattttaacaataaataaaaatcttggccgggcacagtggctcatgcctgtaatccagcagtttgggaggccgaggctggtggatcacttgaggccaggagttcgagattatcctggccaacatggcaaaacgctgtctctactaaaaatatgaacattagccaggcatggtggtgtgtgcctgtagtcccaactcctcagaaggctgaggcatgagaatcacttgaacccaggaggtagatgttgcaatgagctgagatcgcatcactgcactccagcctgggcaacagagcaagactctgtctcaaaactaaaaataaaaatatttacctattgttctcttgatattattatataagaaatacatattctggccaacttacaaaattagtcttacaatattttccctaaattattatggtaaaagtagattatatactccctaacaagggcatctgtttttaatctttgagtagttgaaaccatgtaataagtttatgcctattgaaaaatgtaatctttctaaggaaaaaattaaatttcagggtgttcattatcatctctaattccactgctcctcaattccaggatgcatgcttttttcacatttgaacatttttgaaaacaagatacatcttaaaatagtatctacattaaatgtggctctgttcttttttatcttctaaaatgctgttattgcatccagcaatccatggtgtatcagacatgagaaaatatgctattttctgcatgcctacaactcaccaggttcttctagatgctcggtacacagaaacctataaggagcaggctcacaacaataggccaatgtattttacagcactaaagtagttacttgagtaatatgcaccaatcaactcaaattttgttatataatcctttataactctcattctcaataggaaaagactgtgtcccctccacctccacccacctacacaaagagtacctacccagcatcacctgtctatctctgaataactcactaatactgtgtattaaaactgtaaaatcaaataagcatggctggtgctcactgactgaagaaagtgagatattttaattgttaagatttaaattatttaatatgcctcccaattacttgttttagaacacatacacacatgcacacacacacgcgcacacacacacgtacacacacacgcacgcacacatacacacacacacacacacgtaacctacagcaaaatcaaccttaagtaaaacatagaacaatctttcactatttttcctccagaacattgatcctgccttggaaagagaaagcaaatgatttagtgcatctattactatactacatttttattaactaaaaattgtttcccccacgcctccattaaataaatatacatcaaatatttaagtaatatagatttggaggggcatcaaggtatatctgatcaggaaaccccacataacttggaacagccctcagcaaagctggaacccaaacatcaggctttttggtttccaaacctggctttaggacctcaaaatcctgggttcagagaggtgacccaagaaagcccaaagcaggtaagaaacaagaaccaaatccaggcctctcaattccatgccccagagttttgtccacatttgttaagaacctaatctgaaacagtgctatccctatcttgagatacatacaagagtaaggtatgatcctgcccccaaggcccttgagtctctataaggaattgtgtgatttaaatcaatacaactgaaatcagagacacaaaagtaacagagtaacattaatttttaattttttttttttttttttttttttgagacagagtctcactctgtcgcccaggctggagtgcagtggcgccatcttggctaactgcaagctccgcctcccagtttgacaccattctccttcagcctcccgagtagctgggactacaggcacccgccaccatgtccggctaattttttgtgttttttagtagagatggggtttcaccgtgttagccaggatggtttgcatctcctgacctcgtgatccaactgcctcagcctcccaaagtgctgggattacaggcatgagccaccaagctgggccactttttaaatttttttaaaagaagtctcatgcgtctatcaagatatttcaaaacaaaaggaagttttcagtttgacaaagctataaaatacaaataatcaagatagaaacaacatgatgataatagtcatgttaacatttattgactacttactacgtaacactcactttgtaaggtgcttttcatcatttaatctacaacaagatcattagatattattatcatcctaattttacagaagagaaaacaaaaacactttgaaagttgcttaataacttacccaaatttacatatgctaataatcaattcagcctgcaatttcaaaggtcctgccaccatcctataagtagttctttaaaaagggataataaccctccaacacacaatcacacatacacatatgaacacccaggtccagttttatctgtctctctttatggtctgcttgctttgagtatctcaaaattcagccatatcaagaaagaaagctgggagctggaagctgagaaaaatactacccacactgagttggtcattggtaataaataaattaaccaataaggtgaagaataggaagagtttaaacaagaaagtttccaacatgttatgctttaactaactgtgagttgaagtaattattgggaaaaaaggacagtatttttagaaaagcaattaaatttagctgataggtgtcactgacactaaggtcatttcaacaaaaaggattttcaaagtaacagaagcagaacttagggcagaagcacccaagagatggcttcaacagaatcaaagaccaatttgccccaatgttcaaggagaggaaagtatagacttcatttccctcaagatcccactgggattggattcctttacttaattaactactcatccatgatactatctaaaaaatgctgatcctacagctttgtgtagacaacgtgctatagcctcaactactctatttaatggaatatcaattttcctgcctaatagagctcagaatttgaacttccttcacgtaagctgatattctctttcctcatttatactacagctatgtttgtactgaaaggcatgaaatattaatatttgtgtccatgatcatacagtccaatgtaaggaaaaatacaagtggaaaactaagaggaagaaacagtcatttcactgtctttcaaagtaaaacaattacaattatgtaggaaaaatattacttgtaaaaattaactcaaaacattttttatttataaagaaaaattgttattgatttacatgtttacaactgtcctgtcgcacaaatgtgcaagctcccctactgtatcataaggttcttgagggcaggggttagattcagaaacttcacctcttacattggatgccaaggaccgagggtaggtacatagtgtttgtgttcccccaccgtctacctcctggctgtgaatgaactaagaagacagactaatgatcgtgatcagtttagtcatgacagatccagcacagcaccctggccattcatgacagatgcctatttagtatgagctggacaacagggaagtaacatcagtgttatccagttatctctatgaaccaccaattgaaactagatttgatatatcttcccaattgtttagtttgatttcttcctttggaatagctactattttaaaagtttaggcatatggcaatacttagcaagaagtaaatatttaacccaatctccactaagtaaagcccttaacattttatatataatctgaagacatcctgtatgtatgtgcatgtatatgtatgtatgtgtgtgtgtatatatatatatatacacacacatatatatatacatgcacatacatataaatatccatatatacataaatatatatcaatataagctggcactgtgatatagtgctattttctacatagtagcagcaaatcaagattacataccaagagaaggcatttatcttccatcatgtgttaatgctgaaacacattaactttcctctcctcatctccctacctcttcagtcatgtctacctttacatgcaaaatacagtagctgcttattttaaggagtacataatttcactaaatattattctgctcattgtgctttctcattccattcctatcgcaaagcttttaagttgtttgtcaagtctaaaatctctcctacttttcactggagagattaatttggtaaaaatagaatcccaaactgccattgctcttttagtcatcttaattaattgtaattagttttaaaatattcagttcccgatttcccataaaactgagggcatcacacacacatgtgagttatcattatttcttagtaccagcacttgtgatagaaaggtaaccatccattctttcctgtggtctttcatactttcaaccctgattagtatgtgagtggctggtaaataattaattttatagtgagtgacatattttgaaatctgcaaagtattttattctgggaatttaaggcaacccttgcatttccctagatagctctgtgtacgcctacaattataagttgaagcagattcttgactttcccattagcatctaacaatttatgagcttttgatatccatgggatgatttttaaatgacgactttaattccccaatgcatctagataactagaaaaataatagacaataagtgaatgctttagcgaaggaatttaactaagaatttaaagcttcacccaagctgaaagtaatcaaataaactttataatggtcctgcactgacttcaatattctctttacatttttaaaggaaggtagcagcttcaaataacttatttcatgtggactgcataactatcctattatgtagtaatcattatatacaatttacagataagaaagctgaggctcatctattttagttaaattgcagaattaggaattggcagagttggagttcaatccagatccagctgcctttaaagccatattcacagtactacaccaacccaggcagaacatggatccttgctcttccaacatttacagtacctttcaggtcttataccaagtttaagcctaaaaaacatatctgggttttggttatctcatagattatacgagttacttgggttcaatttgtcactgaccacacactgggtaggcagtgataggtctgtaatattaaccataactaaagataacatattttggaaattaattaatttaaaaatcaaatataaagaaacatgtatcaaataatagttttcccattaagaatttggctaaaaaatcatgatggaaatcaaagaaaaatgtgtgtttttcttagccaaaatatttatttatttatatctttagagaagggtttcactctgtgcccaggctagactagcacggtggcataatcatcgctcatggcagtctctaatacctgaggctcaagtgatcctcccatctcaaactccttctgagtagctagaactacaggtgcatgccacgatgtccagttaattttttttttaagagaggtaagttctcactatattgcccagcacagcctagaattcttggcctcaactgatcctgccaccagagcctaccaaagtgctgggattacaggcatgagccactgtgctcggccacagaagtctttaataagattcaattggcatcatccattgtcaaagtacaaaatgtatactttcatttactactgtaactaaaggtgattaaagagacaaccaatcatatgccctttgcacattctatgtaaacaatctttcattacaatatcaattaatcaccaattcattggaagttctgaactccatggaaattgagtatttaagcaacaagtttggttgaatccctattccaaattatttagtagaactcagtaagtgaaaagaattagaaaatagttcttctcagaattcagattatataaattcacttgtaaaattttacatatttaaaaaacaccttttatggtcattattttagctaattatgcactagtttctattgggtgacaattctctaccctgtggtaccttttgtctcagactactattcaaggatgtctgtaaagcaaacagcctgggaggataaagattatgtcttcctcctccaggacagaggataattttgtttcctggcaagagtcaaagataatgccttcctccagggcaaaggctgggcaagtgtgccagaaacagtttataagactggttatttcctaaactctgtgttcctcagttgtgacacagatccaacaggtatgaagtaaccacctggccccctctgcattgccctcaagggaggttcccctcaagctctacaagatgagagcttgtagcccatgctgcctgctgtgcattgagcagtaacatcctttatgtctgatccaggagtttcgtgtcttctgcgagcatgtatgaatcaggcaggctaacttgttacttcacaggcaggttaaaatctcagactcctcactgctcttgacagctctatatgattgattaaataagtgtttgcagatgttggctaactccaaggtaaatttttactcctccctctaaagcccagaactcacagctgtcacttgtgctcacgcagttagggcaaaactaaggaataccatcttcatacatgaaattcttgggactgcctgacgactctgcagctactgaaatgaaggaagtgaagacaagcgcaggagtcttttccttctggtggccactgttgggttattagaatcgtcatctgtacaccaaagacaagctatccttctcatgcgctgattgattacatgctgtcacaggctaacctgtaaatccctgtcatcaatcaccctctctcacagaggatatgggaagatttcatgtctcaatcatgctctccagtttaccccagggtgacaaaagccagatagagtcttggggcactgaggtgatcatactcactttcccttctcgcctcatcatttagatggatacaacactagatagtaacgggcaacgtttacagagcacgtctcaataatcgttttatccttctcccacactagagatgcagacaagcaaaatttctattttctcttcacagaggctcaatgaattgaagtggcttgatccaggcccagatctggtaaccaaggaagcagaagcttcttaccattccatgttctctctacttcacaaaaccaaggaggccaatagatggtctcagcacccattctggccctctcagaggcgtctttggctactctctaatggaccttgtaaggggcagggaagtgcagtggttagggaacacagtcaagagctagattgcctgagattttaaatcctgtctcattcactcattagccagtcactcctggctcagtcacttaggcaatttatttaacctttgtgtgccttagtgtcatcatgtgtaaaatggggataataatagtgcttctattgtaggattattataaagattgaataaaataaataaactactgtatctgacaccaccattgctaccactacaactgctttgagtcccttttagacacactgatccctttctggttagaagcccaatttctgattgtcaggcttggttaggaattcaggtgaacttccccagggtctccatatccaaccctgcaaaacagcaatctaggctcactctgccatcaggaaccaaattatcaagaagaatgtgacaagttccacaaatatttcttgtggaatgaataaatgacttaggaagactctctgttctgcaatatacattctggaagagaaatgaggctttgggcttgactatccctataccccctttgtgaataaatccatgtgacaggcagaatgatgactaccaccaaacccccaaagatgtccagcgtctatttcctggaacccatgaatatgttaccttatatggcaaaatagattttgcagatgtgattatgattaatggcctggagatgggagattatcctgtattttccaagtaaactcaatctaatcacatcagtccttaaaaacgaagaacctttttcagctgtagagaaccagacagatggcagaatgagaaggtctcgacccaccattgctggctttgaagacagaaaggcatcacaaccaaggaatgtgtgtgacctgtagaaaatggaaaaggcaagagcatggatctcccccaaagtcttcagccatgctgacactttgatttgagcccagtgagaactgtgttggacttccgacctgcagaactgttaagactatacatctgtgttgttcaagccactgggtttgtggtaatttattagggcaacaatagaatctctggattcttccactagggaaagatcataacccagtactgggactattctgtagggttaagcaacaggaaagcatgtatttactcaccaattcattcattgattcatcttttttattcatattgagcacctaccacagcccagacactgttctttgggctacagaaaacaacagtgaaccagagagccatggtcagcttctgcaaccacgcagcttacaactcaaagctgacagatagagattaagcagccaattaataaattagataactgcaaacagtagaaagtgctgtgaagaaaataaaataagatgatgagatagagaacacagagggcagagctggggaaacagaaaccccagatttgggtggatggaaggctaagaaatgacatttgccagctaagcaaaggtccaagagagttcataagccactaactcgtggctgacctagccttcttatggatgctgtaagaggtgaaatacctgtttttgagaaattgatatgacttctcactccaaggaaaagtgtgctgtgtgaattgctactctaattttcctgtctccactcttcacaagcatgacttttaaggctttatttttaccatattttatgaacagtgtaaaggcagcattatcccagagtccctgcatatcattttcagtgagagtactcagcgttctccttatctgaatatggatgtggttagactccctgtgacggctacattgctgttactgtgatagatttccctgtgctggctgcaacctgtatcagcgacactggctctgaaaccaaatgcattgctcagggttagacccagacacagtgctagagcctacgcagaccacagctgtctctactgcacatttagttatgacaaaaatgtcaaagcgtgaaggtggcaaataaagtgtcatatcatgtaggaatgatggtctctgatatccaaatcatacacacacaaaacaggccactcaattcatttattgtaatgtcttgctctaatatctatgggaaaatagtacaaacaacttcaatttttattcaggttgtcatagtgtcaataattacatctcataattacccctttcataggttgtctataaaagtaaaactagaacatccaagtaatctgtctcaacccagagttcccagacacacgcaaacaatgcagggcaacgcaaattaccttcacaccctggttagtttgttctacagatgccttactgtgtgagaaggggctaagctgaggcataaaatgaatccaattctgaagctactctaaccatttctagtgttgtatatgttaatataatgaacttacaaataaacaatatctagtaagatggcttttgtgttgggggtgagaggtgcagagttcacactttgataattcactgattccaagaatggtgctcaggttttagagccagagtatctagatttgatttccaacttcatcatataataactctatgaccttgaagaagacatttccctgacatagcatcaatccattttttctctatgaattgaggtcaaaagtagcacacacactgcctggttcagagggttctcacaaaatgagaaagactttgtaaactatagaacacaagtgcaaaccaaaagtcccttggcctcctagcgctacagatatgttgtatttaaggcaacagcctaagtcccaatcctctgagctccaagcatggactaacaagtctgagcttttcctgggatcccctcctcagttactccctccaggattccctgacagtcagacttatggcctgctacctgacaaccctcctctcctactctcttgaacttttcctctgctccacatgccttcatcactctgccatccaccagtcaccatcaacacctctgacaacgttctcacggaagacaacttcttctacagcacaaagaatggggtgaagagggaagggaaggaacctcaaggcctcaccatcagggaagccatttccactcttgagccttgctttttcaaaacagggctgccaaagtaacaccgttaggtatcactgaccagttcttggcaggggctggcaaattttaccaataaagggccagatagtaaatattttagcttttgaagaccacatctgtctctgtagcatattcttctttgcttttttttctttttatgaccctttaaaaatgcataaacaatccagcaggccacaggctggattttcctcaagggccatagttcactgatccctgcgttatgacacagctatcgttcatgccatagtatacttgttttttgtgtgagcaggagtctgttgccagtagggggaattgaggggaggctcattaggtcaggggaggtacctagaaccactgcccctgggactttcaaacccaggagcttggccgcgcatggtggcctcactcctgtaatcccagcactttgggaggccaaggcgggtggatcatctgaggtcaggagttcgagaccatcctgggcaacatggtgaaacccgtctctactaaaaacacaaaaatcaaccaggcacggtggtgggcacctgtaattccagttaattgggaggctgaggcaggagaattgcttgaacgtgggaggcagaggttgcagtgagctgagatcacaccactgtactccagcctgggcgacaagcgcaagactccgtctcaaaagcaaaacaaaaccaaactcctataggtcggtctggtccacgttaacagacttcttcactcatggcttttgttcaggaacctcatcacgtccctcaatccaaccttttttggggaatcctaagctataagagagatcagtgcacgtctgaatgccaaaaatgagtcaagctccagttcttacactcagagcccctaagctctatgtaaatctagcatgtggcttccgtgtttctatgacagttagaaggctgctccacccacagcacatgggacctctgtggttagagtttccaatgatacaatcaagcctaggaaaaatgcatctcagccagtcagaatatgttatacatttattagctactatgattattatctaaaaaggaagaagaggaggaagaagaggaagaaaaaggaagagggggagggaaggaggagaagaggaacagggatgaagagggaagggaaggagaagaaactactgcagaaaattttgccaggatgcaataatggttacaaaattaaattatccttacctagtactttctccttgtgataaaagacttcactttgaggccgggcatgttggctcttgcctgtaatcccagcactttgggaggccaaggcaggcagatcacttgaggtcaggagttcaagatcagcctggccgacatggaaaaaccctgtctctactgaaaaatacaaaaattagctgagtgtggtggcaggaacctgtaatcccagctactcaggaggctatggcaggagaatcgcttggacccaggatgcggaggttgcagtgagctgagagcacaccacgacactccagcctgggcgacatagcgagactctgtctaaaaaaaaaaatcacacctataatcccagcactttgggaggccacggtgggcagatctcttgagaggtcaggagatcgagaccagcctgaccaacatagtaaaaccccatctctactaaaaatacaaaaattagccgggggtagtggcacatgcctgtaatcccagttacctgggaggctgaggcaggagaatcacttgaacccaggagtcggaggttgcggtgagatgagatcgtgccatcgcagcctgggcaacaagagtgaaacttcgtctcaaaaaaaaaaaaaaaaaaaaaaaacttcactttgaatctttttgattgttatatctattctgtaagtgaaggcctctataagcctataaagtacccagctgcaaattagtatataatgcctacttggcccaaaagtgaatcagaaaatgatgcctcttcaggtctataccttagcaccatttgactatctacaggtcacttttttggagggaacaggagtcaggggtggaggggtggaagtcaccggttaatcctggcagatccagccatctccaaggacataaatgaagagcagaaccaagatggattctcatccctacttgagcccttgaccaggcttcacaataacacagaggccctaacttaagttttgagtcaatgtccacaggcccattttctgtagctacttgtagtatgctaacatgctggcacagaagttagtgataatatttactgtcatggtggtggtgatggtgccaccaataaaacttgtcagctgagggcccttgctctggaccacttaaagagggctgatttttcacaagacgaaataacttagaaacatagaggataaagtggtccatagggttagtaaggtggaggagggtgactaagtcatgaaagatgtacagcacagacagaagagtttttaaaatgattccaaatagtgtgtgagagcagactactgaagttgaggatggatgtttgcaccctgcagagaatgctgcactctagagtttcacagtgcaagatgacctgactttcatagtgggcaggaaggtctgggaggccttgctttggactcaggaagaagtaagcaagctgagtagccggaatgccggtgatgagcattcattggtccaaaggagaaagacaaaaccaggaggtggcctggagatttccaagggagagaaaattcaaagctgcctgggagatgcatggcagaaccctaaacagattgtaaaggggaggagaaaaggtcatggcaaagtcaaggatgactggagctccctgcctggggaaaggatggatggctgtgttttagttgccaaggcaacaagcctcaatggcaggcagagaggctacagagtccctctctgggagtatcctgccctcagttgcgcagcacaggcaggtcttcttccacctggaagtacaatatgctgctctgctactggaggtgtgtttatcactgaaaagactcacccccaagtatactggactgcagtaggctgcaatcatgctacagaaacatgtatttctcagcattgttaatggaaacaaacatctgcaacacctaattgaaacccattcataggaaagatacataaaaacattctaacctttagcattatgcacaactttttaaatccagagaatgttacagcagagatctaccttcctggttgagagtgtactacatattttcctttggaaactaaagatactacaaacaaacttgaaaacatatatttcttcaaagtattaatttttaaagcggccaaaattgctaacaaccagggaaagtaccaatttataatttatgttcttggcacatagtatatattgtgaatttgcatgcatattacatgcaaataaccaaaagagcataacattaaggcttcaaatttgtatgtgcaaaagacagtaaattctaacattaaaattctttccagaaaatattaactccccatatcccctgtgactgtcacatagtcagctgagcaaactcactacagaacttgagtagtcaataaccttgttcaatgaaaatttgcatttcccatacctactcttcttagcaagcaaagaagacaagaccatttggcaccatgtgggacagggataaggtgctaacatggcccagcttttcaaacaaattatctaacaatttgacagaaaaaaaaagtgccagtaaaaatgccaccattgaaccactaacagaatctttactcccttataaagattacaacactggggaaatgaagcaaaatgcagctgactctgctctttccactatagtaaaaatatgagatttgtgatggcaaaatcatctgagtcaacctggctgggctagagtgctcagttcttaagtccaacactagtttagatgttactgtaaaagtatttgatagatgggattaacatctataatcagttgactttagctacaggaggttacccttgatcatgtggatgggcctcatctaatcaggtgaaggccttaagagcaaaaactgagtttccaagagaaggagctctccctcaagactgtaacatagacatcctgcctaagtttctagcctgctaacttgccctacgtatttcatactcaaggctataacatcaactcttgcctgagttttcagactgctgccctgccctgtgatttttggacttaccagcaccgcatttgcattagccaattccttaaaataaatctcttcataaatacatatttatgtatctaatgtatagatagacagattctgtctagtgaacactgatacaggattcaaagggattttcagtgtagaactaaaaaagtgctcagtattataatgcattctggtggatgggtaagtgctggttgatcttgattgcaatgtaaaaattaatgtattctttgtttaaataatgctactgctttgcagtgcagaatttactggaagatttccttcttgatatccatttaaagaatttccatagtcaaccctaagacaaataagggtgaattttatttgtaaaagaaaaggggctcatgataatctttctggtggctgagcccagaaggttttggggctcagcttgctgcatttatattctgaattctctgtggttcctaagtcttgagagatggaactatcccttcatttatgtatagtctgaaaacactaatcagactgtttaccccaatgaagcaagtatccacttaaatttagatcaaacaattccatgagtttaatgccactccaaccactctgtttctttttgttccttggccttttcatgaagtatctcacagtatttgctgccacacctctgctcctccctttcttcactctgtgacacagaatgctcatccatacactcagaccccactgctgtgttcactgatgatccccagacctatgcctccttccttgacctctaattcctaccgcgctccttatttattggtgtctggatgatcttctgggaatgggtggggcaaggactacagtcatagcacatccaaaagagaaatgattggtttagcaaagttctatgtttcgcaaactgttccatgtccaccattccatgatttttaagctgggaagagaaccgacctgttccacaaggcatttggacatttgctggataatcttctggtcactttgctttttgttttttttggactgttaaatatggaagttgttctccaaggcagcaatccagccttgacttacactgtctataacttacctttatcttctgtcttctctatcagtcctgtcatcaagtcaaattccttctccttctcactcttctgcagtcattcttagcatgcaccaactgtcttcctcctgtctgagctattttataacacagcaacaatcatctacccgaatgtcatgttgatcatgtcacttgttgccaaatgttccaaatgtttcttcttgaattaaatttcaaccccagttctacaagtccacagctgactcctttgattctcctcttcctggctgtggtctgcaacctgccccaccgctccccacactcccttgctctccaaggctcactgtaccctctctgttctccagatagcaggacaaactctttgctctcattacctctcctcttaatatgttcccgttctggaaaagttcaagagctggtgggtttccttgattccaccttccaaataactagttcaccatggttttccaccattcctgattcggggatcttaaggtttgggttcatatccagaatatcctggggcaaaacggtagtaacaatgtgagtaatcactgtcttgacctcatccaaaagacccctatttttgccttttctcataatgatgtctcaagtaagaaacctctcaaaaatttaaatttcttcttggcaaattagacatataaacttatccagcaagttttattatgcatgtgtatcagaatacatttcccattgtgatttatgcccatgttacatatagttatggatatatttttagaaaattgttttttaaatatttaatagccattaaaagggtaaaataattctctgctccttatggaacagttagatgccattctagtacttttgcaagtatttgcaattgtaatcagtaatgcaggcagaaagaatgccagtgtttttcaatcatcactggcaaaaatgtaaattttttaaaattaagactttaaagatcacctgcattaatcttctgctaatgcaagctgggactatttcctaggattctgagtggtttaacatcatcaagacatgtcacaggcttcatccaaattattcaattcctaccatacattacgctgagcctctcagaagatgaatcgggaagaggcaacctaagtgtttagagaacaaaagggaaaatgaagcacagagacctctggctaaaagtataaacctttgagagggttttaaggacatactataggactaaaaaatgagaacaaatcagcaggcccattagctgtgcagcaaattaaagcaccattgtttccagtttcagccttgaatctggagggcaccaaatagaccacgctgtcagtaccctctgtgaaagaagtgtgttctctgctatgtattctcaagcgcctttctattttttttcagctaatttatcagtttcccacctcttctcctaaatcattattataaacttccccaggaacatgttaaagggacaacaggaaaataatcaaagtttcaaaacacaatctatatttatcatgaatttcaacttatctttttccttgtattaaaaaatgaagcttgctatcttcagatttatattccttttatcttaatccttggggtaaaatatggcatgtggataatccacaaactaaatagcctctgcatttaagaagtagaccatagtccacagttgtatagtccacattttgtcatctcatctcataaaaacaaagttgaaagcggctctgtccaatcttttgagagggcaaaaggtctggaagatccaataagactacacaagagatttttaaacattagtatgtatttaaaccaatttattcataatatagtctcaactgttacataggactaggcccagagataactgctttcaattctttaagtaattattttagatttgtttccacatgtggaaatcagtaggtgttggctcactattgtgcaaagaattgattccaggtatgcaatgaggtatggatgtctctcagcctcagggaatcaggtggggttctgaggtagcaggtgcctctgggcagataacacctggccatcagcttcctcaaggtataaaggcatggtcctcatggctctgctgagaggcactagaaacatccatggacacccatgtcaacaggctgctgcagaaagcaccccttcactttgtgcagaagcagtccatgtagctgctggaggaggtttcattccaggtatagaaggcacagctggttgaaagtggagctctagaaaggtgtgggcagaagcgcctggtaggcaaagctacaagggacagccccaaaaattctgtctatacataccagacatttctttccagttgagtcaaatatcgtcttttactggcatccaggctacctatggagtgactgctctaacaataaacacacagtttataaattcgggcctcattattattttaattacttgataggaaaaaaattagttgaatttgaaatctgttggaattatcagaggattgcatttgtctagcaaagaaaaaagctaaaactattaatgtttttaaagataactttaacttttatagaatatgaaacggtggtgaaatggcttgtttttttaaaaatcactacttgtgtagtatctcactgacaatgactaaaaagaatttgaagagagaatcattaagatattgatcaagaattgtgttcagccatttcaggcatataagaaatataaaaagttatgtttatgaaagcaagctcaggtttttcattgaaaaaatctgaaaatatgttatttgaagttttatatctacttaatattctacaaatgaatgtctccagcttcctacattatttagtatcagtttctatgcttgtcatactaaagacaaaaatttatatgcactgatttaaataacatgtttctcttactacttcttagttttttgatttcaggtattattgattgacctcccaatgaggaagatgagggttaggttttttatcacacacacgcatgcctcatgttcccatcctctcagaataattctggttgtgttaaatatccatatttacatccttagaatcatgtagtgttctatgattatatctcattttctgcctttttgtcttccttggaattaatcattgttatatttaatttgcgttagtttcctatgtacttatcatgatgctatccccaaagcctccccaagatctgtaaatctcctctcagagcaaacacattaggtgtttaatcaattttaccatcttgaagaactctctcctgaatccctctacctactgcaatttagatcagttgatcactagtccagtgcacagctgttgagatctcttttaccatcacctgtgaattcttttcgcctcgctcttgtgttggtcctatctctgggataccaggtctttctttttattagtttaccatatcatttattggaccacattctagtgttgtaaagtttcatgatcatctgttgttattcccttttaatcaggaaacttctgtttttgagaaattttggtgaattattcctttgatggttttctgtcctccattttttatgttctctgaatctggtgtactatttttggatgtaagaaccaatcctctaagcttcttattttttctacgttattttctattctttctctttttactacactttcttgaaaatttccttaatttcacctcctaacccttataaattctgttgtgtttcatggttataatatcatgccttatctgtctggagatactgatgatttcttttttcagatttattcttctggccgggcactgtggctcacacctataatcccagcattttggggggcagaggcaggtggatcatttgaggcaaggagttcaagaccagcctggccaacatggtgaaaccccatctccactaaaaatataaaaattagccaggtggtagtggcacgcgcctgtaatcccagctactagggaggctgaggtgggagaatcgcttgagcctgggaggcagaggttgtggtgagccgagatcacgccactgtactccagcctggacgacagagtgaaaccctgtgtaaaaaaaaaaaaaattttcttcttcctattaaggttgtttcctccaagttgctttttttgtttgcatgctttagtttttttctctcatgatattagacatttccttaaatgtctcacgatccttggctgtctgagatatttaagggccgagcactagaaggtccacagaaaggttgggagtgtggttgttgatataggatttattttagaattgttctggctaggcccttccttgagggaatccctgatatcagtatccttgagttctatttttaggttagagtcccagggatgtttcctggagtttcctgcaggaaaggtatccttagctgcctgtaggctaaggagcagagaacagaaggtattgtcattcttgggatttggtaaatcagtgtaatccacaatctaccacatttcaggaccatattataccacttttaacctttcctgatacttctcaatccagaaaccttctgttttaccaactctatagaaaacataatcttcatccctctgttggagtggaggagcagtttccttcttgtataaagttaggaagcagatctgaactttcaaccaatacttctcaactgtatctccactctcccttccaggggttcttgttcctgagtttttgcagtgttcatcagtataatttggcttacctttttcctttctcctctgctagattaaaatttcactttctcaggtctgctaagtaagttagcagtcatccatctatatcccaaatcccaaagtgctgtaactgttgccctatttctttgctctcatcggtgtgtgccttttaaaataaaaatcccttaaacatcattttaatgaagtttcaagaagggtcaggaactaacacatgtatttatccttaatctgaaaatgatcagtcagtctttatccttttgcattgacattgaaatggggattactcttttttgttccctcaaaaacattaagccaaggcccaacattcaagaggaacaggaaatagagaaaatagcaatttttggatttagatgaaactaaatttaataatcgcatgctcttataaactagtatatcattgccctaacgatatattggacattgtgggaaataaaaatatgtctctatttcaaaacagtctctaaaacttctgaaaaagatgaacaattaaagaggtccttaaattgataattaacctaaaagagagtattcagagagaaaaatcaccaggcaaggaagaatggtaaaaggcaaactcactggagcaaaaaggaccttaaactccattttgaaaaataagtgttacagacatttcttctgcagagtttgcataatgtgtattaggtataaagtgatcaattgattggggaatacaatttattttatgcagactagggctcctggcataagggaaaaaaaagctcttctgcttacaacacagctgttttaaggtctttattctccatttctcacaatagtggatcattaagatgttgaaacaattttttaaaataccagcttagttcactaccatcttataaaaagagatacaataaaatgcattttttcgtgatgttcaggttttaaagttatacttttacagagatagaaaataccattattacttaaataacttcaggtaaaacaactttgtttattgtgcccctgcaactctcaagtctccaacactatttatgccactgaaataattgtctttatagcacaggttttgataatgtgcagttttaaggactatattgcctggagcagaactgactttaattggatggatatagatatgagaggatttgatgcagaatactgtgcgcgttgcaaaatgggatgacagaatgaagagacgaatctgtcttccccatagggtctgggtaggaggccggtggaagttaagtatagacgggtgtctggacaagtctgaacacagatgctttcaaacccaagtagtagggaatgaactctaaagtacaatgagcccacaattttgtagacaacaaagagacattgatgttttctgaataaagagtaatgttgttaaaatgatatttcaaaaaatgtaatctgccaatactgtatagggcaggaagtctggtcacagaaaacagttaagacactaaataatacagagatccaaagtcatgtgaagctggcctggattccttggcagtaaaaatgtgagagaactcacttcagagcaagaatcaataaaaatgagggatctacatttacagtactatagatacaggcagcccagtaaaagaaacgggactgaattaggactgataaaaggacttacagtgaagtagtttttaaactaaatctgtgatatcatttggttttcaattcaagaaacatttaccgagtatctactatatgcaaggcatgcagtcttttctcatcatttgtctcattatcttagaagccaaatgtaaaaaaatccagttaattaatttcacagactgattgatgttcttctgcaagaacaacagattgatttttttttatagacagcaatactaattcttccatcatgtccttctctttctgtgcacatagtcctatcgactttggggccaactcaatacaaaagcagaagaaaggcattaagagaacaaggtccattaggcccgatattgcctcaattactttaattccattattcctgttcatattacttctttaatcaataactcttttcagtttttcatgtttacccttttcaaaatcacaagtaataggattacggtcttttgagctcagtggcaacagagtttcataaatatatttctgaatttgtgattgtctccagatctgcaactgagaagtcttaaattgaatcaagttttccagaggccattttatttaataatgcagagcatctccatgcaatataggtgcttttccctgttattccatttgtcactcactgtcaaagacaatcacacatgctgaatggctttctaagtatcttcttcccatgtctaaacctttgggcagtttaactgattttcaaactgcatctcttttctgtacatatttctgacttttgtttaatgtaatccttctaccttcactgacaattattcttccctctaagagtttcatctggacattatgttaactactaccccttccagatgacaattaatcaatccctcagttctacctctgtagcagcctttcaaattaaaggaactctgttttcctctaccgttttaacaaacatccatgcaatgtctactattaataaatgcaagaagctgcacttccagcataaataggatacaagataggtatatggcccttcccttcaacatgtggatagtctaagaatgttataaaaataacttgtgatatatgagaagcatgcgaaaattgcaatatgcagcatctattcaaagttctggaattcacaagggataaaatcattcatgagtagagaaaagttttcataaaggatatgaatttcagtgaggtcttaaaggagggaaggattttgaaaatggaatctaagagagcaaagtaaccaattctgtgtgaaaagcaaagcaggcaaatctagtagagtaaatgattcaatggagtaaattaaagagagcttgacttccctttggaagcagtgagaccaggacaagggtgaagcagtgagaccaggacaaaggtcataaaggaagagtttggcaggatataagcactctttcacacagccattctccctgcaaggagcaggatgaactgaagacatacaaaagaagcttcaacaatgtgtcaaaggaccttcaagatttgatttctgccttcctatagagtctcatccagccctatatccctcttcacactttatgctccagcagtacctaaacagcatggaatacagaaacatgccctgccccctcataccactctgctaatctcccctctgtttcatttagaatgttctctctctaccactcatctcctaccaatttccattcaaatacaatcttctctataaagtatttcctaattgtcccaagccagtttagttgctctgtttcctatataaaaggtatacttagttttatagctccatcatagtcatgcaaaaatcattgctttctcccacataaattataatatacttgatactatgcccagaacaatttttggcacacgtccaaagggtactacatgaatgaatgaatgaacaaacgaatgaacaaacaaaacagagtggtcatatgaacaagcaagaaaaaggtaagaaatgcttggaaaggataatcgtagatttaaaaaaaggaaagtaaaaatatgaaagaattacagaaatttgacagagtttagtggtaactaaatgtagatgaaagagaattccaagcttctgagttccctgccaaaagccactgctcttcttcctcatttttatattaccagctcataagcacttaacataaactcatgatttaaatgaagcaaagatggacccatcagagggagaggcagaagatcctacagaaagcagacattaagattcctattttaactgatttgtgtacaaaaattttctgaaaaatgttgatagaattttgaagtataatttgtttaattaatatactttccataatataataattacattctaatgtcagagatctaagaaaaacttaccatgttaattattaactaaaaagacataagaatcatttttctcatttgcctttttttaaaatcagagtttaacaagttagcaaattattatcaagtccatgagaatcttatagctgagttttcagaaatgtgaaattagagaatgcaaaatggagtaaagacaaagcaacaacaataaaacttgttttccatgttcaaggcacctgaggttttatttctgggttattttctccttaataatagagaagtgttagatacacataagttaattattaaaataagacttattgggatgttataattgttgtagcacacactgtagagtacttcactggctattttgggacagctgaattactagaatataattgctcaccaggccctacctgcagccagcaagggctggcccaccatcactctgtttgatcactgtataaccaaaacaaattaactgtttcaattttaatgaaacctatagacatgcccacaagccacactaggagagttcatgtgaaaagttatgggagacctctaatcaagggtagtaagctcttgcataaaatggaaaagaaaagtaagcaatggagacacaggatgaagttatacatctatatttggtatttggtggaactctgcctgcatgcatcacacatgccataaatatttgctgtttgatttaccaattttcttaggactaatgtcagaaaaatgctaaaatgaatttctactttcattttcattttctactgcctgtcatcatcttataaatccactgctgtctaagccaatgctatcagttggccataggacagcctgcagccccacccccaggaacacaaaatctcctgcggggctggaaaagcttgtaagtaaatgattccaccttcctggaggcctgggcctgacccacacagtcaatctctagacactggtctgcctgcttacagcagctccacacagcactaatccaggggcttaagtgaatttgcagggctcctaaagatgcctacctcactcctaggaggagatctgaccctggactttcactcttctcagcaggaggctcccttttgctattaaaaaggtaatcctttcctggaagtaacagtagacatggctagaaagcactaccccaagaggaaataaagggtttcccaaataagcaactctaaagaacagatcatttaagtgctaccttgagaccagtatcctaataatttatcaacacccaaatctgaacactcaaaagataacttgtaataatgttgagttaaggatgcataaagaaggaagaagacgcgattagggcagatctatttcaggatagcatttagagattaaagccagagaagagaatgttaaatttaataagtgcaaagagatgcagctggaaagaaagaatagcctggctaagtatgatttaaacggtattgaattagctggaaagatatcttgatatactgatagaggcggcatgtaaattggcagttcaacctgcgatgccaacacagacagcagtaccggctcacacaaagggctatattttataaaaaccccatctgctactaattttaaaggaaaactcttatctcatttatgaggttgtttagcctggactaaactgaaggcaagagctccctgaggacaaatgccagcgtaatacctgcccacctctggtcactgcactttgctttgtcaaattaaatttggccatggcctttatagtccttgccattcgctaattcaacaaatattaagcagcaggcaccatactagatgctttagggttatctagaggaattcacttcaggcatgccttgaatatattacaggctcggttccacacaaactttttggtttgccagtgcgtataaagttatgtttacactatactatactctattaattgtgcaatagcattatatctaaaaatgaacacaccttaatttagaaatcctttattgctaaaacaatgttgatacaggaacacagtgtaagcatgtgctgttggaaaaatgatgctgatagacttgctggatgcagggttgccacaaaccttcaatttgtaaaaaaacatagtatctgcaaagctcaataaaaccaagtgaaataaattgaggtatgcctgtacccctatagtgctattggctgaattgtgtaccccaaaaagatgctgcaatccaaatctctcatacatatgaatgtgacatttttagaaatagagtccttgcagatgatcgagttaagataaggtcattagggtgaaccctaatccaatatgactggtgtccttacaaaaaggaaacctggacatagacacagacacacatgtagggaagacagtgtaaagacacagggagaatgccatctataagtcaaggaatgcctgaggctgccagaaggtagaagaaaggcctgcgacagattctccctcacggcctagaaggaagcaaccctgctgacacctggactttggacttctagaatccagaactgtgaaacaataaatttctattgtataaaccagccagtttgtggtgctttgttaaggcagtcagatgagactaatacagactgggtcacaaaataagcaagtccaataacaaaattaccatggtcatcagaactcctaatgtgggtctatctatggaagctttggctcagttaatgggtccaggtttggtcactggatgatatagatcactgtcatccacgtcagttctataaagggcatcaaagaaaaagatagctcatatcctaaggagagactaacccaatggggactgtttaatcctctaagaaggtgattagaaagaaacagaagcaataaaggttaatggaaaattaatctcaagtgacctgtttgggcaaatcaaagttgtgagacatgtacttatttctaaagaaaatgcaaaggaaatttagaaggataactttagataaggggacagagataagactttaattagaagtcttcaatattcatgtatttacataagtgttgaaaagataaaggcttcatgataaggtgataaagatgaacaatggtagtacctttatgaaaactctatagaagttggaaagagatttcaagtgaccagtcctatttccttgctggctgtttacagaggccctgtcacaggtactttgtaaatgctccccaaatgcatgttagttcagagatcttctgccacaggccctctgaaccccagatataactaagacacacattagagaatgatgccagaggtataattaaactacatcccttcccatatggtgacaaccaacctgcttgttatttgtggtgcacataccatccctttacctgagcatggtgagctctctctcctccacatattataaatacgacatcatgctggcagcaaaggacctgtaaaataaaggccatcttgttagaaaaaacttcaaacatcaatttcagagagctgactgaacatatatatgtaagcagatgcaaggtttcgcctgcaaagttcgagctgaacatagccctttccatttctggccactgcaattgaatgcccttggagaaggtctccgcatggtgctaacttggtaacaatcaataaatgtgaaggtctcatcataaacaaagcctccgaactgtcaatctttcaaagagtatttctgctttaaaagtagtctttgttgctaaagtagctacactaaagccagtgctagggccagggcctcccaaatctaagaaagcctaaataaataaagctgtgtgttaattaatggcagtacaatctaaaaatgtcattcagaagcagttttaggggttgactggtatcagacgtactgtttttaagtatgagaaattcttgcaagtttccaaattgaaataagagttacacacttataagctttctctcaggaaatttgttgttctgcaaactataaagtgcacctagatattttcataggataaatcccaactttattttctagaaagtattttaaagccttgttactcagagtgtggtccacaggcagcaaaatcagcctcaccagtgagcttgaagtgctgaatctgagaacccacctgagacctactgcaacagaatctgcattttaacaagatcctcagataatccctttgcacattaaagtctgagaagcatggttttaaagtgccttatacatcaggcctgtgagtgctagaatcataagaaataggttgccccgaacttcaagaccatcctctggtatctaaaacttaatggaatcacaattcctctattataattgcacgaatctggaaacaaatattctactaaactctccagaaacaccttacatctggctaaatctcttttctttccagaacatgtagactaattgtaaacagataactaaaagcatagccaaatttggaagtattttacactctaaagaccagcatctgtagacattgaagatagacattatttgttccataactaggtgctcagtaataactaatactgtgtaaagagccccaaagtggaaggataaaaattaccacatggcatgatagatctaatagggaaaggtcagcacaagaagccaggggcaggggaaggtactggtacacacttagaaagtacctgacccaggtgggaaacactgggaaggcttcctgagctgagtattgaaaaaggatgaggaaagatcttttaagaagcagtccgcctacaggtatagtgaatgagggcaggtcactagaccagcaaggagccaactaccttatttcaaaaaaatatccaaatgtgattttatcaagttttttcagcttctttaatatttgtatgcatgagctataaatgtgacagcccttaggaacacgtctcttccctttcaactatcctacaagacaaggaggaatggcaaacatcaaacacaagatgcactactcagaagtcggctgcaaactgcaagggggcaggaatagcagaactgtacctccacatttgctatttgatcacacagagtgtcaatgaaactgcaaccagcaatacggggaccataaagagaatcacattaaagttaatacaaaagtcaggaaaatgtcttcagcaagggacactggctatttggcagatgccctgctgggagtaattgaaggctctcagtgtgaccaaagtatgcactcccctctctgagcccttctcttcctcctgaatttaaacagttcttatcccatctccttccccctcacttattcttgtgatttctctgactcattttccttctccctcactacctccaagtgccctcctatctctaattcaactcccttcttttccctttcaatctgcccattttttcaccccttccttttgtgagaagaaggagctaaggcccttccttttgtgagaagaaggagctaagggagagaaggaaggacaaccaaacatctttttttcccttttttctttgctcctttcccttttcttcactaacgtccccacatttttatttccctcttctatcctctcttttctttcctggaatcaaatccctgttatcagtacataacctgtcttcccaagcatagagcttagaaatgataggaaaattgctcgactcctagactgttccgttgtaattcttgggagttctcggattctcctaacccactgccaggtcaatgattgagagaggaaagaaaaactttcaaaacctagcattttcttagcatttcctaaaatgtagaacaattctggagtacttggctgttgtactgaaaggggataaagatgtaaaacatactagaccaaaggtttcattctacccctggttctccctaagtgtatttcctccaacccaccatgaaaccaactcttctgttactcttattcctctttctgcatatcccccaaaccctcctggaatgactgaaacacgcttcattaccagtaagagccagataaatgacaaggcaggaattaacagagtgcttctttacaacgacacagagtagcacacaaagagcctcatttaatgccccattaggaagccttacaagttacagcttaataaatatatgaagattatcgtaatatagaaaacatctggtaccacttcccacatgaaatgcacttatggagaactctacagagtaggctgtgatatggcaatcttgcatatagtctttgaactgcagaaaagcaatttggcttcctttaggtatttcactctttattttcaacatatgaactatgaacgaaactttgtaggcaaatctgatttcccaatctttttattccagcccctagataccatatatgcccctgaaatagagtacatattcccaaaatatttgctgaatgaatgagttaactagtcaaacaatcactggccaatcaacataagccttaagacacaactgaattaagtatttgaaggaaaatagggctgggagcggtggctcatgcctgtaatcccagcactttgggaggctgaggcaggtggatcacttgaggtcaggagttcgagaccaacctagccaacatgatgaaaccccacttccactaaaaatacaaaaattagctggcatgcctgtaatcccagctactcaggaggctgaggcaggagaattgcttgagcccaggaagtggaggttgcagtgagccaagatcgcgacactgcactccagcctgggcaacagagtgagagtctatctcaaacaacaaaacaacaacaacaacaacaacaacaacaacaaaacaccagtatttgaaggaaaatatcacacaataatgcattttgaaaatttcccctagatttttggtattgacatctgatatgatctggctctgtgtccctacccaaatctcatctcaaattgtaatccccacatgttgagggagggaagtgactggattaagggggtggtttcccccatactcttctagtgatagtaagatctcatgagatctgatggttttataaggcagttttccctgctcttgcatgctctctctctcgcctgctgccatgtaagatatgtctgcttccccttccaccatgattctaagtttcctaaggcttccccagccatgcagaactgtcagtcaattaaacctcctttgtttataaattagccagtctcagttagtatctttatagcagtgtgagaacggactaacacatcatctaatcataaggtcaatatagggtgttggatgtaactcaactctcagaactagaatgaaaagaggtgctgctttgggcagagaccctgagcagtcagatgtgtcaacattctaacagcaaatgaataaatggaaaactctagaaagcaaacaaaagttctcaaaaactacagcagcctagaataaattagtcaatccctctatttgttcccatgatactctctacacataccccattattactgaaggtctcattacaccattacatttcttcaaaggtttctgactcaccctgggaagtgacgacctgatcacagcccactacgatttccgaggcaagccaaaaagaaacccctagaatagatctgctctacagatcaggaaagggactggaatcctattttgtggaaggggaagaggagacatgacaagttgagctgtgtctggatagagctcaaggatccctatctctctggattcacctctgaattcagggactaggctagcagttccccaagagcgagatagcaagtcactccatttcaatcaaccaagagtttagtggaaaagccagtagtggaaatttgttgtaacttgctctaaatgtcttaataatttaaaaaatatgttttattaaatatcatcaatagtgttccagatattggaatctactttgtattcaaaaactatgagaggtgctttttaccattcataccattgacatcattggactgagatcatcaccccttcagaaaagaactctttagaaacctacccaatctatcatagagagagcgagcttcctgttaaccttcaactccattgccccctcagacttgagccagttttaacaaacgccctgcacttacatctgaaaaggagttgaccctttgaaggaaaaaaatgtagacacttctaggatatatgtattttagtgtaactctaacccaaagtaaagtattttgtaaaaactttagttaagtacttactaaagtaaatttactaaagtaaagtaaagccttggtaaatctctcctactttattaccgttagataatattccctttaaccaatcctatttctccacaactatccactttttcatcacctagcataaaaataaacaagtttaaccatttcttcaggtctttatgtccatacgaaggcttctttgtcatgtacaatttatatgaaataaatttgtatgcttttctctttttaatgtcttctttaagaggggcatcagccacgaacttaggttgaatgaggaaaagatattttctccttctacaccattttaaagcaatccctagatactgctcatattatatctgcatatcgtgagacctagatttgttaccattcaacaaacaggggttctaataataaggaattagagaaaaggtaaaatgttctaaccttttcctcttaagtttcactttgagatctccaatataaatttcctaattatataaaaaccaccgctctatgatttcagtgctataagtctgatttcatccttatttccagaaagaaaaaaatagttgcatttgccatctgaattcactacctacagttctacagctatgtttttgtactggggcattgaaggacagcaaaaagtagggacaaaaaagtctcttacctcccaaagccatctgagtgccctctcaccctgcaaatcacatgccataccttttctagatcaattctttgtttagtttcaccagtacatcagcatcttcaatttcttctattcccatctcaataagcaatggcttacagaaaagataaacctatttttttaaaaaaagcaggtttttaaaaacctgcttccttccataaaatttgtttgcatgtgtgtatatatatatatatatacatgttcgattctcatatgatttccaaattagaactcaagttcaaatgatcaaatcatgcttacaaaacaagatctataaaattaaaacagattgatggaggaccccttaccaccacttctaccatatccctgacacatacgactcacccagaggatccacttttcagtccctaggtgcagccaagccctccactaaacaaagctcttcctgacagggactgggtgaatgcctctataagagatcaccacatattttcatagtttacaaggataaagcaattacagcttcagtcgttcatgaataaagcctctttaacattttaatgagaacattaactcagcttcacttggtttggcctctctagaaagtctgttagcctaagagaaagtttctttaaaacccagtaatgaaattgaggcctctctgtgccccacagggcataactgggctacaaacactggctggactatttctctcctgaagtagcctatattttttgataagactacagtttggtaaatgaaagaaggcatctgaagaaatacctttctctctgcagtatttgtgtgcttgtgtgtgctcactcattttatatctgacttgtctcctaatttgctttttatgttatacacagctttgagtacaatgtgtgactcaaaaaatgttaaatcatacttttctgcaattttcccttaatcattttctactgcctctgttctctcttgccgcgtgactgattcccaccaaggctaccaaactgccattcgcctggagacccattaaattcagcagaaaaccagcagagcttcagaagtcaaaggtgaacaagaaataattcccagactcagtgacttaacatgaatttctgcctcttctctggaccaaaccaggagcagagtgaatgaaagagtttgtcaccttaagagtaaagctaaaaagaacgaatgtccaagacacacatgcatttaactcttcaaacatctgctgagtatgtattatgcagcaggaattgttctaggtactgggagtacaagccaggaacaagacaagactctcactcccacagagctaaagttctaatgggaaagacaggtgataaaccaaaaagagaatgtcagagtgcaataggtgctatgaagaaaatgcaacagggtgatgagaggctagaaaaataaggtgaaaatttaaagccaaacagagcaaaaggctacagcaaaatcctcaaggtcataaaaagacatggaataaccttaaaagcacattgctaagtgaaagaagtcagtctgaaaaggccgcatactataccattccaactacatgacattgagggaaaactcaaactatggagacagtgaaaatatccatggctgccaggggttgtgggggagggaagggagggaggaataggcagagggcagaagattttaaggccagtgaaactattctgtatgatactacgagtggatacatgtcattatacgtttatccaaacccatagaatatacaacaccagaaacaaaccctaatgcaaatgatgaactttggatgacaatgatgtgtcatcacaggttcacggattataacaaatgtagcagtctgttgggggatgctgataatacagcaagctatgcatgtgggttgtggggagctatatgggaaatctctgtacattccactgaattttactgccaacctaaaactgcccctcaaaataaagtctttaaaatccttaaagtataaaagaatgtggtgagctgaagaaccgaaaggcccagcttggctaaagcacagtgaacaaggtaaccagcagagtggctagagtaagcctggcaggtcacgtttagaagcctgaatttcattctaaaagcaccaagaagccactgaatagtttcaagcagggcttgtcattatgtgttctacatttttgaaaggtcactctggctgctgtatggaaaatggatcacagagaggcaatcaacagaggctgatgatggtggtctagtctacagtagtagcaacagagcagcagaagtagatggatttaaagaggagctgacaggactggtgatggacagattggatgtaggggataaagaagaaagaggaatcaaagatgatttctgaatgagaggagagaccatgcactgagatggggaaaaccctagctacaaagaccacacaaagtgccatgtgccatggtacagatctctggaagcagtgggaatgttcagtcctccaagggaaatcaagttcagcttgcttgatctctgccttagcatgaatagcaaatgtgtgtgtgtacacatatacacacacatatatgcatatatacatggatatatgtaaacatatatgttttaatactgtttctgaaattcaaagcaagttttaaatcatgtcagcaatctttcgaagaacagagaggcagggttgttattgttgtcccaattaacatgcaaggaagctgatggcaaatgaggtgaaaggtcttttgaaggtcacacagcaagcagtcagcagcactgaaaggaggggcccggcttcctttcaggagtccctgccgtacatcacaccctctgcctatcatctggagcatgtggggcaccctgcaagcactgcgagagaacattctcggatgaggtaagggtggaggtgctgctccctcacccatgccattttctttttgctcatcccatcacaggtgctattttaataacccataaaatgtggctgataaaaccaaaagatcgttaacaccaaagcaaactttacagagagcaaatcaagtattaaggtatattgtggcatagatttttagacagacatttaaattatgaaccacaaggcatctactgcacaagctctccaaatccttctgagggctgcacaggtggagattcctcatgaatggaagaaacactcatgcccaggaatcacaggcctatcagtagcctcatctggaattcttcatccagtctttaggtttctcaaagaacatcaaaagcactgcacacattttaggaaaaaaagacaaaaacactagaaccaaagagttcacaggtctggtctttgtaacattatttaaaggaatacaatttatctagatgaaattaccactaaaataagtcagatcatatttaaagacacatgctaggggcaggactgggaagcctggacactttgtttagtctgtatactacctgtacaagttttaaaaatacactttcatttttcatctaccaggctctccctcagagctgtgaggactcccacctcaaatttagaagtctgaaagagaaacagtgaaggggtgtccgcctctatgtttgtccctgtgagtcatacattttctgttcctactaaatgtgggttggttgttttctagttgatttgcagacttcctctctgctgcttttctctaataatatttttccaaaggacccctaccttgcaagcacagtcccactaaggaacaacaggcaattatgcatgatcacagtgatcacagttactggggcctgaaataactggactgagaacacccacagaaaggggttcagggaaaagaagtttgagatagctggtccgttgcaccctgacctccagtctacagatttagaaaatcacttgtcagggctaaaatcatggtggtcatatgtgttgccttcttatgaagatggagtcatttccatttattactggttgtcttgccaatactttcacaaagatacacagtaatatgctctcagcacacacaaagtagagttgaaacttgccctgccattaaacactcaagtgggtcaccctctgaaactgcccaccgagtctcccaccaagacccttcaacaaggccttatctctctgtccaatctgccctacagaaccctttttacttctggacacatcactttcccattttctcatatcattaaaattttctttcctttctgggagtgtagtcaatgagattggcagagaatacaggaaaggcagatggcaagcatgaaggcaaactgggagtaatttggaggggcctgggttcagagagcctgctcccaggaaaagcccgagtcagtcagccatggagatggactgccaatgggaggcagggagagcaaagagcacatgagtgagagtggccaaaaggaagcaatgggtcaggaacaagcaaagattcaagatgagggcttttggtgccactatgagacatcgtacaggtggctctgaggctggaagcaggaggctgtagagtgccaatgccacctaaactggaaagggcaagaaactgagccctcaaaaataggacaaatactgacaattttctcccttcatactcaaaacaacctctctctagagcgctctttctcttctttccttcaaatcttgagcccaatgtttgacacttgataccttgaggtgccaattatcatagtgatgattctataaagtacacaatttcacactataactttctttgcaaagcatttttttacatgtatggtatcttttagttctcacaatgttgtgacataagcattattaaatgcacacatcctgactcaaagagatttagaatcatgcacaatgctacacaagtgaaagaatctgtatccaaatccaggtcttctgacttgcgatcctgtggtttctagaatatactattagtctatttcttgttatttttatttatttttaggtttcattttattttaaattgacaaacaataattacatatttatgttagtctgtcttgtcctctaattctctattctctacatttcactaatttagacttcactaattcggaattggtgaggcaataaaacatcatttgataccctatttacttggaaatctgggaggtgctatacaaatgtgcatacaatatatccaggaggctgaatggggaagctaccatcctgaaagtggagaaaaaaagaaagcttgccttcttttagtcaccagggccaacatcagcaatttaacatcaatatgaaatttttaaaatggatttgctaactataaatgacttaattttgaattcatgtctagttaatattctataaaactcaaaaaaattcctcaaatataaaaaatatgatcttaaactaatggtacttagtctacaggctaatttttaaaaactatcacatccttatgatttttgtcacgtctttattatgtaacatagtatcctgtagttcaatttttctgtgaattcagatctgcctgtccttgtagagtctggcataaagttggttttcaaatatttgttgactagatgatggatacatacatgaatgaatgcatgtgtctgtcaagttacactccatgtcagctggagagttaaatgccacttccatcaggcacaatggaccagtcctggactttagaattccacagatacagattccaatctagctgtttgtcagctacatcatcttaagcaagttatctcacctctggactccaagtttcctcatcagcaaaatggtaacaacactgagtagcactcagaactgctgtgaggctaaagtgaagtcacacactcgatacactgcctaggttgccgccattaatatagcttatttatcctctctcctctctctgtctcacatttagcatgacccctttcataagaccaaccttgataatggtgtttcagtatataaaaccctgttgtaaagttaatggccaaacatcaactttatttacaatgactcaatttcccctctactaacattaaacttatttattcatggtctagagataggttgttatgcatagcaggtgttcaataaattttgataattttagaaaaaaaatttccagggaattgaagctcactcttttaggcactaatactctcttcatttgaaagctttcaaaaatatactataccctcaaccactatgctgagcagcaggttgaaagaactctaacctcttcttgactcagttatcaacatgaacttagacttaacaccgtaatgaaaaataataattccttgagggttttttaagtcagtagatctgctcgtaccaaatgttcccagatttctatgccatgatcatttcttccatttcttcctgtggtcagcagcatgagacactggggaatgaacaagatcaagtccctgtcatctttgagggtttaccaggaacaattcccagctatttcttatctgtggcctcatgacacacacacacgttttggtaaaagcttcaaggagggaccctagtcaaaggaggactgctccatccctcatgttttacacataatacctactcaacaatatttaggaagtgaactgagtaaacagtatgtaacttttgtaattagtatttggagataaaaactatttgtagtttctatttggagatgtttttctaacccatggctaggccctttactcatttgtggctacatttcttcatctttaagataagacaattgggttaaattatccctaagatccttttcaacacttatattctatgatctaatactccaaagctccagatgatagaactgctggaaatatgaccactggataagtgaggtattagaggacataatgaataaacaatgcatcctttgccttcaaatgcaaaatcctatcaaaaagatattatctgcatatcatggaaacaaatgcccaaaagattagctttcttacttctttctctcacctgaataccatatacaagagtagacatattgaccttggagtgtaaacatactgacctttttattttccttgtgtcaaatgttcataataaatgaaaaacctaacatatctcaaaagaagtcaactgcattcaggcaaatacaaccctaaaggggtttttctcataactaaatgcagtaatgcaatgcttcactaccttttgttcatagttatttcctcaaacaccacttggttcatatactaatttattcacatatttgtttagtgttccagttttactctttatacagaaatgaaatccaactttcttaaagtatggtttaactgtattaaaactaaaacttctaaattaaaagaagtttcataagtgtacacagaaaagaagtagatgctttcaaataacaagtcaaatatttttcaacaagtaccttgggaaggcattctgagaacagctttgcccctagaggcccagggcaagagaagtcatggacaactctctattccagataggatggtgttccttcagttcaattcaaagtataccttcctcaagcactataccaattctaaaggggataaaaaatgaaaaaatacatcatctctgccttggagaagatgcagcaagactgagtgcatagggtaatgacattggaaaatgatgtcccaggatcagatcccaacttcaccataattaactgtaaaacttcggcaagttatttaacctctctgattcagtgtccttatctgcataatggtgatgataacagtacccacctcattgagttgttatgaggattaaacggagaattactcctaaagcattaagaatgattcccagcacacagcaagtactcaaggttagtatcatccctgtgaacatacaacccatgaactatttttttataagtaaaactgaagctataacagatgtcaggaaatgaaaagacaaaaacaatctggaaaattatttttccaaccttcatcattattcttgtgtcttcctgatgaatcctaactacaactattcctcagagagatatagagatagcagagaatggaggtgtgaagaaagaaaaaacagagaaacatgaaaggagagaaagagagagcaaacaggaggtgcatttctgtattatccaaagccattagaaaggcagacactgaactaaagttggagagaaggccacacttgctgcagccctgccctgcccctttcccttctcctctcagaaactccttcctcaagcattgagctaccacacttttgtcctaaccatttctttgcttttctttcccatttatacttttgttttatagaatatgaggagagactttatatgttttatagaatggaaaaggctttagaagtcaccacctaacacaatcctctcaatttatacatgagaaaaactaagggcctgtaagacaaagacatttgtcctgggttgtatagctctataatggcacaaacaaaatcaaaactggactccctaagtccacaccatttcccttaggacaacaaaatgtatacatttacccaaaagcaatatggctagcctttatcccatatggcagatatttaaatttttctcttgggaagaaaatcttgagaattttttttaaatgagttaacaagaatcttactgtttttaatttaataaatgtgttttattattgactttattgcttgctaagcctgaaattagatttctctatgtttgggtatgtcttgtctaaccaataacaggacaaccagactgcaattaaacagatattcccacttgggccataatgcataaacacacacacacacacacacacacacacacacacacacacacacactatcaggaggcacttaaagtttcagcacattctcgttgtcacttttctggcctgtttaggagaaggagatattaaatattaaaaggctcttctaatatacagacttcaaatcatttatcttccaaaggaggaacaagtttcttgtcatttcctcatatgctatttctaaccccactgcctgcccattgtactccataagttttcatatctgtgctcagaatgtccttactatgctttgcccagatcaggtatacggcctcctaaacgttcactgctccttactcccagccttcaactccataatgaacgactgaggctctgaaatcagagccttataataatatattttttaaatggagccaataactatacttttctgttgttgttatatgtcagatctttaagtataaggatctggataaagcaaacattttaaaacaaacaaagcctcctggtttgcttatactctccccatttctctagtattcaaggtagctatcttctcttccattcactatgtggggcttcataaaaggtatgaactcactgtgactaaaggaaaggttttggcagtcttctcacacttgtttagataataggaacatctgaatctgggccactaaaaccaactcagttccacggtctaaataggtgtttacttttagtaggctagacctgcagaaggccactttactagaaccatgcttggtaagtattatttacatggatctatactactactactatgtgttttgttttcctttttctgttaatttttctttcacagcaaatgcaggctggccaccatgggtggtggcagttgtagttaccattctcattcataagaaattcaataatagaaaaagtagaattcaacattacaaaaaaaattgcaaaaattaaacactcaaagctcagaaagagttgagccaagatttgaaagtttctaaggaaggggaaaaaaaaccacattgctgcatcctcctaccctgcatgccagctagcagtggcagttcagtctctccagatgcctctcagaaaaagaaatgccacaaatataacaggagttgagatcctgggggagccaattagatttaaggtgctttcaaaattctgtaaaagaaaaaaaggcattagaaaaaacctggcacttgaaatgacattttatgtgttccgcttagggcctttggaatactactcatataagggctggttgccatgcttataaaataaactttgggtttttaatataacagaacaaaatcattagctagtaaaacaaacttagcttcagagggagaatgtggcacgtcaaatctaaggtatctcatcctttatctttggaattgtcagccaaaataagacaaatcaggccaaggtcaatggcagacactctactgagaaactctcctcctaagactgactgttgtgtagtactttgaggttctggcacttgtcaagcaattatttgggggtgagctgcaaggcaacagaaattttcaggccccccacccaacaccataccagttcctcaattgcctttcgatatcccatgacaagagaggtaggggttgggaaggaaatggggagctcagaagggactgcagtgtctccacagttacagaagcaggtctggggtccagctggtgatggggagagatgcactacactaatgtaatggctatttgtcagtccattatcatctttcccaatgagatgcagggcagatgcatcaaagacaagagaatcagacaaaagacagtgagatttaaaaatacaccaacttcagttgggtttttgggatgatttcttttcatcccaagatgaaacagccacagatccacctccaaactggaggctcaaccaggctgtctcctcagagccccactcactcattcaccttctctttaatatggtatgaaagcagtcaggtccaagaagccagcacaggggtatgtgccctcctgaaaaacattccagggctacaggacaaagacaactttttgttctaccgtgtagttgaatgtcttggcgacaccaccttgacctcctcctcctggtagaggggtggttatttcactgcctctggccagaattcaagtctataaatatgtatttagacatggttctgtgtcagccactgaaccatgtgtcgcaaaggacactatgggaagagaactcatattctgcctccatagattaccctctaagctaatgaagatgtacatgtctgtaaaggaagcaactttacttgctgaaaccctgttatttccaaggcctaccttaaaatgtaacctactctgcagtgagcagagatcgcgccactgtactccagcctgggcgaaagagcgagactctgtctcaaaaaaaaaaaaaaaaaatgtaacctactccataaggttgtcctaaccagaaacaacatctccctcacttgagctcctatgtccttgtctatcttctattttagccgtttatgaaattgtcttattgcccctttaaattctttaagcagtgatattttaataactggtaagagcaatatgtcagaagatgtcaagttcttgactgtgtggtagacataggtatctcaattattgaggaaacaaagtggtcagaaaggatttcactcagctatatttgatgggacactaaaattgaattgtctagaggaaggttttaaattaagtaagaagatgagcaaaagtcagatgtcccaggatgtctcctagcacagatatttaaaatgtaggaagttctgacaaccttctgagtggccatgaagggtgatccaaagtccttttatagcagattcatcagtcccatgatagcacctctaatccacactagtgacagtaacaactggagaataataatatatttgtttttgaggccctggaacatctctgaggactatcgccctacagagaacaggtaatcttcagaagcacttgaattcccatgtttacatttaccacagagactgatatgacctctttggagggaaggaacaagtaagagctaaactaagccaatgcttctttctgcatagtagccatagtcaaccatagacagcgaaagttgtgtctctttacagattttttggagcaatattttccctaattacaaaataggaatgcatatgttatactcagtcaaatcaaaaaaaataatgatcatagctaaataataccactataaatatttgaactttgtaatggttttcaaagaagtagtatttagaatgtctctttagaactgctagtttttagaaattactgtcccttaagcatttactttctttttggccttactgtgtaaatcatgctgctcttcctcgatttcccaggatccccaaggctgtgctctacaatgcttgctttaaataaaacttggtgccaaagagtctgccgcagctttcaagttcacccggacgacactttcctacaatgggtctcttcatacttcactatatccggatctagttgatccgcattttctgcacaaagtctcacttcccagcaattgcaatctgcatcttgcatagtttccttctattcccctgggtagcttgctgccaggaaggcagaggagaagaggagctttttgatgctaacaaggcctctgtgtaggactcatagctaatggtaaggagttgagtatggcatttctcaggggagcccaggtgagtgaaagtgtaagggcacagctgacagccatgtgcgtacctcgctgctggcctaaagtaggtcctccagcctctgagcagtaacctgttcatggcttacatcatgaaaaaatgagtcagtgcacttggcaactcatgccctaaaataggtaaggcctgaactcaaaaggaaattctgaaagaaaggcattatatggtgacaggtttttttttaagttgccggtggtaggataaaagctaatgaattatgaacatctgtattattctgctgtcttcctccttctggacttttagatgactgtaagctcaactttgagctcagctagtattttctcctgggcattctgagaaatgagaacacatttgcctgctgggaggcatacccattacttatcaaattagccctcctcaagaatctaacagacttgtcactgcctttagaaatcccagaaggaaacacacacacacacacacacacacacacacacacacacactacatggttgaaacactcagaaatctcttaatatatgtgaagtcttggccaacatacagcaaccaaggagtcaaaagtcatgtatgagtccttagggataatctttaagcaggctcttgccactgtcatgattggaatagcaaaggaaaagcacctgaccttctaaacaaagaagaaacaaatcagtaaagcttagatattgggacttaataacaaaagataaccttaagtagctctcgggatataccaggactttatttgtgttatctcatttaatcctcatgataatatcttgaggtagactggtagtattaatattctcattttttaagatgagaaaatcaaagtgtaggaagctttagtaactcattcaagtctcccctgttaatcagagatgggatgtgaatgcatgctatcaattacttctgcttatcagtggtcaatgatattttctatcaggattagcctacatccaataaattttgaaagatgaaggaaaagatgagcagaaaaaaaatgcaggagttccttattttttaacaaagtgaagataatacagggaaagaacacaatgtcagtccatttctgtgttatctggcttactgaggcaaaaggaggttctgaactcgaaccatatgaatgttgacccacaaagaccagggtttgttcttagctaagtgagtctttggttaaagattctcacatagactctgagaccttacacacatggtatcacactcattcaaatgcaattttccccatttggctatttcaagtagtcaacacacagaaactgcgttttcctcctgtgtctccttggggaggtcagggaggggtggtgacatcatgggaacagtgtctgtcttctctcctatgactcatccgagtatgtcaaagaaatgctgctaatgctagtcctgcagcatgaattatcctatctgccaagcaaactcgtggaaaacagcatactctctccatcacagccccaaagaaaggtagaaaaggcagcaatgaaaaactactcatgcaaaaccaaagcacaagagaagtgaactttactcacttcctccgctcctcacaaaaaagtatatatacatttccattttcatgttgccagaaataggtaacgacggaatttgattcctcctctgtgctctcacaccactttgtacaaattgctaaattacaatgcttaccatattgtcctataattagattttaggtgtctgccttctcactagtgtaataactccttttttcccttaccatttgtattccaagcatctggtatcacatttaacaaatatttgctaaacaaacaaatgaaaggttgaataaatggcatttgctcaagggctctctctaactaggacaaaagtaatgttctttttcctctattctttgtgactgaaaatggctgacacagtcatattggacgggggaatggatcatgtcaatctggagtattgggtgtctcagatgttctggcagttactgaatgagtgtcgtatgtgtggttacacatgtatctcatagtttcctctgcttttgtattctacagagtttgtctcttccccacttgtacccaccaagccagcctatttcatgattggctcccttaatcacttattttctttgaacttaattaggtcaattaaaatccttactctaagaaggcactcttcttattttaagttgcaggagagagaggagggcgggaaacatcacttgatattaccctacagtgcatgctatgttccaagcatgatggaggctggatattcagcaagactcagtacatccgtggcccttcctcttgcagaatttacagtcagtgggagaaagagagataaatcataaggccaatcaaatgtagtaactataatgacagatgaagcacagggtgctatgggccacacaggaaggaaaccaaagccaatctggagatcaggaagagcctctagacaacataccttttacattttgacctgagagataagtgagacttatccaggtgaaaggagaatgtaggaagggggaggaggagacccagaaactagagagaacacaatataaacaaaatactcaaagctactgaggagggctagtgtttaagtgagaaggcaaactcaggctccagctattttcccattgcccttatcctaagggcaatgggaagcctttggaggattttaaccaaggtagtgacatttggatccgagttttgggagagagacctgggttgtaggtaaagtcacatagatttgggagtggtatcattaacgggaggttaactgcaacaagtagaccttcaacatttccttttagcaagattactgtggtgccatatggagaatggattataaaactgtgagactagatgtgtagaaaccacttaggatgctatttcagtagtccagatgaagatggtaatggtgacatttgaaatggaaagaagtggatgggttcaaaagaatactagacagaattagcaggccttggcaattgaccagatgagaggttggcaaaatttatctgcaaaggactagataagaaatgcttagcctttgccagccatatggttcctgtcaccactactcaactctgctgtttagtgagaaagtggacatagacaatatataaatgaatgagcatgcctgtgtccccataaaaacctatttacaaaaaaacaggccataggccaaattcgacccaaggctagggcatgccaactcctggattaaatgaggagtgtggcaatcagaatagtaaaaatggctcccaagtatgtgaactcagcgtctggttgtccggggctactatttgcagagaaaggggcacaggagaaggagcagggtcagagggaaggaggcagtgaccagttttagacaagctgagttcaatatacctgaaatatatcacccaagatgtgtctaataagcagttagacagttggatctcagtttcaggaaaaaagatctgggctctaggtaagttgttttagttagggtcatctaaaatatactaacaggccacaaaaatcagtggcttcagtaataagtatttctttctcatatgatgacagaactcaggccagggctgggggaggacagttgttccaggagcccatctgatggcagcatccatcctactcagccaaaaggaggaaagttcagagacaagcatttgtaggaggtttctatggagggatccgaacttccagagaggtgacaaatgcagtctagctgtgtttgtttctaggatcaggagtagactgaattttggtgaacagctaccaggatctaccaccagagtcaaaaatacatagagaggtcaagaaggcatgaaaatgaataaaagtgattcaggcaactataaagcatgagaccaaggtcagagctccaaagaacaccaatgttagaagatacactgaagaggtaaaaggaagatccagcaaagtagaagaatgacaaaacaaaaataaaacgagactgtgttagatacttaatcaatgtatgtagaaatgtgagtacaaatttcatcattaagcactgagcacatctctgacaagctgacattatttggtgcctctgatatttagatgaaaaataagccaaattggatttaagagaaaatggcaaaatcagcttctcgaaaaagccagattttcattaccatgcagatggactgctttagggctatgtgtcataatattcattttttccatttacttttgtgtccataaatcaagctctctctataggagaaatgtatattctgcatcaaacattttatgtgatcttatacacatatgaacttaatataaatatgaatatacatctgtcgttgtatacacacactcaacactcaaaggattcattatcaaatgcatttctttttcacttccattttttgcaattttccatgctctctgctttgcccaaggcttcttctccaccacccaaaccatcccactttgcatgtctgttcttggctctcagtggaaagaccaaggaaaagaagctagacttcaccctgataacattttaagtccttctccattattagagaatacaacagagtctgtagcctgaatgaaaaatccaggccagaacatccatcccctgttccttggctcttcctccaagagatctcagctaggaaaagggagatctgaaatcttgctggcatgttaccaactaacagagtggtatccatcaatctagcctcttctctctctctttagaatgtaaggtattcaggacaaccatgggagttctgagatttttgtatttagaacactctttttagcaaaagaacatccagccttgcttataaataagttaaaaaaaaaaaaaaaaagacaagcagattaaaaaaagctgcccaggaggcactcatagaaaaaacaaaattagtaacctcttctacttgcccagcataaattattagtgtactcagcttgaccaagtgactatttataagtctgaacaccatggtgttcaataaatataattgaggatggtgacaatgctacccatatttccttacttaatgacacccagttggcagttcagtagcacaaatcatatgcattttactcttcctttactcgtcttcacattgtaactcatatcaggaatgaatttaaccattggaaatagccttccaattagcaaaattaatttttcgtttgatttgaaagagaccagccagtggatataagcaaggaaaaactccgcaagcagcatttctggcttctgtgaggagattttctgtcagctccaacaagtctttcttattgctacttttatagggtcatcattattcaacgtctcctagcttcaaatatcatctgcaaagcacatctagaaatttagctggtgatgcagataatgtatgaaactgagaaaccactacttgtttcccactggctaagttaaatatatagtttagaagattttagaacctctcagctagtctgaggtgggagaagggcaagagttcgccaacaccatgtgtacatagcctgtgaaacttcttaggcatttgttcaaaagagtatgtgaatgcaaaattcacaatttggacattttatctagccttcaattggcaactaggctggaactccatcaactttgtttagtcagatccttctctcatctctgccattcttctaaagccacaaagtcaaccctgccatctccttctcttcacaagacaatcttgtctcctctatgtctagaaaatcaaaaccatttaccaatactgtgaaacttaggaccacctttcactctcccatcagcatcatttttcataagtaagtaccaaaacaagtctttcatctgcctctgttctctcccccaccacccctatcttagtccgggtgcccatcactccttacttagactagtacctctcgtcatcttcttgcctactgcctaatttctctggaatccatcctactcgtcttccatgaaaagaaaaaaaaaaactatctaaaacaccaatcagatagtatcatgcctttgtataaaccctcacaacaattacaccatctgagaataaatctacatttattccctggttacaacctcatttctcatgacttctgtcacacatttcacaccatacacacacagctgctagtcctcacctaagagactttcacactcaagtctctgcctagtatgtacctcctcattaatcaccccaccctcccttggttcattcctactatatgtttaatgttcattcagggataatctcctggaagcccacagacttttttttttttttttttccgagacagagtctctttctgtcacccaggctggagggcagtggcgcgatcttggctcactgcaatctccgcctcccaggttcaagcgattctcctgccacagcctcctaactagctgggactataggcacgtgccaccacgcctggctaattttttgtatttttagtagagatggggtttcaccgtgttaggcaggatggtctcaatctcctgaccttgtgatccacccacctcagcctcccaaagtgctgggattataggcatgagccaccgtgcctggccatctggactcattcttaatcctctccaaacactctctacctaactctgtgagtgaactctaatacttctatatgtgaatctacttttttatctctgaattagtggatggtaattgacatatggaacagaatggaggaaagagaacttgacctaaggatccaggggaacttagtgtatgatgactggaaaagccacggattctgaaataatggtgttgggataacaagttaacatacagaaaaaataattttggattcttactaagtatcttcccccaaaattaattccagaaagattaaatctttaaatgttttttaaaatcacagaattagaagaaaatttaatggacaatttctataatccaaggggagaaagtttttccaagtataattgtaaaagccagaaactataaggattgatacatttgattgcacaaataagtagcttttcaattgggaaaaaaaaatgctataaatccaagtaagaagacaatcaacaaatagagaaaactgcatatttagcacattgcctgacatctaatttactttgtataaactgatttatatgtagagggctaatctccctaatatataaagaactcttttgaaccaacacaaaaaagacaaacctcctattagaaaaagcaaaacaaatgacatgaacaggcatacaaattgcctctaaatttatgtaaaattttcaaattcccaaagaagttcaaattttacatgttttgtataacagaataacaaagattttaaaaaatactctgagttattgaagacgtgggaaaatgggcactgttaaatactgctgagagtaaactgataaaaatttgcaggaagtagtttaagagtacatattaaaaattatgacccagaattttcaccagaatgtatcctaaataacaacctaaacatctatcaatgaggtgttcttaaattatagtagctctttatattacagtatcatgtaccatcaaaatcaataacacgcatatttacaaaaaaagctacacctatgttataaatttattttaaaaactatatttgaaaacaatttataacacagttgtgtttttaaataggtgtgcttacatgtacaacaagaaaaaaacttagaaggatatttctcaaaatgtaaatcatcatctctaagaggtggaactatgaattccttctttataccttctttcctatacatagatttttgaattatctgattttttttcaaagagcatgtatacttttataattaaaattattatgaacaatataattatttctactgtttaataagaatggagaaagacaaaaaccaatgtttgtgtgaatggatagagaagagtcacatgtctaaaaaagctgccattttaactaaattataccaaccacaaccaaggaacactcataaagtccagcttgtacaaagtttgacaaatccaattaacaaaataccatagactgcctggacagttaacactatagttttccttttctgaatctttctcatacacaaaacagtcagctactattctaattccagtggccgtgaaacaagaatgaactgtttcatatccattcaactctgatcattcttataatagaaaaggtgaagctaatttcctttctctgtctctgaaagtttgcccatcttttgtcacaaaaaatgttggatggcctttcagctctaaggataaacgcatgcacaggttaccaggacatgttgcaagtttatatgcatgttctcatatgaacaataatcatgtctatgattagccaataattctcacaaaacagaagggtatcagtaacataggcagaaaaatccaacaaacaaaaatgtcgactaagctttaaattcattttattacccaatattataaattttattacccaatattagttcaagtccatcattttaaaatagggtttatcaaccatagggagtatggggaagctaggacttggtgactggtcttcctgagaacaaaagaagtaaaagttatttatagtgaccttttaatgtttaccttagagctgctaatccgatgtaaattgtcaccccatggatatgcataatcaactttattccctttgctaattgagaaatagagctgttaatgtcaagaaacatttgaaaaatgcaccaagcctgctcaatggagcaagttcattttaaaagtcagagtttccatatggtaaaatcatggaaattaaacttaggggaaaaaaaaaaaaacagagagagagactaatttgttattgagctagtctgtgctagaacaaaatcagtcttaacaaccccaagcctggaaattttgaccacttcttatgttcaaaagtaactccctcagctcttatgaaaaataattccatcacatctctccaaagttcctctcctgctgagtttatgctttcccacctgcactgggtctggcttagcagtcactttgccaggacactcacacaatgcaattcacacaagtcagtccttctctttcttttactctctggtaggttgtcttttgagtttcctttaaaactgatcactgagaagtaaatgagtgagtcgtatgccaattgtgtaaaaaggggatgataatatattcccttgagtgatacttgaagattgctgtcacttttataatgccacatatggtagaagtaggcaaaattttaatttatggttaatcttagaagagatgtggttaaagcagtcactggctgcaagggaccactttgccctctcctattccaagacaagactcacttctacccttcctcagtgacttccttgttttataaaacccaagttttctcccgtttctttgagacaatcctcattattgaacattctcccccttgaaagagcttaactaaaatcttccccttaattgtctgctgcattttgtctaagaaattaaggccagccctaagcatgtgccccaaacattctcttctcaaaggcaaggccagcaaccattctgtttcttgcgacgatagaaaacacaagtcacagtgagaagagcacaagcactaaccacacacatcgatggcacacttcaagatcctgcaaggcagacttagtcctgagtgagtggggcttagtcctgagcacatctagacttcaatctcctgcagtcaccaggccccgcagagtgatatgttcacaaagacacacctgatgtgaactgcatgctcttctgagaaggtaacccatgattagcagaataagctcatatttaaaaaaaaaaaaatggttctttactccattcccaccacacactgcagggatctaagtaggggttacctaacctctctgagccttgatctcctcatccatcaaagtgctttaactgacctaatcacagccagagggctcaccttggttcaacaaaacatattcagacccattctccttttacttttaaaaaaatctaattttttttttttttttttttttggagacagagtcttgttctgtcacccaggctgaagtgcagtggcgtgatctcagcttattgcaacctccatctcccgagttgaagcaattctccagcctcagcctcctgagtagctgggactacaggcatgcaccaccgtgcccagctaatttgtgtattttcagtagagacggggtttcgccatgttggccaggctagtctcgaactcctgacctcagatgatcggcccgcctcagccttccaaagtgctgggattacaggcgtgagccaccgcacccggcctcatttttttcttcactttttacaaaataacagttttactgaaatatgatcctcataccctaaatattccccgtttttaagtgtacggttcagtgatttttaatatattcacagagttcggcaattatcaccattatttaattccagaacattttaatcatcctcaaaagaaaccccatatccatcagtagtcactccccatccccccactacaacccatgataactactactctactttctgtttctatgaatttggctattctagacatttcatatgaatgaaattatataatatgtagccttttgtgactagcttctttcactcagcataatgtcttcaaagttcatctatgttgcaacatgtgttggtatttcattccttttgatgccagaataatatttcatggtatagatatattaataccagattttgtttatctattcatcagttgatggacatgtgggttcttcccactgtttagctattatgactgatgttgttatgaacattcatgtacaggtacttgtatggaaatatgttttcagttctcttggatacatagctaagagatatactgggccatgtggtaactctacgtttaaccttttcaggaactgccaaattgttttccaaagtggttgtgccattttctttgctatttgatatattttggttccttctgtgtctgctttctggtttttgggggctcagctgggaaagtaattgggatacttcaaaagatattttacacatagtggacaatttttagccattataggtagacacaaatacacagtggctgagcttgggagccacagaatgtggtgctatagggcacaccgaaaggatatccatgctagttagcaatgatacctggagttcagagaacaatttaggaagatctgggtgggttttgatatgatatagcaataaacaacacatggatgcacgcacttagacctttatctcaggtgcttaaactataaccaggacaattcaagacgtacgtaaataatgacaggacacatttttgagattcctttgctttttttttttttttaagaatatataagaatatttccagctggccatatcagagaagatggttttggaacagaaaccatcttcactggctcttgaaggataaaaatgtcttaaacaagcagaaatgaggagttgcatctcaggcagaggcaactgtataaagaaaggcacagagtgaaacatacaaatgaggagctggaaaaagatacaaaagaaatgaaacaattaacattgaatatgaaaggtgatttagaaggtggaatacaagatgactctacgtttttggcatggaagatgggatagaccactgtgccattaacagaaaggatggtcaaatctgaaggaagaactagtaggagcgggaaggaaatgagttcaattttagacatagattgggtttaagctatcaggggaacatatgtaggtagggtccattaagcaaataaaatatagaattggagcttaagaaatatatttcctaatagaggtcattgctgaagccttcagtgggaacacagggagaagaaaagtggcctgttataacttaccctcaaagaggaaactcagtccactgcagaacaaagaagaccaggacaaggccatgcaagggcttgggaaactgaccaaattttagggctcaaccttgaggaagggagctggctgttcaactacaatgttctgaaggacagtgcaaacacaggcttaatcaggccagagctgataactaggaagtttaatctagaaagtcaggcacagcagcaggaatttccagtcacaggctagccatatcaggacagatcacctgccacgggatcaggagatgaaggacagaactcagcctctccagaactagcaggacctgggcaaaatagacaagttccatccaaagggacgggattccagaaagactctagttcacacaaattggacagatctgataggctttgctggaaggatacaggatggtctgaatacgagtaaccagaagtaactctacctcccctctgtcaacacctggtttacaggagcaagactggtttgggtccccatatgctacttactgtagatgaagcttctattgttccttctgccctgttcaggaaaggctcacaaactgactgaagctaagcttccagatgctccatcacaccagaatcagcattgaggaaggaaaggatagggccttgcagtacattcacatttggcagggcaaagaaggaagagagaaaaagaagatacggtggtggatacattcaaacactctgtatatcagcagagagtaatgatgaagcaggagagaaggagatcagagaaaatgaaggagtggactcaaaaaaaatgggtgagtcatcagggaatccctttgtgtcactggttttcacctaaaattttactttaccatatccaacagtgatgctctattacaaataatgctttgcttgtcatcctgccttcaaaagcccctttagttttcagcaaccaatacgtaagaatcacaactcctacataagtaccttttggtaaacacattcaatcttgacctggaagctacagtaaaaacaaagaaaagatcaattatataaagttggaaatacagacctccaaagaccctaactgttagagtagccagcacatatcagaaactttacagaatgccaaatcacagcataaataataaaatgtaaaactcagtggttataaaaatagactgtgagctaaaacttaaacaattaaaccatattatagaaaggcatcttttgaaaatttaaaatactacaattttaacacatataaaaattcacaaaaatgaagtttttttttacctcatattttattgaggcaagaagtaaaacaaacaatgatcttaacaccatgatcaaaaatagaaactttcaatcaacactgcacttttcacaaaattataagaggctgaaaactgcaaatagcacatgtcaagtctctgcacacttcactagagatatatttattcaaaactaaatgtctcccaacgatcttactctagaaagaacatgagtcatatatgctgagaaactcttcttacagttttaaccttttgcggaaaaaaaggcatagcttccagcccatacactagtaaagagcctgtgaaaaacaatttcacagtttaaaaagcaagactctctttggcactgatatccaacatttcagacagagaagcaaagagctcatcccagctgatgactgcctcataacttgggaagcaattgcataatgactaattctggagcttgtgcagatactgggacaaacactgcaaaccttgtaaaggacaaaaaatcccagtgggtgataaatcagcatggttgctcaggccctccaagtagtatcatggaaaagtgcagtggcccctcatatcgcactgaggcatcagctaagaaatgacttgagggaagaatgcctcctatggaatcatcaacaagtcaaacagatcacttcgtttttatacacttctggttcaggagtctgatttggtgctctacagaggaacacacaacccatgctagcaaaaagaagtagaaagaattcttttctccttctagaatggtaccccagcacaatcgggattgctagagggcagatatgcaacagagcgttcttaaagttactccttttctgaatactaaagaacttttctcaggctttttgaatgagctgaaaaccagtttcgaaagataagatattaaaccatttctatagggaataagaacactggagattatttactttgctgtaattactttggcacatagggagattagctttcaaatgctactaggtttgcatacagagatttcaataatgaagaaaaattagttcatgttttgaatatttagggcttgaagtatatattactgctaaagagtgaaaactggttaatacttgtgcagagaagaatagttaccaaaaccattaattgttttaaagtctgcacttccttccccacgaacaatcacttatttggcttattttctctcttttttaaaacaatacataatagttgtacatatttttggggaatatgtgatattttgaaacatatgtacaatgtgtatgcatgtataacacatcaggataactgagatatccatcacctcaaacatttatctttgctttatgttggcaacattccaattcttctattttgaactatatattaattgttcattatagtcaccctactgtactacaaaacccttgatattattccttctatccaaatgtatttttgtacctgttaacaattgtttgtttttaaaaagcatcttgacttttattagagccactactaaatgaaaactcacttgtacattcataaacgagtttgagtttcataagaattgggtttttaaaccaagaagcaagacagccaataattccatctagtaagggggaaaataaaacttcttttgagttaaatgaacaagcttcaagaagagataaatggaattttagaaattcattatttagtgggatattttcttgggttttcgagattgtttacatcatgactttaagctgggaccaaatttatttctgaaaagagtctggtagcatgtctcgctttatacattatagttcatctccctgcttgctatctgttaggtgagaagtggttgagattaagtgacaatgtttgcacagttatttttgactttttattctgaaacaattatcaatttacaggaagttgcaaatgttccatgttcttttagccagcttccccagatggtaacatctcaacataattatcaaatccaggaaacttggtttggatcataatcctgaaagatacaatcccaaatgttgaaatcccaaaggatcaaaatccctaaatatcaaacgccctttaaatcaaaatcttaaagtccaaaattctgaaaattatagtcacatgatagttgtatcatgttagatgaaactattaccttcttactgtctttatttggaaattgaatatgatttaaggagagctgtgtcttgaaagaaaaacctcagctattcatcatgatacaagactttaagatataatgattgtgaaagtcacccaactcttataaactatctccaggcaactgtccacaatctattcttgcaatacactttttcacacatggaattttaaaagattttttcttattattttagtttttcactctttaaaattatcagcattattttctacaattcacttgctatgtatttcatcttcacatcatttcaatactggaggtacaaaactgtagagacctttagagggttccaattagttttacgcatttttttgcaagagactccacgaaagtgcattatcacaatgttaatttttgtttgtaagcatttgtgcatgtacataaaaacactgaaatttcctcaataaagagatgtactttttgtacacgtgcatttgtaaaaaataacatttctcaagatctcagcaatttgtgtgactgtatatgttgtggtgacccatcttagttttttaactaatctcctcaaaagacttagattgttcatcacagtatttcagatgaccacaggtacaaagctgggtgcacacggttacaaaccacaatgatatgcactcattatttccctttttacctatttctttatgaatagggtttatctgctcataactgttatacccatgcaattattgtgtgtataccttagtgcttacacaaaatatctatgttagtattgtgtattttattgtgtaaggtaacctatgaagtgttctgtcatgtttttatatgtttcataaataaatccccttttaaaatgcaaatacatatcttttaaagaatttttaaattattttttccagaactatatttttgggatttttatctttcaggattgtgattttggggattttagactgaaggaattttatcttttgggattatggcatttggaattgtgtcttttggaattataataatcttcccaagaaactacaatagtatgatacccttatacagactacagaccttattcagattttgccagcttttgtatgcactcatttgtacatgtgtatgtatgtatgtatatatatagttttacataggtgtagtccctgtgtagattctgataaccatcactgtaatcaagaaacagcattcttctaaccccaccagggaacacccttatgctactccctccatcctatccctatcccctggccaccactaatgtgttctccatctctataattctgtcctttcaagaatgttatataaatggaattatacactatgaaattttttgaaactagcttttttcactcagaataatgccctttagacccagccaagttgctgcacgtatcaatggttcatttgtactctttttagtgctctgaaatattactctcattttgatcatcatacaaattgactgaatgcagaaatatcttgttgaggtttaaatagatagataaatagcacttctcacaagttccaaaacaaattaaaaggcaaatgaagcaggcagataggggataaaaagatatcaatgctttactgttcagtctgattgaagaatatagctttatatctgatgccagaggggttggctaatactctactgcaggattaaacttatccattggcatagatggaaaactactggcaggcaaatctggaagaacggggcatgctgaattcctactctgtaactcacctttcaggtaatgctatagtcaaaatgtgtccccccaaaactcatatgtagaaacttggtattaatagatggggcctctaggaagtgattaagtgatgaggacagagctctcacaaatgggattagagttcttataaaagaagtctgggctgggcgcagtggttcatgcctgtaataccaacattttgggaggccgaggtgggtggatcacttgaggtcagaagttcgaggccagcctggccaacatggtgaaaccccatctctactaaaaatacaaaaaaattagctgagcgtggtggcaggtgcctgtaatcccagctactcgggaggctgaggcagaagtatggcttgaagccgggaggcagaggctgcagtgagctgagtttgcaccattgcactccagcctgggcaacaagagtgagactctgtctcaaaaaaaaaaaaaaaaaaaaaaaaaaaaaagtttgaggaagcccttttgccccttctgtcaagagaggacacacagaaggcaccatctatgaaaaacaggcctctaccagacagcagatctgctggcatcttgatcttggacttcataggctccaaaacagaaagcaataaacttctactgtttataaactacctattctatggtattttgttatagtaccaggcacagactaagataggtaactttaaatccaggagaggaatgacttgggaggcatagaaaaatgggtagtgttctttccatatttttccttcctcaggtgcagtgtgtacattctgtcctctgtagaaacataaagagtatggaatagacattgtagccaacaatctagattttctcccccttatccctttcactgtcttttagtttttcccttccatttatgggcaaccagaaatgttgctattcccctgagtgaagactgcttttcggggccataaatccaggcagctttagatagtattcttagatacctctctgaagcgtctctgggaatgttatacgcttatcttcctttctacttcagaagtcctattcatagtcctattcctttgttctatagaatatctcaataacatttcttgagagtagattttattcagtagatgacaaatttaaagcaaaatatataacaaacaggcaatatgctaggagttaagagaatttaccttaatttccaaatgaagactttacctgttttgtttcccctaatgtttgcccaaaaaggaataactgactactaaaaataccctatgcttaccagttctatagtaaccttcctttagaagctatttctttattagcttttcctattttaaaaaatgacatatatgtacattatatatatatttttttaaaaaacagctttttgcaatttatagcaaaatggtaaactagaacaggttattgtatcccttcctcatgctcaaacctgaaaaaaatgaccttagtagcaaagaactaaaaataacagggatggtgaaagacaccaagaataggtatgccattgtattcttcttgatagaattatggataacaaattaagacaccgatagagaaaaataaaaaagaagagtgcactttaataagttagggagaatcacataatgttgaactagtgtcttttaaacaaaagaaaatgtgatgtgtacaaaggaaatcagaaaagaagaagaaaaagtaaaacaaaaagaaaacataataaacagaaaatatatatgactaagataacaggaataagtcctgatgtaacagtatttaaagtcattataaatggtataagcccaccaatcaagaccctcagagaagttctgacttctaataatggtggagtagcttataacagactaacactttgctgaaaataggtacaagctccacacaaaacataaaaacaactttttgaaggcactgaagggaaaccaaatgaagaaggaaactgacctttgaaagaaaaaaaaacaacacactgggtaagatctacttttatacatcttttcccttaggacaagataggtggaattcaagcagaaatccagtctggttagtatgaagagtcagaggacagagtctgaggctgccagagcactgcaaaaagcaacagggggtgggactggtgatccacaacgaagaaatgcgtagaaataagacctgaatcccgcatttaaatccttggctgatcacttaaattgtacgtacatgcatgcatggggcaagactccaaagagcacaggataaaacgaaccaatggaaggcggaaagaaccaaatagagatttcagcagctgtatatttcagctgctaataattattatcttgaatttgcaatttaagtcctgccagatagtgggggcttggcaaataacttgggctttctagtgacatcacagaagggccatgagttaagaataaatacttatttgaagaactattttccttacaactaaaggcaaaacaaaaacagttctaccctaacaaagcctaatattgaccagtaacataattggatattggatattatccaataatatgaaagatataggtaaaagactacagaggatataaaacataatactaaaattatttaacctaaaaaattcaggaaaggaggaacagagaaacaaaatagaggagacaaatggaaaccaaatagcaaaattgcacacttaaaaacaaatatcaaaaattaaattaaatatatgtaacacccctgcagtgagccaagattgcaccactgcactccagcctgagtgacagagtgggactccatctcaaaaaacaaacaaacaacaactctctctctctctctctctctctctatatatatatatatttgtaatatatatatatgtaacactccaattacaaggcaaagatttttaaactagataagaaagcaaacaaatacatgctctattaaaaaagatgcactttaaatgtaaagatatatgcaagtttaaaaaaaagaatgaaaaaaatacatcaaatattccacatataagaaagcctgtatggctatataaatatcaaacaaagtagacttcaagccaatgtatattaccagagaaaatgagggtaatttcataatgacaagggggtgttactatagagggccgtttcattaataaagctcaagaattttaacatatatgaaacaaagacttagtagaaataaggggaaaaaatagaaaccattcacatagttggagatttttaacacccctctcttaggaaattataaaacaacagaccaaggggatagtatgaatgcagaagatttgaacattatcagtgaacttcaacttaaaatatattttgaatagtaaactcaacaaagcaaaattcatatagtacacattcttgtccagtacattgaaaaatatttaatgagacagactatatattggaataaaaaacatcttaataaatttttaaaaatcagatagaatatgtttcctgtctacaaagtatttaataagatatcaatattaagaggtctagaaattaccaggcctctcagaatattccttctaaacaatccatgggtacaaagaaatcataagtgaaattagaaaatatttagaactaaataataataacatataaaaatgtgtgagatttactaaggcaatgcttagaaaaaaatctgtagatttaaaaagcttatatttaaaaaagtaagaaaggtttaaagtgaatgatctatgctaccaagttaagaagctacagatagaataaattaatacaaagtaattagaaaggaggaagcaataaaataaagcagaaaacaatgaaatagaaaagagacagtaatgaatatcagcagggccaatttgggttcttggaaaaaaaaagaaagaaagaggcggaaggagcataccacaacacaatttacaattatcaccctaataacaaaatgtgatagcaatattacaaaaaagaaaaatcacaaaccaatatcactcagaaagatgtaaaagctgtaacaaaatattaagcaaatcaagcccagtaatacataaacagataatacagcttgaccatatggtatttttcccaaaaatacaagattagttcaacattcaaaactgtatctgattaacaaaaatattaacaatatatgggtaaaaataaaaactatgatcattgtaagagatatagaaaggacattttacaaaattgagcacatgatcaagaaagaaaaaaaaaaaacaagctcctagtaatagaagggaacctgataaaactatctaaaaaaaatctcactctaatatcacaattaatgttgaaatattgaatgcttttctcctaaagtcaggaaaatatccactcctaccacttctactcaacattgaactaccagtcctggatagtgcagtaaggcaagaaagatatatatatatatatggcataaacattagaacagaagaagtaaaactgttttttgcccccaccctcactcccgacccagacaacatggttgcttacagtgaaaattttaaggaatgtacatacacataaaattactggaactgaaaaattcctttagtaaggcccaatgacagaaagtgaatatatgaaaatcaactctatttctatataccggcagtgaataactgaaaatgaaatttaaaacgatactattaaaaattgcataataaaacattaaatagagaaaaaacataataacaaatatgcaagacctctatacggaaaaccaaaaaatattgaagaaaaagaataaagacctatgtaaatgaatagatgtttcatgtttcagggaagtctcaacattaaaccgtgacctgccccaaagttgatttgtagattcaatgccatcccaatgaaaatcacagcaggatttttacagaaattgacaggtgagtctaaaacttgtatggaaatgtaaagaacctatagttattaaaacaataagaacagggtggggcgcagtggctcacgcctgtaatcccagcactttgggaggccaaggcgggcggatcatgaggtcaagagatcgagaccatctggccaacgtggtgaaaccctgtctctactaaaagtacaaaaattagctgggcgtggtggtgctcgcctgtagtcccagctactcgggaggctgaggcaggagaatggcgtgaacccgggaggtggaggttacagtgagccgagatcacgccactgaactccagcctggtgacagagaaagactctgtctcaaaaaaaaaaaaaaaaaaaaaaaaaccaagaacaaagtagaaagatttacaggacctgattccaaaatttacaaaaatgctatcagaaaatgtggttctgatataacgacagaaaaaaagatcaattaaatggaataaggaattaagatatgtatgtggacatatattgttagactaggtagttaggcagacatgagcagagtgggagaggggtcccccttatactaggaatgtcaggacaccatcaggtgatggctagacagttcttaaactgcctctctaaaataattggttgtagctggtgccaggaaaggcagtttcccagtagatagagaacacctgaagctgatgatcagcggcttcctaataagatctcaggagttgggtgagtgggctcaagcatgagcactaaaaggcaaactggcacgtttaactggtatatgaccttgctctaggaacatttgtctggtgagggaagaatgcctcaagtgagcatgcgtacaacttcaataagcacattgggcatgcagcccctcccaagtgcggacaggccattgcgcatgtcgacagcccaccctaagggaagaatcaaggtagaagtaacacagaccctggaatcatgccaatgtataaagccccaaggcaaaggtcaaacagtgcacttgaatctctcaagtcacctgcttggccctcttccagtgtactttacttccttttgttcctgctctaaaactttttaataaactttgactcctattctaaaacttgccttagtctcttgcattgccttatggcccctcagtcaaattctttcttctgaggaggcaagaattaaggtggctgcagacccatatggatttggtgcagctaacaataggacaaattaattttcaacagaagcaccaaggtaattcaatacagacagaaagtgtgatcttttcaacaaatgatgctgaaacaaatgtaaatctgtaatgaataaataggcctcacaatatataggtaaagtaacccaggacgattcatagagctacatataaaaactaaaaatataaagctgatagaagaaaaaacctttatgacattaggatggtaaagatctttccatacacaaaacccactaagggttaggcaaaacaaaacataaaaaaattctgctcttcaaaggacatcattaagaaaatgaaacggcaagccatagattcccagagtggctttaaaaagcaaatagcctgtctatgagaattatagtttttaaaataaggatataaaattactggggtaaaaaggaagaaaatatttaaaatacacatatctgacaaatgatgtatatacaaaatataatttttaattctacagtttaataaagagacaacacaataagtaatggacaaaagaaatagaaccttgagaaatgaagatgcaaaaggcgaattagtataagaaacggcttcagcttgacatcattagttacctgagaaatgcaattaaaaccacaaatattgatgaggtaataggccacaatattgaaaaacacaatacattccaaaggctcaacatcatatggaaaattttttatgaccatactatgtagtaaaatcagaaattaataacaaaggaacaaaaaaagtaaaaaataagtttgcaaaataaatattaaataaccattacagaagaaatcttaagagaaattataattttaagtacatttttaacgaaacaagaaagactgaaaacaagcaagttaaacagtcaacacaagaatctgcaaagagcaagtaacaaattgaaacacaaaaaagggaaacaatgatgagggcagggatcaatgtgaaaaacattcatgaaggaggaggaaaagaaggaagaagatgaggaggagagaaggagggagaaggaagattaacaagctagttcttgggaaagattcctaaattatacatagttcaagaaaatctgaaaaagataaaaaggtagaagttgcaagttaaattaaaaaacagaaataactacaaactgatttttaaatgagaaaagaatatcaaatcttcttgaaaatattaagcatcaaaattgtttgagataaaatagaaatcttggataaaacaataatcataaaaaacagaaccggaaataataatttttaaatctcttccaaaaacggaaaatattaggcccagatcattttgccagtgagttttactttcaacaaacagatcattcctattttatatgttattaaagcacacagaacaagaggataagctgcccagcatatgtgataagaacactggtaccttaactccaaaacctaataaggacaatgaaagaaaatctcacttatcaacatagatgcgaatatgttaatataaacatagtcaatcacatccaacagagtattaaaataggaggggagaggaaaaagagggcaggaggagggaaagacagtggcagggcaaggagactatggcaaagataacaaagacatcaggatcagataaagtttatcccgatgttcagatatatcctatgtctggataacatatttcctaataattcaatgatggtttgacattagaaaacatatgaaagtaatccatcacattaatagattaaatgaaaaaaatcacttggttatctcaataaatgtagaaataacatttgaaaagtatacaatgattcatgttaaaaattatcagactactaagaatgagggtaacttccttaataaggtaaaggttatatagcaaaatgtacagcaagcactcaattaattgaaaaactttagacacataatactacctgctatcactacttcaggccaacactatgagaaaacaaaaagaaatcagaaggataataattgaaggaggagagaaaaaagtgatgaacataaaatgtgtctatcaacatagaaaaattaacacaatcaatgaagagaaatgtgaccaacataaaaaagtaagctgaaccaatagataagaattaacagaatcaatacaaaagtagaaaaataataacaaatttgaacaaggtggtcgaattcaagatcaacttaacatctacaaaattgctctacagaaacaataatcaagtagaaaaatagaaaataagatagcatccacaataaaagaaataccttttttttttggtttggctatctaggattaagaaagttggttttttaaattattattattatactttaagttttaggttacatgtgcacaatgtgcaggtttgttacatatgtatacatgtgccatgttggtgtgctgctgcacccactaactcattatttagtattaggtatatctccaaatgctatccctcccccctccccccaccccacaacagtccccagagtgtgatgttccccttcctgtgtccatgtgttctcattgttcaattcccacctaggagtgagaacatgcggtgtttggttttttgtccttgcgatagtttgcttagaatgatggtttccagtttcatccatgtccctacaaaggacatgaactcatcattttttatggctgcatagtattccatggtgtatatgtgccacattttcataatccagtcttaccgttgttcgacatttgggttggttccaagtctttgctattgtgaatagtgccacaataaacatacgtgggcatgtgtctttatagcagcaagatgtataatcctttgggtatatacccagtaatgggatggctgggtcaaatggtatttctagttctagatccctgaggaatcaccatactgacttccacaatggttgaactagtttatagtcccaccaacagtgtgaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgctttttggctgcataaatgtcttcttttgagaagtgtctgttcatatccttcacccactttttgatggggttgtttgtttttttcttgtaaatttgttggagttcattgtagattctggatattagccctttgtcagatgagtaggttgtgaaaattttttcccattttgtaggttgcctattcactctgatggtagtttcttttgctgtgcagaagctctttagtttaattagatcccatttgtcaattttggcttttgttgccattgcttttggtgttttagacacgaagtccttgcccatgcctatgtcctgaatggtaatgcctaggttttcttctaggttttttatggttttagatctaacatttaagtctttaatccatctggaattaatttttgtataaggtgtaaggaagggatccagtttcagctttctacatacggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggcgatgtgggctcttttttggttccatatgaactttagttttttccaattctgtgaagaaagtcattggtagcttgatggagatggcattgaatctataaattaccttggacagtatggccattttcatgatattgattcttcctacccatgagcatggaatgttcttccatttgtttgtatcctcttttatttcattgagcggtggtttgtagttctccttgaagaggtccttcacatcccttgtaagttggattcctaggtattttattctctttgaagcaattgtgaatgggagttcactcatgatttggctctctgtttgttactggtgtataagaatgcttatgatttttgtacattgattttgtatcctgagatttgctgaagttgcttatcagcttaaggagattttgggctgagacaatggggttttctagataaacaatcatgtcatctgcaaacagggacaatttgacttcctcttttcctaattgaataccctttatttccttctcctgcctaactgccctggccagaacttccaacactatgttgaataagagtggtgagagagggcatccctgtcttgtgccagttttcaaagggaatgcttccagtttttgcccattcagtatgatattggctgtgggtttgtcatagatagctcttattattttgagattcgtcccatcagtacctaatttattgagagtttttagcatgaagggttgttgaattttgtcaaaggccttttctgcatctattgagataattatgtggtttttgtctttggttctgtttatatgctggattacatttattgatttgtgtatattgaaccagccttgcatcccatggatgaagcccacttgatcatggtggatgaactttttgatgtgctgctggattcagtttgccagtattttattgaggatttttgcatcaatgttcatcaaggatattcgtctaaaattctcttttttggttgtgtctctgcccggctttggtaccaagatgatgctggcctcataaaatgagttagggaggattccctttttttctattgattggaatagtttcagaaggaatggtaccagttcctccttgtacctctggtagaattcggctgtgaatccatctggtcctggactctttttggttggcaagctattgattattgccacaatttcagagtctgttattggtctattaagagagtcaacttcttcctggtttagtcttgggagggtgtatttgtcgagtaatttatccatttcttctagattttctagtttatttgcatagaggtgtttgtagtattctctgatggtagtttgtatttctgtgggattggtggtgatatcccctttatcattttttattgcatctatttgattcttctctcttttcttctttattagtcttgctagcggtctatcaattttgttgatcctttcaaaaaaccagctcctggattcattaattttttgaaaggttttttgtgtctctatttcctccagttctgctctgattttagttatttcttgccttctgctagcttttgaatgtgtttgctcttacttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatatacccagtagtcattcaggagcaggttgttcagtttccatgtagttgagtggttttgagtgagtttcttaatcccgagttctagtttgattgcactgtggtctgagagatagtttgttataatttctgttcttttacatttgctgaggagtgctttacttccaactatgtggtcaattttggaatagatgtggtgtggtgctgaaaaaaatgtatattctgttgatttggggtggagagttctgtagatgtctattaggtccgcttgctgcagagctgagttcaattcctgggtatctttgttaactttctgtctcgttgatctgtctaatgttgacagtggggtgttaaagtctcccgttattattgtgtgggagtctaagtctctttgtaggtcaataaggacttgcttcatgaatctgggtgctcctgtgttgggtgcatatatatttaggacagttagctcttcttgttgaattgatccctttaccattatgtaatggccttctttgtctcttttgatctttgttggtttaaagtctgttttatccgagactaggattgcaacccctgcctttttttgttttccattggcttggtagatcttcctccatccctttattttgagcctatgtgtgtctctgcaagtgagatgcgtttcctgaatagcacactgatgggtcttgactctatccaatttgccagtctgtgtcttttaattggagcatttagcccatttacatttaaagttaatattgttatatgttaatttggtcctgtcattatgatgttagctggtgattttgctcgttagttgatgcagtttcttcctagccttgatggtcgttacattttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaagttcttttctttaagaatgttgaatattggcccccactgtcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttctcggagtgtcttggagtatctttgtggctcttctcggagtatcttggagttgctcttcttggagtatctttgtggcgttctctgtatttcctgaattggaatgttggcctgccttgttagattggggaagttctcctggataatatcctgcagagtgttttccaacttggttccattctccccgtcactttcaggtacaccaatcagacgtagatttggtcttttcacatagtcccatatttcttggaggctttgttcgtttctttttattcttttttctctaaacttcctttctggcttcatttcattcatttcgtcttccatcactgataccctttcttccagttgatcgcatcggctcctgaggcttctgcattcttcacgtagttctcgagccttggctttcagctccatcagctcctttaaggacttctctgcattggtttttctaggtaaccattcgcattcttcacgtagttctcgagccttggctttcagctccatcagctcctttaaggacttctctgcattggtttttctaggtaaccattcgtctaattttttctcaaagtttttaacttctttgccattggtttgaatttcctcctgtagctcggaatagtttgatcatctctgaagccttcttctctcaactcatcaaagtcattctccgtccagctttgttccgttgctggtgaggagctgcgttcctttgaaggaggagaggcgctctgctttttagagtttccagtttttctgctctgttttttccccatctttgtggttttatctacttttggtcttcgatgatggtgacgtacagatgggtttttggtgtggatgtcctttctgtttgttagttttccttctaacagacaggaccctcagctgcaggtctgttggagtttgctagagatccactccagaccctgtttgcctgggtatcagcagcggtggctgcagaacagcggtggctcagatggaaatgcagaaatcgcccatcttctgcgtcgctcatgctgggagctgtagaccggagatcttcctatttggccatcttcgctccgccaagcagaaatatcttgaaattaacttgaaagtaagaatgctcaaggaagtcctggacagagcattcaggcaagagaaagatttaataaaaggtatccaaataggaaaagaagtcaaatgatctctctttgctgacaatataattctacacatagaaaagcctaaagactccaccaaaggctcctggaactgacaaactaattcagttaaatttcaggatataaagtcaatgtacaaaaatcagtagcagtcctatacagctataacattctagctgagaaccaaattaagaacacaatcccatttacaatacccacaaaaaaaaaaaatgaattacctaggaattcatctaaccaaataggtcaaagatctctgcagagagaactacaaaacactgctgaaagaaatcagagatgaaacaaataaatggaaaaacatattaagaccatgctcatggattggaagaatcaatattgttaaaatgatgatactgcccaaagcaacatacagattcagtgctatccctatcaaaatactaacgctgtttttcacagaattagaaaaatctattctaaaattcatgtggaaccaaaaaaaagcctgaatagccaaagcaatcctaatcgaaaagaacaaagccagaggcatcacattacctgacttcgaactatactttaaggctacagttacccaaacagcacggtactggtacaaaaaaagatacacagaccaacagaatagcatacagaacccagaaataaacctgcatatctacaaccatctgatcttcaacaaaatcaaaaaaaatatgcaatggggaaaggacttcctgttcaataaatggtgctgggataactggctagccatatgcagaagaatgaaactggactcctacctctcagcataaccaaacattaacccaacatggattaaagatttaaatttaagacctcaaattataaaattcctagaagaaaacctaggaaatcccttctcaacattggctttggcaaagaatttatggctaagttcctaaaagcagttgcaacaaaaacaaaaattgacatgtgggacctaattaaaactaaagagcttctgcagagcaaaagaaactatcaacagggtaaacagacagcctacagaatgggagaaaatattcacaaactgtgcatctgaccaaggtctaatacccagaatctacaagcaaaaacaaatcaacaagcaaaaaataaataaagcaatttaaaaatgagcaaaggacaggaacagacacttctcaaaataagatgtacaagtggccaacaaacatgaaaaaaagctcatcactaatcatcagagaaatgcaaatcaaaactacagtgagataccatcccataccagtcagaatggcgattattaaaaagtcaaaaaatatgatgctggtgaggctgcagagaaaaggaatcacatatacacaatggtgggaatacaaactagttcagtcactgtggaaagaagcctggagatttctcaaaaaagttataatagaacttccatttgagctagcaactcactactgggtatatacccaaaagaaaataatccattctatcaaaaagacacatgtacttattagttcattgcaacactattcacaatagcagagatgtggactcaatttagttgcccttcgacagtggtttggataaagacaaggtagtacatatgcactatggaatacactgcagccatacaaaagtgaaataatgtcctttgtagcaatatagactgagctgaagatcattatcctaagctaattaatgcaacagaaaaccaaatacaatatgatctcacttataaatgggagctaaacattgaatacacatagacataaatatgggaacaacagacactgggaactaccagatgggagagggagggagggaagaggggatgggttgaaaaagccacctactgggtactatgctcactacctggaggacaatatcatttgtctcccaaacctcagcatcacacaatatacctatgtaacaaacctgcacatgtaccctttcatctataataaaaattgaaattatttaaaaattggaatcatctcgggaggctgaggcaggagaatgttgtgaacccaggaggcggagcttgcagtgagccaagatagtgccactgcactccagcctgggagacaaagcaagactccgtctcaaaaaaaaaaaaaaaaaaaaaaaaaaaaaaaaattagaatcataataaagctgttaaaatagcttaggaataacgatataatgttgctgttggacccttcaaacaagactttgttatatattcccccttgtgcaggtattctactgtgtcctttagtagtatttttaaattttcttcataaaggttttacacatttatagttttaaaaaagaatgcacaagatctctatggagaaactttaaaaactacattaagatcagatacaatggacgagatgaattaaccaagaaatattccatacataggaaaaaattatcgtcatcctgtaatttatttttcctaccactattcttctccatctctcaaggaggcaactgatttatcccctgaaggctcagggcctgattccaagctgatctagatgtaagacaatcagcattttaattcccactggcaaccattccctgaaggtctggagctagttactcttctaagtatttgtttccacaaagcttcttaagcctcttctattactgcctattagaagtcaggtgtccttcagcagtgttaactgtgtttttatacctaccactgagttgtagtactccatatatattcattcaaatacacacacacacacacacacacacacacacacacacacacacacaccagcaatcgcacattcaaggttaggtgtgggctttggtttctgtgactctgtcttgctctagcctgcccttctgcctggttgctggagctgctcaatgcagcgcctgggcattcaggctccccctgaatcatctacatcccagtggtcataatcaatgctgtggctggaaagatgagagataagaagatcacacgcgaaattctagaaaccagaaatgcaccaagtcttatggcactcatagacaaaacacctgattaatccctcatttcaacacaagatatccaaaggaactaaccaccagagaaccctaacgtagcgcaccaagtgtggacagtctcggaacatgcaatggagcaccagaaccctaaaaagactggccaaaatcctgaaaaagcttgccacaccttttggctatggagctttttgcctaaggggccatgcctgcacccaagctctagcctgtccaaatgaatgagtctcttgcccaattctgaccttctgtttaagacttctagagaaggtatcagacctcatatcctatttctgagacacgataacagcaacatttgtaaatctgctggaattctcacatgtaaagaaaataacctacagcaggttcacctaatcctctcttcaagcagatatatttttaaaaattcaagatgtatatctttaactgtaatcattctaaaaataagacagagaacagtgtttcattttgaagggaaattgtctaaaattaatataaattacatgttattattgaaaaatcacatatgtaagtctgacgtttctctcaggactgtgcttgcagacttatagatcccatgcaatataaataagaaagcaatgatcttattcaattttcttgtgccacacaagtaaatgttctataaacacactacattctctttgataaggcagccctggactagggctgctccctgaacctaccagtttctgtacttccatctctcagtgacttcgcacaagttttccttcatacggaagcccgttcaatgcctctctctatcatttccttcctcaatggctactcaaaatcacctccttgaaagtttgcccactcttcccaggtgcccaagccctttgagctgtctcaattatagctcagcttccatttgctttgaattggacttacctttttctctactactcagtgctggtgttatgggcatgtgacttgtgcagccacaaagagcttcactcttagaaactccatctgagtttaatgctctgctgtcatcatcttgacattttcaagaactttatttttgaacttgtgttttgtaagtgaagcctgatgggacactagagcatgggcacgagcagaggggtatgcacatgtgtgtccccattcctttctaccttatttgtatacagcttttttgatgctccatgaagacagaattccagtggatccacaatgggtgggaggaagtctaacaagactcaaagccaagtacaaggtaaacatattacatttatgactaagtagtgagtaaagagggacactgacaaccctgagagggcatgctctccacttgaaccagaacttgattcacaggcagaaagaaggcaatgttgttctaaatagtagtcaaccacttgctggaaataatgacatagaagaaaagggaaacacagggcaacccattatttattttcttttcagtccttccttatttaccggtagtccaaaaggagagagtggtgggtagaatgtgcacataccaagaagtgaaataaaaacaactgagttttgtgcagtgtttccactggtttggtaaggacggagttgtgtaatttcaatgattccacatacaaatttagtacccttatacttacatttaaaaccagtattgcacaatatacagatgaatggtaaaattcatgctaataatttaaatttttaattattattttcttaggatattaaatagcaaatttaaaacaccataaatccagagactacataaataagaaaaagcttttatatattttatatcttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtgtttttagtagagacggggtttcaccgttttagccgggatggtctcgatctcctgacctcgtgatccgcccgcctcagcctcccaaagtgctgggattacaggcatgagccaccacgcccggcctatattttatatctttactggcactttttcccctgctttttgcacaaggggccccacattttcattttgcactggaccttacaaattagatagacagcctgccactgagacatcagtccctggagcacagggactctgcttcatgcatggctctctaactgcagcacctaggctattgctttatgttcattcagtgctcagtaaacacttgttaaacatagaatgtggtgtataaggacgaaagatcttagggtcccaagctaggaagacaataaccctgctctcgactctgttaaacagaccacacctggggtacaatgtccagttctcagggccacctttgaacaggaatgtagagaagaactcatcaaaagatactgggttcaaattatttcatcagcttattagctatataaccaaacagaaattggattagtctttgtgatcctcagtgttcttttttgcaaaatagggataaaagggtatttaaaaagacaatgtaagtgaaagcattttgcaaattccattgctttatacacatgttagttattatgatcctaactggaaggtgtctgtaggaaattaactggaatgatgagatggcataacagcagggccttaggcaacagagaggatctaagaggaatacagccactgacttctaacagttaaatgttcacagagggatgtaggtttaagagtgaccagtgagagcacagtaaaaacctctgggaagaaatgtataataaggcaggaaaggagcatgaggaaaaatttccaaagaagtaaatgtgggcctgcctgaggatacagtaagttccctgtcctttgagagtacaggactacctaagattttaagaaacatgtaacatcagataacaactggacataaaataataaccataatgatggtggtagatattgtttattggtgcatcctaaataccagacatgatgacagggactttacatacattattttttaaaatcataacaaatccataaagtgggtaaaattactcttatcactgttattattactctaaaggtaaaaaaaaaataggttaagtaatttatccaagatcacaaagccaaccaccttccactgaattcaaagtcaatattgaacatttatctggctgctaaaagaaataataatgattacaaatcccaggtctatttgttaaagactcccaaaatggcatcctcaatttcacacaaacatgacaataatcatctgaatcatgaagaaatctaaaagatataccaagaaaattacatcatcataaaacagaactttaaaaatatcaaggagacaaaaggttttcctcctagggcaccaacacagtttgtgagttcctagcccttcccaaactgtccccacaccttaagaaacactaggggctctagagctctctctctacacaaaggattcctgaacacagatcttaggccccgccttggcagagcaagtgggagcctgggcctgcagacagcacttttgtcccatttgaagatatactatatagctttttatatttaagcatcttgaaaatcactctaggaaagccatatttgggcacttagaagtatagcaggtgtgaaattatctcttggtgggacactgctcacttccccaccacttaagcccagaacgtgattaaaaccaaaatctgtaaaagcaaagctgtgacattcatttaacatttccattgtcaaaaaaattactcaggagccttgtaagtactctgtattctacctgttaggattgttttgaaatgacatcaccacaaatttcaactgaaaattaagaattggaagacagccgactctatccgctattcctaaaagcacttcaaactcttaatcttcttatattcatttcaagtaggtaacaaagcactccatgagtacaaatgcattttaacagacttttgccaatgccaagacaatgtgagagtcactgaagatactcaaaatttaaaagtgggtttatatcacactataaatgggacccaagacactttctgtccaggtgttgctatacttcaaattggtggtggcattttaaccatctatacaaatgcctgaatctacacacacacacacacacacatacacatgacaggaagaattgcaccaaacctttaagctgtagaaaaaaaagaaaatgagactccagaatatttcattaagataaaaatgttaggataaaaatgtccaaacacaagctttgctactgaaaacagttattctgggatatctgatcagccgtacaacaccttatctcttcacatcactagggtagtttttatatttgaaaccacatcataaattatactgtaatacctatctgcctcaaacacagtagaaaaacacctacacagcataaatcatacatgacatcacattaggtcttttaaataatgttgtgaacaccaggaaaatattccagaaatccatttttcatgctctttcttttaactactacccaaatagaagtgtctactttgcctctccaccagtccttttcagttaaataaatcaaatatatacaaaggacttctcatgcatgaaaggtaccacatgtttctacacaaataggagtggcatatctatcctccctaggacacagaatgctgagttcaagcaggcctggtctgtcttctatgtgctctacctcttagaggtctgacactgcttctctttgtgtctacattttgtttgaacagtacctccaacacatggaatgaaaggacggggagggaattctcctagcacctatgcatccctcactccttggcaacactatcttaccacattgataaaataatctatttgcctgtacctatgcacaaggaccattttactcatttgcgtatcttccctgattagcaggatagtagaaacaattaacaccgaatccataagtgtagattaaacaaaaaccagtcaagtttgcctttgtattgtaactctggtaataggttttagaggaaattcaactaaaaaggaaaatgaacttaaagagtctggatttttttcctaatccatagttatctaattcaccctttctcaaaagaaggctctctctttcttcctctttatcggctcttgcctgtctttccctttctccagttctctctcacacacagcttgtatctaaagctatgcaagaaatacattttatactagtgatttggtcagtgttaccctgcttcttcttgctatgaatgcagtatatatgagataagtacaaaagaaagagtatctaactctcttattttcatcatgacccactgggacaaggggagagagagggcacagctgcctccacggaataccctgttattgggcatgacaaagccaaggtaaagttctctggcatacctggaattcagacatgattacatggatatatgtctcactttccttgattattaagttgtaactctagagtatttgaccagcaggaaaggataagctttttctgatgagtatttaaaaagaagggtagaatcattttacttttaaatcctgcttttaagaggaaaccaaatagggtctcccttcccactggttgagcaactaccagccaatcactctgagccaaatgcaatgactacaaaagaccttggttccctgaaatgcttgaaggttaagggattacaatatgactaactggacctttataatcgtagccaagctgaagaatacaggcctcagagctcaccaagtagtagtgttattcttttgttgtaaagggacttaaacagagggacctaaagagttaaaacagtatcagccaaagtctgctcctctccgagacaaggacaagagctggatgcatgaattttataaataagagcatatcttcgactcctgtgtcaaatttaactgccacaagtatgaaatttctgcaagaaaagtgactgctactctttgctgttttcatttctaaagccactttcttccctgaccagctagaagccacttagatagttttcgcctggcacggtgactcactcctgtaatcctagcactttgggaggcagaggccagcagatcacttgagctcaggagttcgagaccaacctgggcaacatggcaaaacctcgtctctacaaaaaaaaaaaaaaagaagctaggcatggtggtacatacctgtggtcccagctactcaggaggctgagacaggagggttgcttgagcccaggaggtggaggctgcagtgagctgagattatgccactgcactccagcctggacaacagaataagaccctgtctcaaaaaaaaaaaaggttctgattatcttactttctttggtaaccagatacagtctcaggagcataagataacaataccatttttgttttgtttcattttgttttcttaacaagccatatacttatacaacaaaggaacaaaaaataaagtgtgaccataaaattaaaacataaatccacaataaagaatacaccaaaaaaacaaaactttaaagttttaaactctgacttttgttatgaaatttttcatctttttttttttttttttgagatggagtttcgctctgttgcccaggcttgagtgtgcagtggtgtgatcttggctcactgcaacctccgcctcccagattcaagtgattctcctgtctcagcctcctgagtagctggtattataggcgtgcatcactacacctagctaatttttgtatttttagtagagacagggtttcaccatgttgaccaggctggtctcaaactcctgacctcaagtgatctgcctgcttagtcctcccaaagtgctgggattataggcataagccaccacgcccagcctcatgtttcaactttaatcattcattgaccactctatcatctgcatgagctttaaaaaatgaactgttggagaacacctaactcactcaacaaatacacacatgcctgaaggagaagaattggcctcgatgggcaacgtagaaattctcctaggattagagttcagctctaaaggaggaaactgaagaaacgcattgacttttgtgtgtgtgtgtgtgtgtgtgtgtgtgtgtgtgtgagagagagacagggtctcactgtgtcacccaggctggagttcagtggtgtgatctcagctcactgcaacctctgcctcccaggttcaagcaattctcgtgcctcagcctcccgaggagctgggattacaggcacacgtccccacacctggctaatttttgtatttttaacggagatggggtttcaccatgttggttaggctggtctcgaattcctgacctcaagtgatccacccaccttggcctcccaaactgctgggattacaggcgtgtgcatggatttttgtctcaaatccaaagtgatgcaccgaagaacaccctgcacttcttagtgtttgttctctccttcatgggtgctggtactgaatttccagctctttcacggggcacttctcaccatctcagactccagagcaaaggcagatgtcccccaaatgaggttaacagactccagttacattcttttttaaaaccatcctgcagctaattccttaacacatgttaaaccaggtgggaataagagaccaacatcttcctctagactcagcaataatgggtcccctccacccccagctgaagttctgctttgcaaggataccccaagttgtactgttcatcactcttagcagacaacttagacatagataaaaatgaacggaatccatgttcttctctatttggctggcagacaacagaactaggccatccttacaatgttgttccagaaagtttgttttaggcatggggttcctgctgtcagttggctttctatgaggaaaactgggatggataaagatggtgctgaagtccatgtatggttgctgttggggccgcgggtagacagaaagggccaggcaggatggagagggagcttataaattagatcttacattaaatggctaagtaaaagagataattaggcaactcctctctattctcccctctaccccacttttccctactgcccccacctctaaataaatgtatagaaccatttgaaaaatattaacaactttgagtggtttttaaaatacctttggctactaatattattgccattaacattatgcatttgcttattgatactttcattttaaagaagtcaaagttttaaaaaggctaattttagatccaaaacaaccatattaacacatctggtataaacaatactgagaattcataacaagaaattattttaagttaacaaaagcttccccaacgctattttctactatagaaaatatgcaatagtttaatgtactaaaggccatggcagcagctgccagaatttaataccccttgggcttttataaatccaatttcccttcctcttattctcctttgctcttttctttttatctttcttttccttcttctctggagagaggtgaaaaaacagaaatgaggtggggttagggcaagtgacctgtgaatcaaaccaggtcacattcccacaagtcagagaaccttctttttcttgaacagtccttggagtaaaagaaaaagtgaaaacctcaaaatcgttaagtcttagttccattctcttgcctaatgtgagatcaaagttaatctaaacaaaatagcagcacttgtcagttaaagattttgaggggagaaaaaaccatttatttctttccatatcatacccattttccaggcccttttacactgcaagaattcatggggtgttaatgcacatctaagtccaccacagtactactcatctctctggcatttaataccctatcccctcagtgaacatttagagagcttgggcaaatagatcattgtttcccaaaatgtgcactgagaccgagggctctctgggatggtaatagattctgaagaaaataagcatctcataaattcacttgggaactgctgtgtctaaaaaaaacaaaaccatatttgtttacagcagaacttcttggagactgggagatgcactgggaatttctaagagggggatatagtaagtagtatttcccaagacttagctgacaactaactcctttggggtgagatgtcactaacctttgttctataaaacacaagctggagaaaaaattgaccacatatctacaattcaaccatgcgtatttgtgaaatattttctctgaattacgttaaatggcaaatcaaaatatggaaagtatcattaagaatctgactgactgggaaagaaagactgggagaaaatttctgccctttctttggctagctaagcttctgatgtgttctttctcagctgtattcatttgatcaataataataaccaccacaaaaaccacttagttccgtacctttgttttgcacatgagaaaactgaggcccaaaaaagttatctgctttgcctgaggtcattcagtgagaaagtggcagaatatggaacagaaaattcaatgttccacaatccaacattccctgaaattatgtttacccaatatgtactctggatgtaattatatatgtcaagataatgtataagagctaaataagtatctatttaactcagattacaccattcttctgattaagttatagtaaagcctattaatttctactctgcaaaattggcatttgtgataattcagctaggtctaggtaaacgtgtctcttgtattatttatgaagaaggaatatgtctaatataaacacaagtagcacaggaaacacttaattcatatacgacagacaaaaaaaatgatttggaaacatcttaacagtaacccaccaagaactgagtttttaatctacttttcatctatttattaaaacatttttgtaatgttttgttgtggtacttaaatcttgaaaaataaattggcactagaaatagtaacagcagccttgggttaacatgtgcattctctaccatctctccccatcaacccctagaagtcaatgttttgttccaagtggaattaagttttaaaagttaatatattaaaggaaactacaaaaggaagcagatgacagaacaataggctgaaaacaataatgcctctctgatggaggagtatacctttgtctttattgacagaaagtcaactttgtaagctaaagctgggtgtgtaaacggccttctcccctgcactggatctctgtaccattccaattttagtatatgtgctgccaaagtgagcactgcactggatctcttcttgagttaccacccactctgtgggggacatctcctctgctcctactctgggagaacttcccattcatttctgggagagatccctcccctctctccagaggatccccactctatctgcggaagatctcctccaccctgtgggggatcctcatcactctcaggggcattccctctcacccatgggggataggagcaatctcttctactctcacaatttttctaccatccatatgttaatgactcctaaatcctttgctgtagttggctaccttaaatacttctgtaggggaggagcaaagaaaataaaggagaggaagaaaggtggtatctctagggctgacctcacaccagagcactatttatgccctaccagcatatctaattaaccttcttctcatctttgtccataaaccttattctccacttctattctcaatctgttgttagcaccagccatccaccagatagccaaacaaggacttgggggttcattctatatttctcaattgccctgagaacctacatccgatcactctccaaagtctgcttcttttaccaacaagattttaataattcttctgttttgcctggagaaatcaataagtctcctacctggtctgcatggctctggctttgttccaccctcaaaaccatgctcaaatcaagaaatccccagaagtccctgtaaaacatcatactggctccatcacattcttgcctaacacccttcagtagtaccatgtcacatacaggacaaagcccaaactccctagcacaggttcccatctagtgtctgcccacagcccagcctcactgtcatgacgcacactctgtgtgatccaggaactacttgcagctccctgcaatgtctgtgcagcttctgacctgtgtgtttttgctccagctgttccttcatcctcaccctcattccgcaggactcagctcaggcctcagctcctccaggaagcatttcctgtcatctgggatagtctagctattcattctcagcactcctatgataccctgcagcagctgctgctctttaacattgctccccaactctttcttcatgatgtgtctcatccttgggggcagaggcagtttcttactcatctgcgtatacccagttcctattacataatgtatgccaaataaatgtctactgaatgaataaaacgagaaaccagtaatgacaagcacagacccactaaggccaccttctttctgagttcctcctcagtcccaagaacccctgccaaattctaggtaatgaccccgggtaattacatcaatttgccatacactaaaaattactctaatttaaacttcactaatttggctggcctttccaagtcagttttaattaatgatgttctctctgttgagatatttcacatagagtattttctggactgaattattctgtgtgcctcagttctctgccactttccatgggaagagctttgtatagtaaatgacaaagtttataatatttttaaaagttcctgttgaagatatttctcagcagaatagtatagccacctgttttcactcaatcataactcctttcctcagccaagcttttttaagcttggtcccagtcctgtttttgtttttttttttctttaggaagaatttgagaaaaaaattaaattgccattctggagtaagagaagattgaaaattattaaaacatacttcacattgaaggtgtaactgcttttggctcagaataaccaacatatttcaaaaatgtattcaaactacatttaatttagtatctagcttagtctccctcacgaaatcactgtctaactggcttaaagcaaaataaaatatttttaagcgaaaaagaactaaagctatcacttctgagtaaatgcaatcagcacaatattttagcaaaacatcacgatttataatacataatgataataaacatttctgccattgaggtccttagcactgcagagaaaagaaaggagcttgcccctgggcttgtaatctaaattaaacaagcaatataagtcgcacaagtttcacaggtgagagttaattaacattttatcccaagcagtgaaggaaaggggaaagaaaattaaaatcaatattaacagcatcagaatttacttcaaccttataggagtcatctgaaacgtgaatataatttgagaagcttgtaacactaccaagcctgcctgatagccccttactcctcctcctacttggctatcacctaaacagcatatttatggggttgattcttgtgcagcttcacacagccaatgggcagaactgcctaaagatacaggatggataagacgaactccaaggacctgttcctgttttatgacacaaaaattttctcctagctttttgtcttcctcactccttatgacaaagcatgcaatgacagaaaatacactgaacctgtattcatttcacactgtttgttcatgagaatatactctcaaatcctcattaccaaagactatttgaaattgatttataaacaatgtgagcacctagaatgtgtttccattctcatacaattcacttcattttctaccaagtcattgaaaaatatgtaccaagtaatggtgagcgcccaatcagccacctactatttttaaaaaatttagaagtgaactagcttcccactgctaaacactgaaaaaccaataccaaaaacagtaccctaaagaaaaagacaatgcacaattacgtcaaagaatagtaagatatgttgcctcttaaatcttgctccaaggttttcttaaatgagaatccacacaagaattagttggtagatttaaaaagttcagagggcagagcatgggttcaacaatgctgcctattgatgtttttggtttactggcccccaacactcactgcattttctctggcctttcattcagccccagtaatgcaagacaaagcaagttctccacttgcccattagactgctctgaatatggcaatgtcagtgcccatgttgcagacagtgacagttcacatcactgacacaaattacatctaattgcacggaggcacacatgctgagtaaaagacggcccacacctaactggctgggtcagttgcaagacagatctcgctattatctagtcccttcctggaaacctccctccatacctggtgaaggattaaactcccttcatacatgaagaatataccttcatacctggataaccagacccatctcccacaacaccgtgagcattatgaggctggaatacaaaaatataaggatttcataaattctaaataattttataccatacacataaggaaacagtaataacaagaacaacccctgccccaccacctcccaaatacaacaaatggtaggtaaaataccttctgtgcaacagaagagcgaagaccagatagcaattcccatatggaaggcacagtaactgtgctattgaaaaacaccatcagttcagttattttccacacaaagaactgaaagataataacctctatgcacaaatgaatcttgggctttacaaacatgtcagaagcatcaaaaggcattagagtaagccacatcgtatgaggcgatttatcctcaactttgtctgaatgctccatagaaaaagacctagtttttcaatacaccaaaagcactgccctttaaaaagccttctcatcttgccttgtaccagacacttgttttccaaatataccctgttcagattgctgatcttcaggttcaatccttcactaaaagactttctgcatcattgacataaaaaaaagcttgagttattaaaggttgaattgtgtccccctaaaaggaatattaaagtcctaacatccagtacctgtgaatctgactttatttgggaatagggtctttcaagatctaatcaagttaagataaggtccttagggtcagccctaatctaatatgactggtaaacctataagagagaacagagctcaggagttcaaggttacagtgagctatgactgtgccactgcaatacagcctgggtgccagagtgagaccctgctcctgccccccaaccaaaaaaagaaaagaaaagaaagaagaagagatacaggcagaacaccttgtgacagtggaagcaaagattgaagtgctgctgtgtaagccaaggaaagcctcaaggacttcggacaaaacaccagaaacaagaaaagattctcccctacagatgtcaaaggagcatggccctctcaacaccttgattttagacttctagcctctggaactaagagacaattttgttgttggttgttgttgttgttgttgttgttgttgttgttgttgttgttgttttaatccacctagtttccacttaatggcaaccctagagaactagtacaagggttgtgtgttccattcttttacctgcaagcagggctgcaggtaaaaattaatcctgataggcagactgtgttagatgctatagaaccttctgtaatctatcctaatggagaagacctcccaaattagaaattcttatctgtaaccaaaacagaaacaaaaaagtgttactccaattcactacttttccacctgaaagtatctttgaaaactgctgaggtcatcctgccttcctttcctaaggaaatcctcctggaggaggcaacaaggcaaatccaaaaggaccagcaagcaacttttcactctcgtcatgtgtttttcagaatacccagatctcaaaaacttcatgcttcaacatccgtgggtatgagcacataggcaatgacaactctctatcatttaatgaaatcacagcatgcaccactagcaactgggaaaacagagcattcctattgaaggcgctataataaaatgtgctctaaaggagtttctggtttgctcggtttggaacaaagacatatgagatacagtcacaaaaatagaggacagctctggaagacagaatcagagaacttgttgttagctagttatgtttttagagatcccataccataattttacagatgagaaaaatcatgctcaagatacatctttgaggcaccattgagggctctggcttaggcaggctttctaccagactgtgatcccaatgcttcccacctccaaaggcaggatgataatatttattatgtgcttcagatatcccaactaaaacttgttttgtttgaaagaaaaaccagttttgtaagaaagaaaaaagaatgtctatcattttaaagtggaaaatgaggaacatattaccatgttataaaatccccaaatactcaatgtttaaatgtatcagaaagcatgacatttaggacaacatgctagtaactgggcctttaaagaccacaattacaacctggcttttctaaacagacataaaaaattcctttctgctgtatttaacaaaacaatcatataataaaacatattacagtatttaccaaactgagacaaacaataaaatttattaccacccattttaattaatacgactacttgtggaatcaaggagggtaaaaggaaaaagggaaatgtgggccaggcatggtggctcatgcctgtaatcccagcactttgggaggccgaggcgggtggattgcctgagctcaggagttcaagaccagcctgggtaacacagtgaaaccccgtctctactaaaaatacaaaaaattagctgggcctggcagcgtgcgcctgtagtcccagctacttgggaggctgaggcaggagaactgcttgaatccaggaggtggagattgcagtgagctgagatcacaccactgcactccagcctgggtgacagagcaagactcagtctccaaaaaaaaaaggcaaatgtggagcaaaaataaaatgtgagagataaaagaccagggataaaaataattcaaaatctctacagtggtaggacagttgaaacacatatatataatcacaccagaagatcactcaaggttaaagcttaaaatatctatccttccatttaggggtgaccatagcacagacaatgacaggaagaatccttgcttctggaaacttcccgtaaaagtgcaacattacagaaggtaaagtgagcaacagacaatgatgatcaaaacccattttcaggactaactccttccatttcccttctttcattgatttttttttaaacccactttgcactcagtcagcttggttgcagggaacatcgtttaatgtaccttattgattcaatcatacacatttatacttgtgtagaaacttctgctacagtgcatttattgatcttttaattattaatgtaagccacaaaacctgaagagctttattgtaaatattttttattctctcaaattatgacaagaaaattatcaaaaattgtcaacaaatgaaacatggtagtttgcttatttcctctgaaaaggctaatcaaccggttatgtatcaaatgtactgtcaatgagaatttttttctaaagtcagaattatataagcctgaacagttctctgatgaaaactttaatttctagaattattattactgtgatgcctttaatttggctctggagatggcaagcaagtgttccattccagtgtggccattttcaaattgcacagagccatcaggtgagcaagctgtctgtcaaaatggtcataagataggatcctgtgctaacggttgtggacaaactgtgaagtggcatgcattgtctggtgaattactttatcccgcttgtctccgcagtatggccctctagacctagagtaagatacattctcacccagatactctgtactatattcaaaatgagaattaaggggactgtctaggtgggaagctctgcagaaccagccaccaggctgtagcaaaaggcaggttctgcaggctttagaagaagtggaaggggtggggctgagttcttactgaagaaaagggaggcagaaaacacatttaggttcaaggtggaaagagatgaaactttgatggtcatcctttcccatgcaaacttctcccccatctctccctctaaatactacttcagctagccttaaatagtcaatgtaaacttggatgaaccaactgaaccggaagatactgtcttaacacaggcttaattctaccctgccatagatgatttccagtggaagccagcttcatgcttacatttcttttagaatactgaccagcaaatatgtttgccattgcaccttatactttccaataccaaggcaatgatgtgtgtaataaaatcaagtataacctctaaaaaacaccccagaatttgaaataataatttaaatttgtgttgctaccttctagagtctgttaggtttttccatttctagacaataacaagaagacctgccacttccggactgaatggtcctgaatatgaatagaggtgtcacatatctaacatggagcactaacagtaaataccagaaagcctgggcacttgactagtgacagaagcagatatcctcaagcaaatgttgctctggatctctgaagaatctctgcattgctcagcagtggcaacaaatgcttgaatagtctgtcaggttcaactctcttccaagcttcactgttccggaggccacagaatgctgcttctgtttggttcagaccttcagtgaactataccaaatagatgggaacccttcctcagaactgatctcactagccaaggacaccgcccatttacatgagttatatacattacccaaatgcatattcaacatatttataaaccatgagtgaaaagctgaataatatattcacaactaggaaggagactaggattggccttctaaaagggaccacgtggttaaagatctggtatccacaaatacacatgtcatcaaacaagtcataatttgtgaccatcatgcatttaccttgacttttattatttaaaatacacatacagctaatttgccaattacatagaacacacaatgggcccttacacagcaaacatacctactaatgtggtgtctaattcttactttgttctatatcccccacagcagatcaaaaaatcagccttactgaaataatttctgataggaaaatttgagctatgattttaaaccatttttgtgtccttctgaagaattcctactttaatttagacccaaatcaccataatcagttttcttgaaaaatgatacgtaagtaaaatgtgtatgaaaatgttattaattaaatggtattttccaaatatcttaaagtattagaaatgccaaattctttagagtatgaataccttcacaaaagcccttttacccaagcttaaagagtacatagtacatgataccacctagaggaaaataattttataaattaggccatagtattttaaacatgtctttaaacagtttttcaacataacaatatgtagttatagagccaagcatataatcaaacaatgcagtaatttaaagttctctgacgttaaatgaataaagaaaataacatattatattgaaaacatctagtctatggctaacattctctcaggccatgtatagaattacaaaggaactagttcttaaattacccattttaaaaattagtcaatattaacagtctctatttagataatccaccactcacccacatttaaatagaaacaatgttttcatttactacttttcaaagagaggtgtcttccaaacaataattctttagttgcatatcattagaaaggttttgaaaaaatatataaagcaagtaaatgtcccacaagcataccaagatggcaactgattcttcctgggtaatgtttgctcagttatttacagtgatatttgattatagtaatatatatagatttttttgttcccaaactctgaaaccattttgcctattcatgctagttttgccaatcagtaactcaattattaaggaggtccagcactcatcccaattaaaactgcaaagcaagaggtattgccttttacctggcccatttctgctttcatagtccttccagtccatttcctctctgaactttttttctcaattagcacccaggtcccttaccctccatactcatggcttagcggggttgccctttatggacagtgcccatccttccaaaaatggacaaatctgcaaggccacactaaaataaaaaaactatcctatctcccatttcctctatctccaactgtttcctaggttccaactagctaatcagattaattgacaccatttgttcactaacaatcttacactaagtcatttcttcaacaaatatctactatgtaccggcatttttctaagtactggggacatactggtgaacaataccaggccaaaattctttccttcatcgaaggttaacacaatgttatcaattaatgataaatatattggtgggtgtggtggctcacacctgtaatcccagcaatttgggaggccaagtcgggcagattgcttgagtccaggagttcaagaccagccttggcaatatggcaaaaccccatctctactaaaaacgcaaagaactagccgggcatggtggcatgcgcctgtagtcccagctacttgggaggctgaggtgggaaaatcgcctgagctcaggaggtggaggctgcagtgagctgagatagcaccactgcactccagcctgggcaaccagagtgagagcctgtctcaaataataataattattattattatataataaatgtatttatttaaatatatataaacgtgtgtgggagttagatgattctaagaccaagagagaaaaataacataagaaaagagctgttgtgatgaggttgtattttattaataaataagatggttaaataaagtgatggataaagtctaaagaaggtgagggaggaagctgtgtgatatacggttaacccttaacagcatgggtctgaactgcacgggtccacttaaactcaaattttcttctgcctctgccacccgaaacagcaagacccaccccttctcttcctcaacctctcctcagcctactcaacttgaacacaacaaggatgaagaccttataatgatgcacttccacttaatgaatagtaaaaatatattttctcttccttatgattttcttagtaacgttttcttttctcaagtttactttgttgtaaattttgggggagtcaaaagttatgtgcagcttttcaactgtgcaagtggtcggtgcccctaactcccacattgttggaaggtcaactgaatatggggaatgtgttcccagcagagggaacaacagattcataagtcgtgagttagaagagcgacatttctgaggcacagaaatgaggccatgtgcctgcagtggggtaaatgagacaaaaggtagtaggtgttcaaggtagggaaacaccaggaaccactggaaggactttgcatttactctgaaagagaagggaaaccattggagggtttttagcaaagaagtgacctcaaccaatttaccttttttttttaacacctttactgagatataattggcatatgatatccattttagatgtgcagttgaaggagttttagtatattcacagagttgtacaatcatgatcacagacaactttaaaacattttttatttttttttaactttttaagttcaggggtacaagtgcaggtttgtcacataggtaaacatgtctcgtggggttttttgtacagattatgtcattacccaggtattaagcctagtaccaattacttattttttcctgatcctctccctcctctaccctccatccttgttactccaaaaagaaaccccatatccatcagcagtcacttcaacctccaccccaaactcttggtcccaggcatttcttataaatggagtcatacaatatgtggtcttttatgtctggattcttacacttcacatgtttttaaggttcatccttgttgtagcacgtgccagtacttcatttctttttatcgatgaataatattccattgtctagctatatcacattttgtttattcaacagttgaaggacattggcgttgttccctctttttagctattatgaatagtgctgctataaacatttgtgtactagttttgtgcagacacattttcagttctctcgggtaaatatctaggagaagaattgctaggtcatatggtaactctgtgttgaaccttttgaaaaagtgccaaactgttctccaaaatggctgaaactttttttttttttttttttgagacagagtcttgctttgtgatccaggctggagtgcaatggcgtgatctcagctcactgcaacctccgcctcccaggttcaagagattcttctgcctcagcctcccaagtagctgggatcacaggcacatgccaccacgcctggctaaattttgtattttcagtagagacggggtttcaccatgttggccaggctggtctagaactcctgaccttgtgatctgcccacctcggcctcccaaagtgctgggattacaggtgtgagtcactgcgcccgcctgaacctttttatattctaccagcagtgtatgagggcttcaaattctccatagcctcaacaacacctgttattattggtctttttgaatatagccatctaagctggtgtggtatctcatagtggttttgatttacatttcagagactgagtaccttttcatgtgctttttgatctcttcagatctttgcccattttcgaattgtgttatgtaccttttttattaagttgcatgagttctttacatatccaatatacaagtcccttatcagatacatgatttgcaactttttctcccatttcgtagattgctttttcacttttttatggtgtgctttaaaacacagaattataaaatgttgacgaagtccaatttatctgttttttgttgctgttgctcgtgcttttagtgtcatatttaagaaactgttgcctaatccaagatcatgaagatttacatctgttttcttctaatagttttatagctttaggtcttattttaggcctttaaaatatttttgaattaatttttgcatatggtataagagaaagagtctaagttcattcttttgcatgtagagattcagttgtcctggcaccatttgttgaaaagattattctttctcacattgaattaccttgcactcttataaaactaaattacattttaacagaatttctatagtcatattaagaatagacaaaatgggcaagggtagaagcagagaagccagttagaaagctattatcataaatcatgtatattagggcttgccagagaaaaggaaccaatagatatatagagacatatagaaagaaattatgaagtattggcacacatattattgaggctgagaagtcccatgatcgacatgctggtcaggaaaaccagtgacatagtaacaatccaaatctgaagggctgaggagccagtagtgttagtcctggtccaagtccaaaggcctaggaactagaagcatcaatgtccagtcaaagacaggagaaaatggatactcaagcaaagagagacagagagagacagagacagagagagacagtgtgtgtgtgtgagtgtgagagtgtgttagttcacccttcctccatcttatttgtctatttgggcccttgacagattagatgatgcccactcacattggtgagagccatcttctttactcagtctaccaattcaaatgttaatctctttcagaaacactctcacaaacatacccagaaacaatgttttaccagttatctgggcattctttggccttgtcaagttgacacataaaattaaccacacaccaaataagagataatggtggctcaaccaagagagtagcactggaagtggagagaagtggttgaattctggatgttttggaagttgagctgataggatctgctaagagactggatgtaggtgtgagataaagaaaggactcagttgactctaatatttttgatttttcagttagacaaactgcaattttggggaatagggacatgatcgctcaaactaccgtgtgtaaaatagactgggaacagggaattgggggataggatgaaagccttctatcctagaaacaatttctgtttcattgaaaatctactgagtccatagggcacatagatggcactagttaatgttcctttacagtgaaagaggctgtttattcactgaaaagagaatgccttgagggctttattagggtcttgaactgaactctttctgtctgtttgtataagaggttctcagaacaagttcagggttgcccagaagttgtttttagagaagccctgaagcctcatactttcacagaaggagaccttgataatctctcatcaggaatttatttgaaatgtcattagaacttcttagagacatcatgactaacctaaaaaaaataattaactgtgagaactacaaattttaccacaagacagtggagaaaacattacaggatagatagaaattcaggaacccctcaaatcacactcctccagaacattttcactggaagacaaaggagcctcatttcctattaactcagaaactctttcaagcatctgttgtggtagattttctaataggtccagcccagggggttctcaggtataaatcctcaagttctagtaaagcctcttgagaagatggtcaaggcacaacttgaatagctcataccactgaactggaaaaatgctcctaaagctctagtgtcctttgaagagacttgatcttcctcccctggccttaagagaggcaggtaaagcaggataagtactgcaacacacagggaagaaatgaaatcacgaagatctctctttctgcgtaaaaatggatgaatttcttcggatttagcagctgtcttagtctgttttgtaatgctataacagaatacttaagattgtgtaatttatgaactacagagatttatttcttacagttctggaggctaggaagtctaagattgaggggccaacatctggtcagggacttcttgctacatcaaaacatggtagagagagagccagagagaggggagcaaacttgcttttataacaaacccagtctcacaatagcaaactcactctcatgacaatgacattaatccatccatgagggcaaagccctcatgatctaatcacctcttaaagatcccatctctcaaaactgttgcgttggtgatggggcttccaacacatgatctttgggaggacacatttaaaaccacagcagcagcttttcactctctctatcctagaaacaacttccatttcagtgaaaatctactgcctccacagagaacaggaatggcattagttaatgttcctttacagtgaaagtatgaggctttctcatacttttcagggcttctctgaaaacaagttctgggcaacccactttaggttctgagaacctgttacaaaaacagacagaaagagttcagttcaagaccctaataaacccctcaggtcattcttttttcagtgtaccaacagctaatgaggaagctgtgcctcttaacgaggaaaggaggctaggataccatgccaaggatctccaagacacacaaaggaagatgtaaatctttcctcaggcctggtgacaagacaaagaccaaatggaatcctaaaatgggctctttggcagtcacgtctagaggaatggaagacgtgatgaactactctaggaactggtattaaaacaagcaacccaaatgtaaataaaagactacttgcttcaattaagtcttagctacaggagtgtgaactttaatatttcctcagtgtacatctccgctagtgctttcaccattattaaagtatgtttatacagggtttggctttccagctattatggaaaaattacatcttgccaacagtactataggggtctaaacacagcaaatcctccactgaccttgaacccaagctaaagcaaatagtcactctccttggtgctgaactgcctaaataatgcactgcataaatggctgtgaatctaaattacatctacaatgcatcttagcattacggattactaacaatttttccagaaggcagtgtttgtagaggcattgcaatgtgaaggaaattcttagggagaaaactggaaaacattcacttgcaaatgatgatcatttatttattgaacactaggagtatgctgggccttgagctccacagaggaggtagcagggtgatgacagtctctggccagaaggcttcacaagagtggaggaagaagatgatggttaacagacaatatgctagaggaaaagtaactgcaatagaaagtttgaagtggtgaagcatcatgagacggaacagaaaacaaaagagggagaagacaacaaaaatgccaactgaaatatctacttaatataaaattacacttccatttgaaccaaaataaaatttatccacatgtaaaagtgctcagaaaataacattaaatgaaaaaagcaaaatataaaatgattaaaacataaaatcatacatatatacaaaggccaaaaactggaagggaatacagagaaatcaaaaccacttaaggaaaacgttagaattgtggacatatcagttttcttttgaaacttcctttaatcatattgtaagaacacatacactatatttttaaaaggcaattagagtatatgtgaatattcactacagctctgtttgtgatggtaaaagaaatagaaacaactaaaatatccatctatagataacatattaaatgaattctggcatatacataaaatgagctgctataccactgatatggtttggctgtgtccctaccccaatcttatcttgaattgtggttcccataatccccagatgtcgtgggagggacccagtagggggtgatttaatcatgggggcagtcaccctcatgccattcttgtgatagtgagttctcatgagatcctatggttttataaggggcttttcccccttttggtcagcacttctccttgctgctgccatgtgaagaaggacatgtttgcttccccttccgccatgattgtaagtttcctgaggcctcccaagtcacactgaactgtgagtctttcctttataaattattcagccttgggtatgtctttattagcagcatgagaatggactaatataaccactttaaaaattgaggtatatctatttgaattgacttgaagatatgtctatgatacatggctaagcaaaatttttaaaaggcaagtgagaaaaatacatatggtataatcatatttatatgaatataaacaactatattaatatatgtcagtgtgtacaccagaaagaaaaagtttaaagcaatatacactaaatagaaaagaaattatggaatgggagatttatattttttatattaatgtatttctgtaggtttgagttttgtaaccttggattacatatgtcattagaaaaaaactttaaagaataaaaactgaattaaaattttaaaaaataactgtcatgttaggaaaaattctttggacatttattttatggtaacgagggttaaaatttaagaggagctttgaagggcagatggaggttagggcaggagacaggcagtgtaattaaggaaattaaaataagtggtcgataagctggactcttacttggccagtagtaaaccaatcaacactaagttgaggggtaacaggaatgagaaaatcacctgaacataaacataagagaaggtatttcatagagtacaacagatcactgttcatccatatagttctaagaaaaagtaacagggaatttttgaaagagagaagaaagtaagtagaaaaaaaaaagtgaggttgaaaactagtgggtaacggtgaataaaacagcacaaagaaaaactggaggaaagtacacagaatttatgaggggactcataacatatggccgatttaccaaaagctagtcaagctcaaagtcatctgactccaaatccattaacctgaaatccactttcttgttttgaaatgcaatctgaacttcaaacggcagtttgtctcctcttaaccagttcagcaaacttcacttgaaaatcaccattgttcatgctagtctgcatcaccatgcctcagatacttgcaggaatcggggcagccaaaagtgtttcagctattgggacctcccctccagtttagcaagctgggaatggtgacaagtataagtggcatgcctcagtataaaaagtaaaatgattggctctaccatttacagtcacatcacaacccgtaccacttcagattcctagtctgaaaaacgggtataatctccaagaattgtgagattcaagtaacaaacaactgagagctccatgcctgggacatagtagactctcaataaatatttctgaatgaacaaatgaaccaatgtgttatgatactatatggtattattattgtgcacaaaaagaaggtatggaaaagggtagtattctagtgaattctatcactgtagtaaggtcaagtaacttccttttatcatcaaagtcttgcatgtattgcttccactgccataactgcccttcataaacaagtttcccaggcatctgtaatcccacctccaactttgcaagtttatgtctggacctgttgccttctctctttagaactatacattctgcgatggtgagggttgtgtcttcacacttcatggacaggcttataaccaacaaaccatgcagaggagaaaacatgtctaagccttcctcaggcccaggcagaatcctctggtgccaacacctatgtggtggcaatgaaggcgattccagattctttggtaatgttgaggcaaaaacattttgaggacctagatgtgaacaggccctcaaattggatacctttttatttgaaggatataagattcagcaataccctctggactacagtttgttaattcaggtcctcagatcccaaagggatccatggatagaattcatggaagttcttgaattcagatggaaaaaaatcagatcttttgtcaccagtatctaactgaaatttagcgtttgcttcaagtaggaatttagacaacaaatcatggtagcattagtagtacttacatatgtgtcaccaacagaaatcacagatattttcatatctcactgcaattcttgttatctcaaaatattatctgtttatcaccactttaaaattagtggtcattatgtgctctgctaaatccaatacaatgtgttaatgaagaagcatgtatattaccataacacgagtttgttttaataacttgataactatttcaatataatcggctccttgtcattctatgtgttttatttcattcatttacatattttactctgagaaacagtccatggacttcaacagactaccaaagatgtccctagcactaaaaaggctaagaagccctgctccaaactataatgcccaacaattaaaagtattatgcaagtacaaatcccattacttgaagcacttttaactataaagatgaaaacattacttgagaatctgcaatcattctgatatgtaggaattatttacattgactaaaaagttctaaactaatggcctgatttacgtaatagagcagcctatgtatgaaacagtctgatttgagttgttattacattttagcacagagttaaaaacataagtatttctatcaaggacttggctttgaagtttgtcttgaatttactacctgaccttgggcaagtcggtaaacccagctaagccttagttttctcatctacaaaatgttgaaaatacctcctccttcaaagcattattaagagaattaaataatacatgcaaaatactaaataatggatacaaagtacttagcacagtaccagacataataagtactaaataacttacagcaatgttattgtcctattttacttattaatctaagtaaaactttatattgagtctttaagatgatttctttaaagtattctataattaaaagataagagagcatgttgcttcagaatacagactctaatgacagactgcctgggtttaaatttttttgtaccacttacaagctgtgtgcctctggataagttacttaatttctctgaggtttagttttagatctgtaaaatagggaaaatagtatctatgccatagggttgttatgaaggtcaaattagtaaccacaggtgaagcacattaaaacatgcctagaacatgatactttgtaattactagctattattaccaacagtaattatgtaatagtttcacgtcaagttacacaggagtctttcttcctctttaatctgaattttagtgaaaatttcttataaatggagtcagccacattaatcatactatttgcatgaatgtatttgacatcaataagaacaaggcagggaataaattcagctacaattatttacaaggaggaattaggaagaccccatttcctttggctttgtaaccaagttaaagcccatacaagaaagattctctgtagtttgaaatgcttattttatggcaacagatctatgaattacaggaataaacataattttgcttttttacctttgaacaggtacagagaggcacctctgtgcccaaggctggagctcaccttggagaagagagccatggaaatgctgggcttggtgacaacagcaaggacaacatcagcatcaagtagcaaagatgcacctgtttcccagcagggaaccagctttgctcctcacgggcaattagcaaggtttgacttaatttaaagcctacacaaccactgatctctgagaatatgactgatgttattttctgtactgagagtaacagtaaaacaacaataatgacaataacaagcacttcactcctctccatcttttaaggtagttgagtaattagtaactcaacaattagtcatcacagcaaaactatgaagcatgtaaaagtattctcaccatcatcttatttcagttttttacttatgagctttaagaattcaggatcctttgttgaatttattagtcctcccaacatataagacaatgaatattagagtcaaattatgatacataccccaataattcgactatactctaaaattaatacacatcaccatctccaggactaccaaaaatgcaaatgctggctggatctcatttttttaaattataacaattaaaaggttattaaatcaccagtgttaaaaagtcagcagcaataaacctttaggttttcacaagatgcacacagaggtctcccttggagatttagttttccaactcataaggctgaaggtccactcccaggaggaagaaaaaacaggaagcttctccccagagtaggaaaataaaatttggcatactctgggttttagtgaccaaagattatcaggaagtggaaacatctacagtagaatcagtgcagatgtgatcattagaaggctccatgctttgtgccagtattattatttccagcatcccttaatagtgtcaaaagcataacattccagctgagggattaatagctgccctaacaacagagcacacagcaggctttcaacacagcagggggcttttcaaaacaccctagggtagataggcctggtctttagtgcttgtaccatggctcaactacactgagataccttccaagtctccaagtatgaagcttggttctcaactccactctgatgtgattctgcagtgtagcacctttacaattcagattaaggcaagatctctgatctggaaccttttgtcaaacgagtcttggaacaagactgacagatgtcccctctacatcaacaggtagggtaaggcaaagacaggagagaaacccagaaatgtatatacatgtgtatgcagctacacagttgacacgtggtgcataatgttccatgcgatcaaatttctttcaggcccattcaaaacaaaatagttgcatgggaagtaataacagagaacctttactggttggaaattctcctcttatttaactaaaatcctacatatccttaatcactgtagtttagcattcattctagtgagaataatcttcctggaacacaaacgtggcctgttactcctcagattagacaccttcagtggctcccctgggcctacaggctaaaatcctaacactttgggatgacaaacaagacctctggtttggaccttacctacctctctagcttcatttacctctctggctgccaggaccccacattcctcgtaagtccccaaattatctgtcatgctccttcttatctctcaatgcttactggcaatatctctgcacctagaatgttttgtctttgtagcatttcaacaaatgcctattcatctttcccagctcagctaaggtcagccacccttgtaaagcctttaccaactttcctttcccaggagagacccactgcttttcttggactaacagaatctcctgcatcactgctcttctggttgccacagcactttactgcactgggtttttaaaaataggtttatggaataatagtttaaacacaataaactccacactttaaagtgtacaatttcgtaagtttgaacatatatccatacctgtgaaaccatcatcacaatcaagataatgaacacattcactatttctaaaacttttccatgcccttttgtcaactctctctgtcactcctctctgtccctcatccccagggaacgactgatctgctttctagagagtcattagcattttctggagtttgaaatatagggaatcatgcaatatgtagtctttatttttgccttgcttctttcacacaacgtaattatactgagattcatacacagtgtatgaatcaacagttcgttacattttactgctgagtagtttcagcatggataggctatactataatgagtttgtctttttacctgttgatggacatgtgggttatttcaagtttttgttcattacaaagaacactgctatgaacattcacatacaagtctttgtacagacacgtgttctttcctcttggggaaaaactgaggagtggaaataaatgagtcatgtggtaggtatatgtttgattttttaagaaactgccaaactattttccaacaggctgtgccattttacattcccactaacagtgtgtgaaaattccatttcctccatatcttcatgaacatttgatatggtttgttgctttaattacaaccattctactatgtctattgttgtattatctcactggggttttaatttgcatttccctaatgattaatcatgttgagcatcttctcatgtgcttatttaccacccatatttcttatccggcagaatatctgttcaattcatttccccatttttcagtaggttgttttcttattattacattttgagagtaatttatatattttgagtattttatatatgatttgtcatatatatttgaaatattttctcccaatctgtggtttatctttgcattctcttagtactatcttttgatgagcagaaatttttgattttgatgatgtctaatttatcaatttgttcttctatgaattgcactttcagtgtcatatctaagaaatctttgtctaacccaatctcacaaagattatttcttaggttttcttccacaagatttatagttttaggtgttacatatatgtccatgtggtgttcatttttgtatatattataaaatatggtttgatgttcattttttgcttatggatatcttgttttgacactatttgttgaaaaattaatcctttctccactgaattgcccccatgccttggtctaaaatccacggtctatacacatgtggatctacttctgcctctttcttctgttccaaggatctatttttctgttgggacaccagtcccacactcttttgattactgtagcattacaagtcttgaaatcagtcaaatttagtcctccaaccttcttcttttttaaaattgttttggctattccaggttcattgcatttcttttttttttttcttttgagacagagtctcactctctcacccagaatggagtgcagtggtgctatctcggctcactgcgacctctgcctcccaggctcaagcgattctcctgcctcagccttctgagtagctgggattacaggcacgcgccactacatccagctaatttttgtatttttagtagagacagggtttcaccatgttggccaggctggtctcgaactcctgacctcaaatgatccacccacctcaacctctcaaactgctgggattacaggcatgagccaccacgcccggcctcattgcacttctatataacttttaagattcatcttttcaatttaaaaactgctggcattttgattgggtttttgttgaatctatagatcaatttgggaaaaaatgacatcataacaatattgagactttttatcaaatacaagctttaactctctaacaatttaggtcttttaaaatttctctcaacaagattgggagaaatattgtacggcttctgcacattcttgtcagatgtatccctaagtatttcgtatttttgatactattgtaaatggcatttttgtttcagttcctgactgttcattgctggtatatagtaacacaattgatttttatttatggatattgcaccccagaaccttgccagaggacactggaattaagaattaagatcaacattttgatgcctaaggggacaaaagaagttgttcacaactacccatagggaaagacacgctgtggaaacacatttgctcaggagagaggagaaatagagctatatcctcagcatttatatttctatgcctttggcctagatagtttgagcctttaagcccatcagtcaagtgatatgggaaaaattcaaatatgtagtatctatggtttttcctaaaacagtttctgaaatgtgaaacagtataatcactaaccacataagagaaactcaggggcctattaagagtaatacgtcacctttcttttggtcttgattcttttcagttggtttctgcttttttccttatccaattacgaccagatttccttaataggaatctagtcctgacatttcagagacataaactgatgtatttcttctacgtatctacgtgtgtgtgtatatatacatatgtatacacatatatatacatatatatgtatataaatacacatatatatacatatatacgtatataaatacacatatatacgtatatatgtatacgtatatgtatacataagtatacgtatatacgtatatacacatatatacatatgtatatatgtatacattacacgtatgtatgtatatatacatatgtatatgtatatatgtgtgtacatacatgtgtatacatatgtatatatacacatatatacatatatacacacacacatatatacatatatacacatatatgcgtgtatgtatgtgtgtgtgtgtgtatatatatatatattattattattatttattttttttttttactgtcacccaggctggagtgtggtggtgtgatctcggctcactgcaacccccacctcctgggttcaagcaattctcctgtcacagcttcccaagcagctgggattacaggtgtgtgccactacgcctggctagtttttgtatttttagcagagacggggtttcaccatgttgactaggttggtctcgaactcctctacttgtatcttttaattttagcagcttgtttttttttttagagacaggttcttcctctgccacccaggctagagtgcagtggcacaatcatagcccactgcagcctcaaactcctgggctcaatagatcttcttgcctcagtctcctgagtagctggggtgacaggtgcatgccaccacacccagctaattttttaattttttgtcactatgttgccgagtctagtttcaaactcctggtctcaagtgaccctcccaccatggtcttccaaagtgctgggattccattcatattttgagtgactggtcttagactcctgactctaaaatctgcatattaatgtatgcctgtataactaaatctgcttctgttcttattgatcctgcatctgtaaataaaatgctggcttaacaatgcagcatttcctgcttgctgcattgattctccacaatagaaaactcagaggtcacatgtttctccatccttcaattcaccagaattctatctgctcaggagattaaaaaaaaaaaaaagataccattgttataaactccagaacacaaaacacttctccattccacacagaaaaaaatcaatgcatgttcctcatttcctaattgaaaggatttttggttaaacatgagcttttacagcttcctccacatctccatatgaccatcactgtcagaaccatcatctttgagtatgaatgacatgctatatgaagggcagagagaaatagacaccaggagaaaaacatacagaaataacatcaaagagtgaaatctggtcaaaattccctaacctgcttcttgtctctccaggttgtgtcacagtcattcaggaggcctcgggcactgctttgttcaggggctcatgtacccgtgaagctctaacacctctcactcctgcatgctctctctctctcactcactctaaataaccacttgtgggccttacatttctttcctataaaaaatctttaatgtttttacaattataatacatgttgacggtataaaattagaaagcccaattaagcctagataagcaaactaaaatcatcattaaatctagtactcagagactaccactcctaacatctggtacatatcctcccacacttttctcctctgttaaaacattttcaacaaaaataaaattataaaatcatccacaattgttttctaagttctaaaataggtaaaatggcaagaatacatgttgattactttctggtatgatcttagcaaaaccagtaaagcattagagataattggaccttaagccaaagccataaaataattatgatgtgagacctgaactatctccagccagcccatggttcattaccaagatgagcagaattaactagcaaataaagaaataccttactaactaaaaatcagaacaccatccctcagccaggtcatatgagacagtccagtccacagacaaagctttaagcaggctataaatatatgtggttgacacattcggggtgacatagtggaaaagagttgaggctgaattgttcctggtgagaagaacaaaaacttaagtgccagaggtccaaagaaaaaggctgggcatggtggctcatgcctgtaatcccagcacttgggaggccaaggcaggtggatcacttgagcccaggagtgtgagaccagcctggacactatggcaaaaccccatctctacatgatatatagaaattagctacctgtggtggctcatgcctgcagttccagctactcctcaggaggctgaggtgggagaatcacctgagtcttgcagagggtcaaggccgcagtgaaccgggatcgtaccactgcactccggcctgggcgacagagcgagaccctgtcacaaggagagaagagggttgaggaggggtgaggaggggaggggaggggaggggaaggggaggggaagggagagagggaaaggagaggggagggaaaggagaggggaggggaggggaggcagagagagagatgtgcatgaagtggagatgcaacacaccactggccatttttatgtgcatccgtgtgtctcattggactgggagctctcagcaggtatcttattcctctcttttatctccagtgcctagtacttagtaaggatttgctcattaggggctatcccagaagcagttgagctgaaattggacaggcaggaacaagtctgcattatgcatgttacaaaaaagatgaaaattaccttctctagttataactgtcccactgtgatttaggcaaaagccatcctggatatgtcacaggtaaatgtttgtaaataagcaggatatacttgggaggctgaggtaagaggatcctttaagcccagggttccaaccctggacaacatagtgagactgtgtctcaacaacaacaaaaacaacaacaaaaaaaaaaaaaaaaaaaaaagctggataattttagggttgtaagcatcgttaatccaatttcttaacatagacatataatattgattttcaaactcccagctgaatatttttcccctaaaacatactgtttccaaggttaatgtgtgttatgaaagataaaaatgtatgggagataattatacgagagacctgatatggtggattaattgcaaaatggccctcaattctctgctcctctttgtatccattccctctgatatctgactttgcaactcctcccatcaagaggtagggtcaatttccccatcccttgaacctggattggctttgtgacttgctttgaaaacaggatacagggggagtgaaagtgtgccagttctgagactaggtctccaaaggtcttgtgagcttctcctctctcagaattctgcctaccaccaagctggccagctggatgatgagacacatgtggttgtgtggcttggccatctcatcactccagctttcagtcagccaaccaccagacatgtgagtgaggacaccctcaaccagccggctctgagccactctgtcatgttagcacagatgcatggcatttcagcaaagaattagggaaatgcaaattaaagccatagagaggtatcaatacacacctatcagagtggctaaaataaaaaatgacaacaccaaatgttggtcaggatgcagagaaacaaagccattttacactacaagtgagaatgtaaaatggtacaactgcggaaagcattttaaaagtttcttataacactaaacacgcaattacctactagtacactcttggtcatttatcccaaaaatgtatgactttttttttcatccagccaaataaaaacctatgttcaaacaaaaacctgtacaggaatgtccatcacaactttattcacagtagtcaaaaactggaaactggaaacaacacagaagtctctcaacagattggccgggtgcggtgggtcacgcctgtaatcccagcactttgggagaccaaggcaagcagattacttcaggtcaggagttccagaccagcctggccaacatggttgaaacccaatctctactaaaaatacaaaaattacccaggtgtggtggtgtgtgcctataatcccagctactcaagaggctgaggcagaagaattgcttgaagctaggaggcagaggttgcagtgagccaagatcacatcactgcactccagcctgggtgacagagtgagactcctctcaaaaaaaaacaaaaaaacaaaaaacagataaatgtttaaaaacctggattactcctcagcaataaaatggaacaaattataaatacacacaataacttagataaatctccaggtagttatgctgagaggaaaaaaaaagacaatctcgaaaggctgaacactgtgtttatataacattcttgacatgacaaaattatagaaatggtgaacagatctgttgccagttcacagacagaggagggacaagaagagaggaaggtggatgtgcatagaaggccagcatgaggatccctgttggatgaaagtgtcctgtatctatgtcagtatcctgactgtgatattgcactacagttttgtaagatatgactatttggagaaattaagtacaaggaatctctttgcattatttcttatagctgtgtaggaatctatatctcaaaataagtttaatttaaactaattacctgaatggctttgggcaggttactaatcctaagccctggtttccttatctgtaaaatgggggaaaataggacttaatgaggcttaaattagacgattaaatgatgtttacagtattcttagtgcatgattagtattcaataaatgttactgttgatatttgtagtaatagtaacaacagtcaataaacatagtcataaattcaaaattttatttgttaaagttctaccagatttggcagggatggcagcaaggcagacagcagtctgagcaaaggaaaggacgctctgtttgctcaaggtctagaaaaccaagaaaaacagctctaccttacaaacagctagagaatgaaacagaaagttaagtaagtgaaaacctggcccctggaactgataagtttctttttttttttttttttttgagactgagtctctctgtgtcacacaggctagagtgcagtggtgccatcttggctcactgcaacctctgcctcctgggttcaagctgttcctgcctgagcctcctaaatagctgggattacaggcgcctgccaccacgcccggctaattttttgtatttttagtagagacacggtttcaccatgttggccatgctgatctcaaactcctgacctcaagtgatccacctgcctcagcctcccaaagttctgggattacagatgtgagccactgctcccagctgcttgaactgatcagtttctataaagctatgtaagtaaacatatatccaaagagtcatagaacctcggagttaaattagaacttaactcactgaactttttcaacccctcatgctatactgaaacagtctccacaatatctgataaagttgttttcttaacttctagtgatgaagccactatcttgcagagtaaaatataattgtttaactctaaatcagaggatgacactctaaactgcacatcagaatcatttgataaacattttaaaaataagagtttaatgattttcaaaggtatgactttttttcatcaccttggaagatgtctcttcagtgtgtagatacaggcaacagttaaagatactgtatttacttcttggatgatgtcttaatccagccagactacagcataatcaagctgcatcatattagggcatatccacccacccatccattcatttaacaagtaattactgagcatcttctatgtgttaagacaccatgttagatgctggagctacaactgtaagcaagagtggcatagtctctgccttcataaaatgtctatcaagagaagaaaataactgcttcattatcacaaaattatgcacaatggtggagattaaagaggggctttgggaatacctcataggatgcagaagcatctacttgtctgaaaggttatcaacaataagactctcttccctataggaatacactgagaaaatatagaccaactcttttttcattagataatgaaaagaaactcctcatttgtctgccatcatgaaagaatatcctggtctaagtgcactttgtagaaggctagaatgtatcaccttgtactaaaggtttatttaacatttctaaaaccaagtccttctaaaatgcaacattaggtactgccctgaatcactaaaatagacaaatgattgtaatttatactattttcagtgctcctggtaatcctcatgaatgttagtactatgtatttataccaggaagacacagaactctctgagggatgtagaggaacagaactcccactgcatgctgtcccctgccatctgtccatgccctcccccgaatgcctggaacccaacgtgtgcatgtttgccccacactaaacatccctggatcagtgatgcattctgttttctttagggcccgttgactccattagcacttgtccacactgcccacctctgccatcatccctcccttctatcctgctctcttcagctaaattgttcttctccttgcattttataagctggaacataaataaaaatttccaagggaatccaaacaactgtcatcatatataaagtaaaaagactctttgcccaaaacaaagttcacatgcacagaatttgtggaaaatattttcagtgggacaagaggcactgcactttcctgactttattccaggatcacagatattccaaaagcattaaagtggaaaaaaaaaaaaaaaacaagcaaacaagcaagcagatgccacctgcctggcaatgagcattatgtcaattatgattaggattatacagaattttccctagaagaagctcaaacatttgtactattatctcccttattttccctaaattcctgggatatgaaaaaggcaagtacaattattattattttgagagggaagctgagaccaccaagattctaagtgagctgcccaaagtcacagaaagaggcccaaaggtcttcctgccttcctgtcctcattctccttccaggaaacaatgctcccggagcagagatgcccacaagatacctaattttcccctcaggtatagaaaaattgaggcaagagaatgcaaattcctcagcactaaaaccagtgaaaatttttaatagacattttcaatctgaaggaaaccacctttatttcatacaaaaacacatggaactacctcagacgataaagaaaataccctcatgtttctaaatttgccacatggactcatcacatttccaaacaccttgaaattacttcagataaatgcagtaactctcagagcactttttatacagagaaaaaacacactgttctgtgagagtataaaaaactacctacacacttccacagaaatgactctgcattagcatgttacaaatatcaactccctgcccactatctctggatgtctgctcacttttcagcatgagactagattgttttcagaagaatttcattttgttgggagagcctttccttgctcttcaacttgagggactgtaggtcctccttcttcgcctctgcatctgctgaatttactcaggattcttggaatataacattttaaagtgctcaccatgttcttgcagctttaagccaaatctgtgtctccttccagctccaattagtaaaatattacaaacttttacaggaaaggaattggaaagatcattccaagtagtcagctgtagaacaggaagagaaagagcaataaaaaacaataaaataaaataaaagtgtgtctctgctcttctctagggtcatgctgcctcctcctacaaatataattaatgcatattctccttgtctgctttttctaaaccatatgtcctataaaactggacttactggtacaaggagaagggtaatgtttaatgtgcatgggtgtatctgagatggatagggctgctgagatatgtcttgagggatagctcagtgttggcaaaagtctgaagaattcatctggcaacatctcgattaagcgggaaactcataaattaaagcagctcaggggcaatttaaacttcattacccaggtcggtctggagctctaggatgaatgtaaactacagatgtagccacttccatttcctctaagcaaacatctccctccagttttcccattgctccctgtgctgtcaacagcctactattgagaagagggaaaggtgtgcaagttgggagctattattcgttccacaggacagccacgtttcagtcttctcagataattaggggtagataaattaagcttcacaatcagatttgagtttcttatcaattttctcacatatatagttaactatgagataaaatttgaatttaactccctacgattgtccctctatgtcttttaagtggtagtactagtaagcattgcactaatcaaaacacaatatagaaagaaatggagaagcacaacctaagtctctagcctccagtaaatgtaagccagtggcatccattttcaccagatgaaagttaataatctgggacaagcactcactcggaatcctagagtattgaaaatgcactcatggtagccagctgtgggaattaggcaagatatttacttcttactattgacaatgcaaaacaatgcttagtctacctaaagtcagaatatactttttaaaaagaaagtgtcacatatgaagcctctgaagcattacaagaaatatttatgggaaatttctatatttgttaatgtaattagaaaggtgtctaagtgattcaatccgttctcaattagccctactaatggaagttaatcaatgcaatggatagctgaaaaaggcaaactgtgtaaatatggctaataaattaactctctttattaatggtatatgatgcattgaatcttcttcatatttaactgaaatcgtcatttttggagaagttgaaaatcttagaaaataattttattcaaccttcttacttttcatccgagggaagttaggcttaaaatgtttcaggcaattacagtttgctaagtggaagagttaggccttgtctatgtctgggctgcaataacaggatatcatagattaggtggcttataaacaatagaaatctatttctcacagttctggaggctgggaagcccaagatcaaggtgtcagcagatccggtgtctggtgagggcccacaccgtggctcatagatggctgtgttcgtaccgcattttcacagagtgtaaagggggcaagggagtgctcctggctcttttacaagtcactaagcctattcatgagacccctgccttcatgatctaattaccggtggattaggatttaaacacataaatttctggaggacacacacattcagtctatagcagatcttaatctaaacatcccaaatgacatcatgaagtggagctacgaggactctattcaaaacaagtctgaaaatcaactagttgcttcagtgtcttctcactacaaccccaacctcagttcaaccctcaagcctcattcacttcccaaaataccagaaatgaatacctctgagaacttcctaagtacaatgtcagattgatttaatactccaacttgaatagaacttcatgtcctattatctttccatagcagttgattgacatcttccctgagaaagtaagcaattagcaattttgagctaaagaaaacattactgaaaatgttgctagcgtagaataagcaaaaaacttttagatcaataatgcctgtggaacaacataaaatgtgaacactatctagaaaaagagttacatgtattatcacagatatataagattcatagagaatttgtatcctagacctatgagaatttatctgattcctgaagaatcccaaaggagattccatggcttttcacaacattcccaggtagcccagtttaatgtttacctctcttaccgctgacataaaacacctatttaaaacctgcctactgcagcttaataggcatcctgtttattctaattttgccaaaacgaggtcagtgaagatttaaacaggggatacagtgcctcttaagtgtcacccagtatagctgagtgacacttcagaggcaaagtctaccttgtcttaattgcagtcacaaccctgaaacatctacaaaaacatattctaacaaaaagttaaaatgattggagagttagataaatccttaagatgtttgtgaaagaaaactctgcttgaatagagggccttatattccacaatgaaacatcctcacaaaggcagctaagaaatgagcccacttgtaacagcacaaccaggagccaggataattatgatggaaacactttatttcaaatcatgaaaagagttacacttgatcttcttgttagcaggggctgtgcagacagcaacatttactgtgaaatgtaaaggcagataacagctgatttgaaaggggattgtgtaaatctagttaaagagcaactttagaagattattttcaattactaagataacatcatggctctcagaaaaaaaaaacggaaaggtttgttctttacaccacatacagtgtacaaaatctaacaaaaacgcctgctttcaagcaataatatcagctaagagctaatatgccttaccttcactttatcctccttcttcaagttgttttcaattatttctaacatttcctcatgtctgtgaacaaaaaagttacttttcaatcagaagaaacagcttaaaaaacactgtctccttcaaaataattactaaagcttttacatttgcaagtgccaaatatacataatctgtgagccctctaaactagggctaaggtcatgaggtaagagtgcttgcaacttggggttgattaaaatgacatttgcttcacgggcagaacacttaaatgagaatgtctgggccttagcccccactcacgtcaccttaactgatccataggaacacgccctgacctgtacatggaccaaatgcaagctacacctctagcttaaatggataaccttgtcaagtgaaactcctagttgtcatattcctcaacatggcatatatagagggtgctaatgatgtatttagggagaaaaaaactaaataacaaagaacctagtctaaaggaaaaacatcaaactgggaagcagaaaaccctgtactttcccaactctgtcatttacaaccgacgtgacctttccaagcctcatcttcctgtactctccacatgttctcaacatcccacccacttaatactatgctccctggacatactgtgttcttctgtgtctctgctttgaatgacctccacctggagagccccttggagcctagcttagttcccttgtctatgaaaggcaccccaactcccttgtcagaattaatctgacaccctgctgtgcacccctctaatgcttggtaattatttgcttcctaatgctgatcacacactgttagttatctatagctatccattcctcgagtagcttaagtgctcctccagggcagggacatgtcatctttgtatattcagagctgcagtaacattaggaagcactcagtaaacacttacgaaataaacaatgaatcaatgaaggaatgaatgacaaactgacttcaccaactttcaatttcatcacctttataactcggaaaataatcattacccagttcgttcagaaatcatagtgatccaaagatgcaatgatgcttttcacatcgttaggtaatgattataataaagatagtaatgttaaaaagtcataacatacaaatagagtatgatgtcttcacatacagtctgcctatactcaatttcagtatctttcttctcataaaaagaaatttaaattttagcaaaaggagagacttcattgtccaaaaagtgttcttatgacactaaaactaaatctctaaaagacaaaagaatcattagtcattttatatgtgcttctccttccattgattagctgcatttttccgcttggacatgtggctagacacagattctactctgtgatatgcactggacactgcatattccactcccgtgttgccacctcaaaacattctaaaagcaaaattgcatttatctggaaaaacaggtccctgatgcactaaaggactgaggcaaccctttgaagaaagggactgagggatcctgaaggtgcacaggagcagtgataatggtctcatatttcaactgtaggtaactgcggactgtatgttaaacattttcctctaaagacctacgttctttctaaccaaaacactttcttgtcacagagagagaaagaattatcttatttgattaaggctactgctgtaacaataaatcccaacacagttcattcacttgaggaagcatagtatcctagccacgcactcaagccaaagcaccacaatcgtcccagcctccgggacaatggggtagcacactgctatagctcaactgtagaaaggtaaactttggagcactgaagtctaaaaatgtattcagggaacggttatgagcttgtatttcatgattattttaaggtgacaaataattaaaattatattcaagtcccaatgttcccattgctcagaagagtaaaatagacttggtttctaaatttgtagacacagacaaggtcaagctacggacagtcaaaaaccatccaaaaaaattaaactaatttcatcatggaacagaagaatgggaattgagaattctcactaaaaagatgaaaaggatatcccagctgcaagttatcataagctagttggcccatcatctgcccggctgcagctgtatccaactctcagctcacccaaagagattcacgctctcatggtgccaaaatgaatgtctctcttaaaaaaaaaaaaattgcccaattgaaaataactctctaatctgcatcctttcaatagaactgaagtgcacttcaccaacacagagcacaggcatcttgaattagcagagaactatttttaacacatgaaggatacgatatgaaattagtttcacggggaatgagaaccttggagattatttactttgccttaattactctgactcaccattaatttagctttcctagggcactaaatatttcacgctaagattttcagtataaagagacaggagcaaaaatttggagcactggaagtttgcagtggcatcttcaacaatgaaacacagatgtccccattgggcactgaaggccattcaagtatgcactgttcaatgacatttttagttactgtttctgtgttgtttttaaccttgggatcagaacctgtgccctgaagtatgcagggagccaaactttatgcagcttctgttttactcctcagccaacaatatcaccagtgttcacagctactcccagcaactgccaaatagggcaggcagcaattgcctcacgccaaggagggaaaagtttagactgtgctttaaaaggaagtttctaacaatcagtgcaattgggcaatgaagtcaattcccaataaaggtgactaaggagacagtacagcagatatgctgtaatgggttcattagagcatcagtgggaaataatgcactcagcttccaccaaagcacttacagtgagcagggtctgtcatacacagctgggcacttgccaaagccctctactctcccccatggctcttaatcagttgtccactggcagacaccacaaacatgggcagtgcatagcagccggcaggagcctgaggggagcaatacactggatgccagatgcaataccagactcactaggaccactcaatctgtcagtgccctccagctccacctggcactcagcaattagagatgaggaggagggagagagactaagagagtcgggggggagcggaggggggcttcttttagtggatgcccacaaagaactgttccatattctaaatgtcaaatgaactggttctgtattacataactccattccagtgagcttaagccatatttttccccactaagtactctacaacctaacattttccttcttacatacatacatttttactctgataaagttgtgctttcatttatgttgtgcttttcctcctttttgattactgtttaattgttctatatccttctagcattctgaacccaaaaaaccatagcagacaagttcagacatctccaaatcttcaccaatcaaattttctgtaatgaacatatgcttccatagtaaacatttctaggctgagtgtgttggctcatgtctataatcccagcattttgagaggctgagtcaggaggatcacttgaggccaggagtttaagaccagcctgggcaacatagtgagatcctgtctctgcaacaaaacacaacaaaacaaaacaaattttaaaactacccaggcatggtggcacatgccttgcagtcttagctacttgggtagctgagatggagatcacttgagcccaggagttcgaggttacagtgagctatgatcatgccactgcactccagactgggcaacaaagcaagatactgtctcttaaaacataaataaatatttaatttgacaataataagtactaacatttctttagcatatttacagctttaaaacatacatacaccatattactttatctcatctatttttaccacttggcctctttccatgtttctcatgctcatgaatactcccaactagcagtcacttttcacaagtaagcctgttcactttgtcattgtcaatccgatttcctcgttgtctgcctaggtcacaaaccttacttgggccatttacactttcagtcacttatcatttacaattattaggtgaatctctccaatgccatatctcaatttcaatacttaacactgtgttgcttattttctagtatcagtgaaaataaaataaacaaattgctattagttaatttctatttgaggagagaagaagcaacatggtgaacaatgtggtaaaggaaggtgttcagaactcttgctgcttctatttaccagctatcacagtgggcaagttgcttaatctatgttttggcttcctcttattgtcattagaaaggctgccatgaggattgaataggatgacatatgcaactgtgcctgaagatactcaaaagacattacccataacactgaatcttctgctaggtttctaaatgccctctccttcacattaataaaggctactatagcgaatagcacccctctgccactgggtccccacaagtgtgccaccctaatgagcttccccattcacttcctcaaaaggatgaccaaggcacactaagtgttgccacccagaaatcactgatttctaagttaatttttttttttactaaattcaactgcaagaatttcagaaaaactacagttgagagcagagagtaagtgcatagatggccattagctccaagcactttcaattatgcttcactggtctttacatcctatactggaatggagaaggagatagtaacagactgactgcagagcaagcatgtattgacagcaagatacaggtggccactcaggggctcccaaatagtctatctctaggccatcacccaccaagcactaggcttatggctggtagaatacattcctctccatccctttctctttgccttcctcgtgaaacacttaaaaaccacaggagctttgattaacctcaaatgatgtcagttccaatttgtcatgctcagagaaattgtgacacctgaaattctgctttaattctgaagcctccacttaaaggttcagagacttaaaaacaaaagctcacaacaggcagttgagggatatcaacgcctaactggcaatagtgtagtttcatggcttagatggcttatgtaaaatgcaaaaggagcgtatcttttgatccagcaatttctctaataagaatttacccaaatgagataattgcccaagtgtagaatggtatacatgcaagtatgcttagagcagcaatgaattttagaatgaaaaattggaaacaaatgtctatcagtaaatctagagtaaactctaacaaacaccattagctgcctagtcagtgaggcatttccgcttcttctttaacaaaactcttagtttccaattcatgaagtttggacgaagttagcatatgcttctacccagatctgagacaatgagaaaatggcattccccctggtcacatgacctacaatggtgtaagtagaaggagtaaaagaagagaagctctttttctctggaaagttaatgtgctcctagagatgcagaaattttgctaccattaggagcatgaaaaagagtaagaaatagacaattataaagaaagaaatcctatatcctgattaaatcatgcctgaatcccctacccactggatttttcagtatgttctatttatgctagtttgccctgggaaatgtattacaatgaaaggcatccaataaaagtattcaagtcattaaaaattttatttattgacatggagagaggcccattacatgttattatgagttattatgaaaaaatggattatataatagtacatacaacaaaaatctcatttatttactttatctgcatatagtatacgtatgtgtacacacacacacacacacacacacacacacacacacagactcaagagatatgcctggatatatcaacaatggttatctctagtaggaattctgagtaattttactttctttttgtattcttctacagtgtttacccgggtgcaacaacagcatttttgtgggagaaaaataagcttctaaaaactagctatttactgattctgtctgtctctagtgtgaaataaatggatggctttgcttcatatccctctccaaacttgtgttccaggagaaaaaaaaaatcaagaaaactagccaggcactcaaattattatttcattataaaattccatgatgaagcaatgaaacccctttcagatctgaatttatacatgctgaaaaagaaacacagccagcggtacctaagtgtctttccagaagagtggaaataacattaatcaaaatgaaacatcctacagaagctgaacacttcttatcccaaaaagagagaatccaaggcgggagggcagaggcatagacagagcaatgacacagctgcctccagaaagagcaggaacctttgaggccacgtaaaagctgcaaaggggttctcagcactatcatattagacagatggtacctccctgactgtcgctaggtatccacatctttttttgtgtgggataaacccccgaggacctaacccacccatcagtaaaggagccttattctagtcactccaggctctccaaaggtaataatttcaaggaaattagaagactagatgttctctgtgacctctttcagttctacaattataacttaattaattaagtacattatatacattttgtgaagagagattctttgaaagacttttgaaaaacatgggttagagacatctgagtgctgtagattcaggctggaagtgacaggtctaagaggtaacagtgggtttagaaatatctaccaaaggcaaacagaagtcaaagataaaaatctctatttgtttactggtgattttttaccagagtttgtagaatcttcccaaaaagttctcaaaaactctggcttctaaaatcagttcattggtgtgatatctcttttttttttctttgagatggagtctcgctctgtcgcccaggttggagtgcagtggcgccatcttggctcactgcaagctccaccttccgggttcacgccattctcctacctcagcctcccgagtagctgggaatacaggcgcgtctgccaccacgcccggctaattttttttttttttttttttttttgtatttttagtagagatggggtttcaccgtgttagccaggatggtctcaatctcctgacctcatgatccgcccgcctgggcctcccaaagtgctgggattacagcattggtgtgatatctctttaaagtaaaaggaatcttataaagtaactgcaaagatagtaggataatttccatcagttccaaagttaatttctagcagttatttgttgcttttacaataaattactacactacttacatggtatttcatgatactggcattattcacagtcagacactattttgttctgagaaagtcacggtactcaaagaagataatctaaaataaacaccaagtatcaaattgtctatactacatgttggctttgggatcaagttaaagatgcttccccaaaaagcattcctcccactcaaaattacaagcatgcactaggttatccatttgtctattctgtgtctgattgtaattccctcccacctagatggactgttggcagccttcaatcctacagagcataaaaatgggaaagaagatcccagcactttgggaggccaaggcaggtggatcacctgaggtcaggagtttgagaccagcctggccaacatggtgaaaccctgtctctactaaaatacaaagaattagcttggcgtggtggtacacacctgtaatcccagctactcgggaggctgaggcaagagaatcacatgaacccagaaggcagaggttgcagtgagctgagactgtgctaccgcaccccagcctgggcgacagagcaagactctgtctttaaaaaaaaaaaaaaaaaaaaaagaaggaaagagaagagaagacaatactgagtggttctcaaacttcagttccaacaagaatcctttatggactatcttcagcgttctgcatcagtagcttgagatgggctgctagctataattttaaaaacaacctagatagatctgaatagtgtatggatcaccctttgtgaaacaatgatgtagatcattacaagaggattttgtcccccttacagataatcaaacctgatcctatgactctatcctggatgattctactcttctctacatttatggtcactattcttgtcccttgtccaggaacccaccaccatctattcctgcacttgaaaataatttccaaattagttctcttgtttctagtcttgccctctccaatctctcctccagaaacctgccagaagggttttatgtattacaaatcagaccacatcacttcccttaaaacccttcaatgactgcttaaggagtataggatttccttttggtggctgcacaatattgtgaatatactaaatgccactgaattgttcactttaaaatggttcattttgtgtcatgtgaatttcacctcattttttttacatggcagacaaaagcaaaagcaaaaacacttcagtggctctccactgcacataggagaaaatccaaagtccccagcatggtttactaggtccagcataattgggtcctaacctccacctcagcagccttgttcctgccactgttcaccctttctctctatactctccagccacactggcctccttctggtttctaaaagccaagctttcacacatctggacttcatacttgggactctcacctggataaccccaaccacccttcaggtatgaatttataaattactcttccatataagcctcctctgtcacttcaccctcattatgccctttcagagaaacccagttttttcaaagtacttatcataagatccaattacataattactgttctgtttatctgtttgatgtattttccagtaaactgtagactcccaagacaggaatgctgcttattttgttcaccactatgttcccagcatctcatgtgaacttggcacaacaaatacctattcattaggcacgcacaatgaatatctagcatgcttttctccaaaaacattaaatctctacaaaatgattaaaggcctataatcgcaatatgatatgaaaaataaaatgttagttattctaaaattcataataactagatgaggaaactcagaaacttcttagaatcagctcaatatagagtacatccaccaagcacagaaaacagcttctctaacttctacagcacctactttgtgatgcttgatagaatcaagtctctaatgcccaagaaaattccacttaaaaactctctcttcatgccacagcacattactaagtaataaggaaagaaacattgtgtacatctctgcagaaagatacaactgaaatggatcaaagactagaattcagaaggatgtcaggagaaactgttagctactttcacataggcatgactttcttgaaaaagggtgtatagagtactaccagaaaataagggctctggacttagtcggttctgagagataaagaaaacggaaaatggagaagaaactcacataaaggcaggcataattggtgttttgttactaaacaaactgctcttcagtgattataggtgtgcacgtgattgattttttccaatcttgcacttgtattaactagaaccctaatttgtccatgaggctgaagtgtgtcttaattacttgccttcaaagcttatgcccatttaaaataagctgatttcttttccattgtcagttcactcagagccacctaatccacaatcctcccgcccagcactcaccacttctgatcattatggagagcagaggcaagggatggccttacagacaggttccaaaaagatccacctattcataactgtgtgcaccagcccacaacacatcccccagccctgctctcactgcaagggcaacaaaacatcaaaacctgaacacatttaccatccatgccacaagccacaagcaatctttcttttcttttttctttttttttgagatggagtttcgctcttggcacccagactggagtgcaatggcgtgatctcggctccctgcaacctctgctccacaggttcaagcaatctcctgttcagcctccaaagtacctgggactacaggtgcctgccatcatgcccagctaatttttgtatttttagtagagacggggtttcactatgttggccaggcttgtcttaaactcctgacctcaagtgatccgccaacctcggcctcccaaagtgctaggattacaggcctgagccaccgtgcccaaccttttttctttttttagagacaaagcctcccatgatctttcacccaggctggagtataatggcatgatcatagcacactataatctcaaactcctctgtgttcaagcaatcctcccacctcagcctcctgagtagcttatgactacaggtgtgcatccctaatatttttattttttgtagagacagggtctcactttgttgcccaggctgctctcgaactcttagtctcaagtgaccctcccaccttggtctcaccaagtgctggaattacaggtgtgagtcacctcacctagcccaaaggtgatttttcagtacttgagttttcttctgctaaagctttgagttttcccaggcctcaggtcagtagacctggtggtgatctgcatggctactaattttaagattattcccatgtgtgctacaatgcctaaactgctcctggcatctgaggatggagtgcccacgattgggtggttgatgtgcccttttgaacatcttagagatagcgctaaagcttgttcttaattgaggctccagcttcctgctctctctgcttgacttggggcccccggagaaagaatgaagctgctaggggggcctacacggttgcaaccaataaaacctctttccaacagagacagggagcctgaagagtcaccacaatgccccactgccacccctaaggaattcaagttgctcttttgtgcctccttccttaaggcagtgtgtgtgaccactatggtggcccccagctttgctccattgacagaccttcttaatttgccttgtttgaagatgctacttgaggcctgttttttcttaaccaagcattcttattaatgttcttgacattgtttttatgatataaccacatatacttccggaggcaataaggtggaggaggctgataatactataaaaagtattttcatgcagtaaagtgccagccaaaccaaaccctatggagcagaggtatgaactgaaagccaacatacatttaggagtgaatcataagaccaatatgttagtatgttaatggtataatacataagagatgagtaagaactgctggtagaaaataagatagggagtgttagcaaatgagggtttgaaggacagaataacaaagacattggagggagattgccaagttgacaaacatgtatgaaaaagaggtgcttggaaaccacagtcgaggagggaatgaagaatcagcaaagggacagagattcctagtggcaggggtgaagttataaatgcaggtaacgtctaccccacctggaactagtaagatttttttggagtggaagaagctacaatgtcagaagacaaaaaatctcaccagatttataacattcccatgctttgaggaactggggaatgtctaattaggaaaacagaaataccttcaagattttccactgaggaaattaaatgcagagaattgactactcaggtgatggaggtgcagacagcctaccaccagatagtgaggtaatctagagattagcatgaacaggaagcactacctcccctggactatagcaggaagtagtattgctggaatctgtgggacaaagtcactagtaagcagctagaaccagagaaggtctgttgagcacaagctgtgctacagacgtgaattcccattgccagggatgctacccacagctagggaaaaaaaaaaaaaatcctgcatcacccttttccctgcggtctcccaccagtgcctcccaagggtaaaacacagcaagccagctgactcagaaatctgagaaagcagcctgcaggggtgagcccttcatatacagagaggaggaaggaagagcaaggaatgctgtacccaacaccagagaggaggatagaaatgctggtgaaaggaagaggagttccagtgagcttgaataagaagctccttttacaataggcatactttaaaaaggttcgcttgttgccatacaatggtcaccaggggataaataaactagaagttctaccttctggaatagctgactgaccttcctgccacattcaagcggcccctgatgctgctatgcagaatccacattggaaggggttggggaatttattctctgttacgctttcttcagttacaattaagtcaggactagtccaaacacgtgaaaaaaattcttaagaaaaattctacactaaaaaaggctgacttttaaaatgagaaatataatagtccataaaagtaaatacatatgtgcgcacacacgtacacacacatagttgtacaagtaaaactgaggaaatctgaataagattgatggattgtatcaatatcaatatcctgctaataaaactgtacactatagttttataagatgttatctttgtgcaaagatatcacaggatctctctgtattatttcttttttttttttttctgagacggagtctcactctgttgcccaggctggagtgcaatggcatgatctcgactcactgcaacctccacctcccgggttcaagtgattctcttgcctcagccccccaggtagctgggattacaggcgcccaccactatgcctggctaattttttttttttgtatttttagtagagacggggtttcaccacgttggtctggctggtctcgaactcctgacctcaagtgatccacccccttggcctcccaaagtctgtattatttctcaaaattgcatgtgaatctacaattatcccgaaataaaatgtttaataaaaaatagcataagtatgtacataatatccacaattaacaaggcttcttcttttctactgtgtatccggggccccttacactcacatgctcagtatttctactgtcagcactcttttgttctcgctgataagcaaagcccagtaagctctttgctgacccactccaccacttcttataatttggtcttttctttgtcattgactcaaaactacttttgcaaaaatatggggatgatgttgggttactattgtttgattattcagcctttgcatttctaactatagagagagccagaatattagtattcctacatgggacaattagaagcctgccttatcttatttcatatcttctaacaagcttcaacctcttcatttcataattaagcattcaattcaaaacagctctctttacagatttatgttttctttctctcactctctttacccctttatcccctttgggagctagtggcctaagaactggcaggaaaaattgcagtcaaaagcttggcattatgacagaacaagaggaaaaaaagcaaccccacccccagctaccactcattcacttagctaaaatataggctatcaaagcatcagggaaaacaacagatacaaatgcacagagtcatactaggtcttccagaaactgatggtggatgaaaatcacctcttcgccaagagcaaggggggaaaaatcactattcatcacaaaatgatgcaccacagatctctcttcagctctccttctctacaactccacaaatccttcccgtaaaatataactttcttcctttaatgatctgatagtgaattattcatactcttcaatttatctttccttcttttatttatgctcagacatgtactacttgactgtaaaaagcctaagattatagattataggcaagacagaggattcccagccctttcaggggtgccaagtccaatgggcagggcagggcagggcaacaggacgaggtggagggctaacactcatctggggaatggcaggtaagtgaccacatggcacaggcctctatgtcatgctgactgttttagagaatccatctcaaatcctttccgtacctccatccccacagttataccttagcttaggtactcatgattgtctgagcagtgccacttcctagctggtctccatgtccccaactcctcctccatcaatccatttcccacacatctgccagaatcatctttctaagctgcaaatctaaggagcaatgccctcatcagtaggtctctatcacctgaggccaggtctcccaaacttgcctcgttatttaaaaaaaaaaaaaaaaaaaaagcagattcttccatatcttacgttgaagaagccaaccttgtgacagaatttaagtacaagttatttatttggggaggggatcctaggaagtactggtagaggaatggagaagggagacagccacttttaaagcacaggttgtctagctggctatgactgtgggtaactgaggatgctagcatgttacccaactctctcatgtcactggctgaggtctattcctgaggccattaactgtgctgcactactaagcttccccacacacgggagagaaaccccaggtggggaataggaggtacttgcagaattgcatcctgaagcagggagtgtcagggcatgagtagcaaactgactatgtctgctgcaccaggccacatccctgaagatgtccattcagtgggtcttgggtgggatctggaaatcagtattgtgacaaacacatcatgggattcctatgaacagacagatttgaaaaacactgacaacattattaagtccaaaatctttggtggactctaccaggtcctccatggtctgtgtcttctgccctgctctccataccaacctccatgcacagtccacttgccagaacacattgaatctgtgcacttccctgcaagcagcatgttctcttccatgagcagcaactgtgccttaggaatctgcatgaggccgggcgtggtggctcacacctgtaatcccagcattttgggaggccaaggcgggcagatcacgaagtcaggagatcgagaccatcctggccaacacagtgaaaccccatctctactaaaaagcaaatacaaaaaattagctgggcatggtggcgagcacctgtagtcccagctactcgggagactgaggcaggagaatggcgtgaacccgggaggcagagcttgcagtgagccgagatggtgccactgcactccagcctgggcgacagagcgagactctgtctcaaaaaaaaaaagaaaaaaaaaaaatctgtatgatccccaaagccaaatacagtaccatttatatggtaaatgcccaacaaatgtttattaaagaaataatccccaaagaaatacatagtatgatattatttaagtggtattgaaaggttccctggacaaaaaaaaaaaatcttccctatgtattaaaatagtaggtacaattccactattaaaactaagcaaatacatattgagcacctaatatatgcaagacactcaggaatccctccagaaaagaactttaaccttttatcagcttttacactttgacaaagatgtgctgatacacagatgtgaataaaaccctacaaaggagataaacacctgggcagtggtagaaaggtaaagggcactcactgtaaaaggaactggaggtatgaaagactacctatcctgtgattctgtcagggttgtcttcagggacactacctcctccctcacaaagattcaacaggataaagaagaaagttttatttcaatggcacaaacacctggaattatgacttcttccagtgactagaaatgtggtacttgggatccagatggtaactctgggctctatcccttacatccacaatggcttctggggcttttgagatgctcaaggtactctcttgcaaatgagaccagagcaaaggctttggctactgaagtcattacagacctcacctgtggcttttctcccactgttagagatgttaacacagcaccttggtcacattccagtctggataattacattggggccagcaaactttaccctccagcaccaactaaacaaagtattcctttggacttgctgccataacctttgttatgctgctgtgggctattaaagggctattccatacttaggatggctgtatttgtggaaaataaatagccctggcattactttctatactgacaaatatattccaaaatatcattggctaagttggctattttggcttaaaatatgcagtgccagaaacaattagaaattacagtaatttcttctccattctctaaacttttactatccacacaaatgaagcttgaaatacttgcagcattacacaaagagggagagatgatgcattaattccacaaaatatatacttagtgtctgccatatgccaggctatatgtcgtaggtaccgggcactgttctcagtgctgggggttatgttgacagtgtaaatatgaaaattttccagagggagtaattcaaatgaattcttcctatgctgctacatttctaaaaatctgaatacattatttttacttgaaaaactaccatacacagttctcccaatcaaatactacttttgtccactattttttttttttagatggagtttcgcccttgttgcccaggctggagtgcaatggcgcaatcttggctcactgcaacctctgcctcccgggttcaagcgattctcctgcctcagccccccgagtagctgggattacaggcatgcaccaccatcccggctaattttgtatttttgtagagacggggtttctccatgttggtcaggctggtcttgaactcccgacatcaggtgaactgcccgcctcgacctctcaaagtgctgggattacaggcgtgagccaccgcgcccggccttgtccactatttaaataagagtctgtaggaccttaaactctatgtgtatgtggaagtatatgtgtacctaagagtgagaaaatatgccttcctggctatcctggagggtggcaaacagaatgctgcttatatatttatttgtttgcttatttttagcaatcatcccatttgggtgggtaagagtttacaggttataatagcagaagctgacataagaaaattgaaaacataaatatctcttgtttaaagctctttagtgtatgaaagaaacacaaatcaggccctctgatattctatcataggaatgaaaagtgacaaaaagaaaaaaatgtaagtattgtgtgtgtttgcacatacacacaaattatcttgcacatgaaaataggagagggaagttaattaaatctcaagattccagttggttaaattaaatgtatgaactaaagaatatttaacatcacactatgcaagtggatgcagaaatagttcagaaaattttaagaaacataacctttaaattcagattaatcctagtggatctgaaacaagtacttctcctagacaaattatatccagacagtggaaaatagattttttttaaagtgaagttcacttgaaatatgccaaattattattcttttggaaaatccttctagctagaataagttaatagcaggcttctaaaactaggtttaacatgctgtaaatccatttattcccctctacaaatctactaaagtacgtcttttctggtgaaaaggcctctttaatggtacttaatactgtcactacattgtttctccaatcagtcaatgtcaaggttttctacttaaggagttatattaaagttaaatgcttacttttgtcataaataataaacaatggaatacagattatttaaaatagcacacggaacctcaaaatgtattacacacaatatatatttcctaagtttagaagaaatgactaataatgcatatatgatccaagttttccatcctataatccattcattatcattttagcattaagaaacaatctgcactatcacctctctcagagatagatgactcatcttccactaacaggcattaggtaacacctttggcaagatggctttgataaaagactgaaacaaatattatgcagggacacaggcaccccacaaaccttaaagagcccagatcactacaccaacagtatgtccattgctttgtaggataggagattgtaatgagtgattgattaattagctataatgtacaggtatacaaactgaccaatacaatcttgagtctcattcctgttgaaaattcacacagaataagagattattaaagactgcccaaagctatagacaactaccaaagcaagggactgggcttcccagtttagggaaaggcaggaatcataggacttttagagattgaaggcacaatatattatacacaatgcatctaagaccacaatctagcctagcatgtcaatgttgattttttactctcaaatgctaatgtattttctaagtacaatattagaaattacattataaggtttttattaagataaaaatcttggttgcaaatgttatgtaaataaaaaacaaagaaagaataatcaaggagagaaatgagggggaaatggtcaagtgtgacccaggggaagacatcctgagactgggtctgtcaccagggttgtgtcacataatctcactatgcctcagtgttccttaatattaaagggtcaggctagagcctcagtctctacttcattcctagcaggaaaatcctgccatctatttaggtattatagaaaactcagctttttgtaatatcctaagagcacctggcagcagcagaaaatttgcttacgatgtttaatgagtgaaaagggaagaatgagaagggtctaaacaatcctcccaatcttgcatttttcagtttatactaggcttaagagggcaattgaagttagatgcttcatttcatcccacaataattcttattataataaaacatttaatattccttaaaaaacatccaaaaaaaaagaaacagcttcaccttactcaaatgaaacttagtggatctgtctcatttggagggttgcaatgcctgagctacagtgtgagtatcaggatgtggaagcagctgtcactgctttgtttttcattcacagtaggtggttgccaggcaacaaaatactattgtctgtttccatgatctattggccaattctactggtgataatgctttctacagtttaaaacagggccaccttttggacaaaaagaaatgagaaaaaattctaaggatgacaataacatatatacgaataaatacactgaatgtaccctaaaattacgtgtataaatatacaactgtgtgctgatagacatacaaatattttgcatgtatgcatatgtgattatatacattctcctacatacaaacccatctaaatttaataggcccacaacttgaaactaaatcccttagggaaatcaaggtatgaactagagaaataaaaacacagaattattttcttaacaatagcaataatttccaatttgtcacatatatcaaatcctgtttcttgaataggaggtcctccagtcagaaaagcaatcctgtctacttatataaaaatgataataatggaaagcctttaccatctactttagaatcatgtaatacgtttaatatgttgatttactatcatatgctaccaatgtgtacaaagataattcaaagagtgttgctgtttacaaccaagaatcttaaattttattcatcttaaaaataattgaattgttctccatggaatagcctcatgtgattccccactttgttttgatatgggtccctggggaacaacagtcatgctatgttactcttgcatatttcactagcttacaaataaaataacacacagtgtactcaatataaagttgtcaacattaacttgcatcagttgctgtttgtttcacattgacaaggcttctaaagataagaattacaatattcttagatgtacagacacaacatcaaaacagcctgaaggaattaaagctggaaaatgctagaggcaatcacgctttgaaatgaagagaaatcagtatcatttatacgtacacatatatttcttcaaaggctctaaataatgccagaacaatatgcattttatgcaatgctcatccgtcttccctcacaatattccgaaagcactttaactgtttaacgcatctcctccaagagggctttcactttttcaaactcattatcactttcaaatctgtatattacaagaaactggaatgagcaatatccattacatgaatagacattattaatataaagtctctatcaaagtggcaacgctagtaaaacaaaagcagagtgtgttaaccataaactaagtaccagccaatattaccactttgcttgacagagccgtctccaacagcacgcacccacctctcgagcgggcccaccagctcagctttccaagctcgctcacctgcgtctctcctccaggaatcaatttccttcccactttctccaccctcttcagatcccttaagcacgcttcattgctttctccaaactaccagactcaaatctgcagcccagttggccaggaacctttccatacgcacgtatttcctgcattctcctgggtctgcttttaaaaattgctaccaccaaacaaatgcaatcttaacaaaattgggattacaaagccagtttttttcatgtaatgttacagcagtgaaagattgagggagagaaaaggagagaagcaggagtgtatctgggtgaagaagcgtggctcagtggctatacagtgagacgcagagattccacagagctgggcttgcccacctgtcgaccccactttccccatgtgctcgccgcgggatgacaaccacaacactccagaaccaccccccttccgaaagagggcggggttacgccttcagccaatcaggacccgcgagccccgggtgtccaacctatggggtggctgtggccgtgcagggggaggacgtggggtggtctgggaggggccgcgtccgtgggaggctcgcacgtgtcgggtccggagaggcggggaggcggccggcgtccagcggccgaggcgcgggctctgcaccctggcagcggccgagtccggctgccccagtgcctcctttacctcgcgttgggccaggcagggcgcgctcccgccgacgaagacctgtccaaggtgtccgagctccccgcgagaggggacagtcacgaataacaacagtacccagcgcagactaggcggggaggaaagtttccggcccgcagcagagcggagtccgccaaggctggaggaaaagggatgcagagcgggagggtgaaaacctgaaagaagagggcagcgggaacactgtgtgggcaggaacgggtcccgggggcgacgcccgcagggggagacgggtgcggggtgcgctgtccaaggtgcaggggaggtgactggcgcgcggcgggcgcggagcccggagctgacactggctggcgggcggaggggagagcggggaacagctgtctggggcgctgggcacccccgggcgcgtaaaagtgagggagcttgagacggggcacggcggggaagggcgtgggggctgcaccgaagcccccacgcgtccacgcacccctcctcaccagcctcacctctagctccactcccctcccccctcgcccactcccctctcagtctagatccaggtgccgtggcgggggtgagaccagaggaccccggctcggagcccggacgccccagggaggctgcgggccccggagctgcttacctggggccgccgtatggggagcggaggcaacccgctgcgcggagtggggcgccgggcgcggcgcggctcctcctagcctcggcgtcctcctcctcctttgcttctcccggactctgtcccgggcacggagctgggagacgcggccgggctgcagtcgccgttccctctgctgccgccgccgctgcagcagacagaggacgccccgtggcggctggaagcctgtgtgagtagcggcgcccgggagagcggggatctgctgaggggcgctggagactccgcggctggaggcgcgcgggcgtgcgcacgcgcgcctgcgagt

SEQ ID NO: 1650 - DNA, 130106 bp, Homo sapiens
acagtgtggcttggtgccaaccatggcgagggtggagagccccgtgcctgcagcgcgcgcttccctcactgggtcctgcgtccttgggcaggcgatgcccctgcggggaggggctggtccatccccggccagccacggacccacgcatggacccagcgacccacggacctgcttacctgggcgcggcgcgggtggcatgcggccacacggaaggggcgcgctgggctgctgcggcctctgcagcttctacacctgccacggggcggccggaggtaaagggaggcggcggccaggcgcggccccgcggaggcagctgcactcgctcggtccactcgcggcttcgcggctgcccgcaaaccaggagggcgtggagacccggaaccggggggaagggcgggggcacttgtgcggcacccgcggggctcccaggggacctcggcggtgacacgaatttctaggtgaccttggcggtgacacgaatttctaggtgacctgtgtgatacactaggtgacctagtgacacaggtgacacttccaggtgaccgcggcggtgacccgcggggctcccaggtgacctcgttggtgagccccggggctccccgacgaccgcggcggtgacacgcggggctcccaggtgaccccggcggtgcactcacaggactcccaggtgacccgcggtggtgacacaccggggcgggcgcgcgccgcttccgcttccgccgagccgccccccgccccccgcggcgcagcgcgcgcccccctcccggtggcgcggaaccaatcctgggcagggaggcggcggctggaggctgaaagcgctgccgtggccccctccccgcctccgccgcgccccctccgcactcgcacggccccacccgcaggcgccccccgtgcggaggaagcggatctgccaggatcatttttgttgtgtcggaggatgaggttttggctgaggactgaagagatggccttggaagaaatggtgcagagattaaatgcggtttccaagcacacgggtaggaggagctgctggccgtcagtgatctgtgcttaagcttgacatcatgggctgaaatgtggggaaatgcgtctgatttttgtaagccgccctcgtgttcctttctagccgtggtagctgtgacatggggggcactggttggcagctggtgtgttttcagaggctgtcggcgatcgtatgctgcccgggatagtcaaaatgactgcacgttggtgacactggctctctcagggttgctgggtctgcatgcggagccatttgtgtgtctgaagtctgcccatcaacctgcctgtccgcagccctcgcaatggagaatgcattgcgaatggagaatgatctgagccaagggctttcagagcttggggtttcagagccaggggtagggatggtgaagctacctggaagctcgttttgaggatgaaaaaacctggactaatcaggtggttcttttcttcattaaatgcaatttaaacctaagacagatgtttgagacggtatgggtaaagagtggactggacgttcattttcagtattaatcgaaatattacttcaaataagctttgaagagtagttcagatcgattcttttaggtgtaagcagagactgggctgacagcttgcatctggccgtggctttcaggcggtcgcatctgagttctcaggctgtgttatgcagaagggagaggcatccttaactcgttttccttgaaatgaagaggaaataatgatatatcattaaaagtaagttgccaagtgttttgcctgatgttgccatatgttatgtcatatatgccattactagttgtctaactagtacttgcctgggagattaaaatgtcagttgcttggtttgggtgtggttctctttctctgcccaccccgatggattctgagagtgaaccagtgattaaatcagcataagcaccatcgtatgggatggtctaatcaagatgtttttaatgggggcttttatgatcaaagctgctgggtttattgtatgtgggtcgaaagaaaacaaaaccattttcatgccgtctgctccctgattcttagagaatcagctctttttctgaagcttgagtggagcttttccgtgcagggtttgcagggtttgagtatggtgaagggctgcgtggatgccaggttcacagggaggcttccgatcggctgtgggggtggaggagaaagccccccttgctctgcatgcctctgcgtgccgttcggtgtcagagtcacagagtgggaaccgctccagaggctgatgtcattccccaggtttttagggattggggtttcttcatgagctccaagagacatgtgcgcatttttaattggaaaaaggctatctcagaagagcagcagtgacactgtctgctcactgaatgtcgtgcgagccgggcgctcggtgtgggccatcgtctcatctggaacaggcagtgagatgtgcgtcctcccacacatctgcattaccgataattgcatgcttcaccaggactttcaagtccagcttaccagatatcctcggttatgagcaccctgtagcgtttagttaggggaggtgaccctgcatcatactccacttaccacccattaacactggcctcttccttcagcacaaacccattttctgctcacgctgtgtgaggtactgctcagcggaggcaagttattaggttgaaggctgtaaaaccatcatgagggggtttatgatgcagtattgacatgatgctaccacagagtgtacgggtatgtggtgcacattctctggtaggggtgaaggtcaaggtaaacctgatccccacctcgggtttaaattccaagcacttcctcaggagagttccccacctgcagccaaacactcttcagcgggaggtcatggagctgcttctccttctggggtcatgctaggatccgtgccaggtaaaagctgatggcaacaggacactgatgtggcggctggtgtaggtcctcagggcagtggcggggctaggtcacagctgagggattgcgtacagcggctggccttagagcagctgcctcattcagctgtgcagagcttcaccctctgtagattcacccccaacccacaggcattttatctttgctgctgtccaggacatgctgctgtgttttaatttcagatttatgcatttcttctgtcacctagaaccttcattagctaggctaatctgcatgtaaaggaggataatgtgtgctgtccatatggtctgtgaatctgtagcctttgaccttgagaattgacattttatatacttttctgaacctgatcttcagtaacaaggccaggggcactttccagtggcaacttccccctggccccccttctatgtgatagggctcattttcgtctgttttggttttctctttggaattttagtcattggtgaaaaggtagaagacattcgagggagcaatgctatggatctagttgatttaagcattcgatgaaacagaacagtggtcctccaactacagcatgtacatgcgtcaccttgggggcttgttaaagcacaggctgctgggcccaccctcagagtttctgattcaggaagtctggggtagggtctgataattgacatttcttaagttcttgatgaagttcttcaggaatcaaacttggggaactactgtggtagaagaatctttaaatctagccccaccttttccattagttgacctaatactaactcttgtcatagacagatgatgatagatggataatgcatggataaatgagtggatggatggatgaatgggtagatgggtgggtgggtggatggatgggtgggtggatgaatgtaggggtggatgaatggatgtgtgggtgggtggatggatggatggatggatgatgatggatggatggatgtgtaagtgggtggatggatggatggatggatggatggatggataaatgagttagtagatagtggataagtgggtggatggatgggtgggtggatgaatgtaagggtggatgagtgggtgtgtgggtggatggatggatggatgatgatggatggatggatgtgtgagtggatggatggatgtgtgggtggatggatggataaatagataaatggaggatgatgaatgggtagatggatggatgagtggatgcttggacggatgagtggatggatggatggatgaatgagttggtagatagatggatgagtggatatatgtatgtaaggtagatggaggggtaggtggatgggtgtatggatggatggatgactggatgactggatagatgaatgggtgggtggatggatggagggagggagggatggatgcatagatgagtggatgcatggagtggaggagtggatggatggatggaaggtggatggatggatgaatggatggatggatggatgagcaaaagctgtgtgctgcctcctgtccttaagctcttcctgggaagggcctgtggcctgagcaatgggctgagggacacagcagcacggaggggctttgggggatgagggggcttcccaggaccaccacacaggcacagctgttcggcaccccccagttgcaggtctcagaggaaaagctctggggggacgcgcccaggaggcaggggcacgcatttctgtgtggaattgaagagctctcagtggagtaggtgcggctccctggcaaaatgccacctgcttattagccagcccagcggtttctgacggacgccttagcactcccctctcacgcctctgccttcggcctcagtgattggcgtctcctcaaggagccatgatttctttgtccattttttaaatgtgctgaggccctttaggagaaaaaccacgcagccaaatgaggtacgtctgtgtgggttgctgactattttgtaacatgaaatttaggtctctaattagataggtgtgactataaagtacagaaacatttaaaaaacaattagctttcatgggatgttgttatggatcttgttagtagggattccggagcaggttttagagatttgagcggagggaggcttgtgaggaaaccgtgagtcctctgagcatccttggtgtcctgtgttgctgaccttctgtgatctgacgccacggctcagtgcttcccaagagctcctgagaacgcagcgctcaggcctcccagctgggtgagtctgacgccctccatgcgaagacggcgcgagcacggcttcacctgtggaaccaggggcagacttatgagctcccgggggtttcagttccggcctgctctgaggacactggggggccggccctgtgtttgcttggagcgcccttcagggagacccgtggctccaggggctggcgctgagtgaccacaggcaaggtctcaggagtgagtgatgccaggcagcacctgagaaggggatgcctgcgaggtgtgttccgagtttcatggggacttgtgttggccaccgcctcctgagtcactggccccttttcacgctgcacctgtgccttgggatggtggccgccttccagcgtcttcctgatctccgtcttcaaagccgctcctgactcttccactgccccctctgaccccatcccccactgtttcatcagctcccatcctggcgcttcctcacctggtgcctcattgcccggcacttccttatctggcatttcatcacctgccgctccacatcacctgctggcttcctcctcctttagtcttacgtttggagttccctgcatttggcttccctaagggtaagaccaccttctatagtggtgcaaactccccctcagaactaggggcaccagttccgcaaaggcacccgggcatggctaacctctgagtctgcaaagccccttgcgtggctgacttccaggtctgcaagggcccccggcgtggccaacctctgagtctgcaaagcccctggcatggccagcctctgagtccatgaagcccccggcgtggccaacctcattggatgagtttgcttggacttttgcacccctggcatgctgctgttctgctgcttttcataagcctggccccttgggtgtggaaagtgcatggattttaggggttccactcattttgcagacgttctggggaaaatcacatttgttgatcatcaataccagctgaataccagagggtgcactccagaattagaccttcagggactagtaaatatgagagatactggaggatgaactccagaattagaactttagggactagtaaatatgagagaagctggctcgggagacctgctttcgccataataaaaaacaaggcataagcatcacaatcagaagttctccaggcttcagctgctcatgaaaggcatgctatgtctgacaaacacattttcatgagtagagaataattttaacagactctagggtctactgactcataatttaaccaaatacagtttctggagccaagctggttctgcagcctaattatggaaagctcggctgccttttccgtgtgtttcgtttcctccgccgcctacgacgtgcaggcagcactctcaacatagccccttctttcaccagaactatcgtttccacgtcagctcacgtcaccatccgtagagttggaaggataccactgtaagtagtattttcacacttctacccttcggattaactcagaaggtatctggtcacattcattttataactctgggtgtggagaaagaagcatctgttacgccttttggaatgtttacaagctaactgcccttgtctgatacacacacaaaaatggagctgcctacattggaattctagcgaagtactgaagttagaatgtctaatgtctggtggtcatatgtggataagatgtgggatgaggtttgcaccttgtgaggttagcggggcccctatgaagggttgcattgactattaggttaaaatcactggtgctggacccgtgacctgtgaggtcaaaccccagctctgccatctgtggctgtgtggtgcctcggtttccccatctgcagaatggactcaggagagcacctacctgctagggttgatgtgacaatcaaatgagttaaatctgcatgaaaagcactgagaagcacccagcaggcaggaagctgtggggacccgtttgctgttagggtcacttgtgcacatggtcagtgccggcgggtacccgccatgagcacctgtgcacagcagggagccgctgccgtggtcatcctcagggagccgctgccgtggtcatcctcacatacagttaggtgtgtgaccgcactgacgatcccagtaatgaagtatgtggggattttccaggtaaatgagaaggaaaaggaaggttctgagaggaagggtctgtggttgacctcgttgcggtcgcacggtgatagaggtgacatccgtggtcactgttctcccagatgcccacggtcgcagagagctcgagcccgggcttcagcacgcagcacctcacaggcccctctgccatagcaagctcctggcctccctccctccctccttccaccccaggagcctttgtccagtgtaaaccccaggagatgcgcagtgctgggaagaaactgaacctttgggaagagacactcaagaaaacttacagttgcgagtttgaaaatacaacagatccgattgttccttctaaattatgggattgcctggcatttgcctctaaattgggctctcagcgaatgttccgggtttttttttttgtttgcttgtttgtgtgtgtgtatgtgtgtgtgtgtgcgtgtgtgtgtgtgtgtgtttgctttactcctttattaataatgttaaagaaatgagacaaatccccaaagcatgaaaaccaatttctcagcattagtcatattacttaattgtgctacttaattcactaaaggaaagaactagtattaagtttcattaatgacatttttggcaatatattagagatggtgagctaatgccccaaacaagacttcgtttctgtaagaatgccttatcttttaaaacgaaacttgtcatggacaatgaagagaagcattccagctggagcacctgttaaacgctgcacaggggaccacacgcggctctgggctcggccttcaggtcgctcatggggcggcaaggctgtggcggacggcagtgtgtgatgctcacgcggggagcagcactgggtcacctgcacctctgaggcagagctgtgtggccttcccagccattcaccaaaggtgcctccaccagaccggagccacgaccttccctggcgggtcccgggctgggactgaaggagaggaggggctgctcggtgagtggcctctcagacaccatggcgggaagacgacagagccgtgaggagacacacaccaaaccggacacacaggcctcctgggcagcgggaaacctggagacaaggacctggtccagcagggctggcgcagaggggttggggtcgcccagtcggacagtgcggggcttcccagtgctgctgtcactaccctgtgggggctgcatgggggagtcatcggtttccacaagcacgctctgtccttccctgcaccccacgctttactgagagaggaaacgagacaccttcgtctgtgccacaacccaggtgtgcacggcggctcccacccgcatcagcccaggagcgctgaattttaaatcacccaacagctcatttaagaccggccctaaacaactccctactccacgactaatggagtggctaatgtaagactcttttactgccaaaaatgataccacttactgatatggatttcttaacagtagcttggggccacattgtataaaatagactcccggggttcacaaaagtcaacccacttctcaggggcccaaccattctcgagcctccctgaagccaaccagcggggtgacaggaagaacttggatctcacatgggttttttgtgttttctcatggaggggctaccacggagcttagggaggaagtggcccccaccagccaggagaggacggccgcgttttcacgatggtcgctgaagccaaagcttgtatgagctacatataagaagaaatcagcagatcgtgagtgaggttcatatctcaggattaatttttgaaaaatggttttaattagtaacatctttaaaactatttagatgtttaggacattgaatgatgaacgtctgtgcacatccaatctgcgcagctggaagtggccctgctgttccgatttccttgacttcctcagcaccttaccacgcacaagggaaggaaaggcagagagagaggtttggtgttgaccccagaggcgaccctgatggctcccgtgcgcaccgctcactgcttccgtgaatacaaagcctgtctgcgtctgtccttgtggatgaaaccaacatttagggcttgatttcctggttattcaaagaggcccttggaggctcaccttaggtcaggagttggagaccagcctggccaacatggtgaaacctggtctctactaaaaatacaaaaattagccgggtgtggtggcgggggtctgtaatcccagctacttgggaggctgaggcaggagaattgcctgaacccaggaggtggaggttgcagtgagctgggatcatgccactgcattccaatctgggggatagagcaagactctgtctccaaacaaacaaacaaacaaaaccaaagaggcctgagctctggaaacaccacgcgaaatgcgccatctgtttccccattttcatgtgagtcaggttagggctgacctgtcctgggcttgcacacaagcccccaacaaaacggggttcgtggtctctgctcctgggtggctgagacatcgatcccatcaccctgctttcctctgtagctgttttgggggatgcagcacagacagcaagcgtccagctgcttcaggggacggcagccttgggaccaccttgttgcgtctggcaggtgggtgtggaaggcaggagggggatggtatgtggagctctgtctttcctggcagaagctggctctcaacacctgtagctctcagaggagcaaacccagcacagaacactttgaacagaatcactgtatttgtggaggctaataggacaccaaggcgccacctctcaggctgtggaagcagccttttcctcttgatgtccccgatgccagtgggaggacatggtaggcagggaccctccatacgttctgggagcgcctgtgcagggtggcaggacgggtgtgcactcagtaaacaatgttgaataaatgccttcttttgctgcaaaccagatgcgtgttctaatcacatcagctcacagaagggcacatgtggtgctccagacagcatgtgggctttcacaagcaggcctgagcgccagccctgccaccttctcttcctgtggcctggagcacataacaatgagttaaaatggcactaggccatttgcacggccttgcacatcagctgtgaggcctggagccctgtgtgtgcccagcacggtgcccagggactctgagagcctgagggtggcacgtcacctcgggggccattgggagccctggatgctgtcacctctcacccctcggaagcagccatggggcagagggtgggagctgctggcttgggacgggctcaacacctcttggggaaaagcatctccggccacgcaaagcaacctcatcacttcctccctcgaggagctcggcagcagacgggagccacaggcgtggaacttcccactttgtttcaggacagccagcagcacgtccctcccttcctctgggtttgtagttgtttgtttgaacttgagacttcctgaggcctggaaggtgtttttggcttgctccataaggcaaggaggtccagcccacgcaagcccccgccctgttcgaggaaggaaaggcccagaacttgcacacagcaggcaggcccagcggctgggtttctctagcacctcggcattgtctgcctgctcttccaggcgtgcagggcagtggtggctcgggccaggctctgggaggccgggcactctgaggaggtggctcagccctcttgggttctttcttgtgagttggcgaagcccagagtcaccagggtcctgagcacctgtctcttgtgaccatgcggcacccgcccggcttttagctgtcgcagcagagacccgaaggctgtggctctagcatcagggggtcgcctgtggtccctgcgtgaagaaccagagctgcctccgctttgtagcagcctttgtgacagggcggttcgatggccgagaagggagcatcccggggaaccctgcggcggctgtggtcactgcccaggaggcgccggggaactgcagggcgctcgaggccaggtgagatacaatggggtcgcagggcatgggggcaggtgctgtgtcccctctgcaggtgtcctctctgcgggcaggtgcctccctggggtatttctctcaccacttgaccagcaaaaacctgtgcagctcggagacttcttaaaaaggtagagataactgctgagcatcccactccaggtctgtgggtccagttttctttgttcatctctgggtcggccctgtcctgcagttctggaacctgggcttacgaatttccgctccgattggaaagacgagtggactcaaagcgagggaagcggcagtggtgggtttaatgaggctccccgggcacacgcggtctgtgggcaggtgggtgtcctttgcatcacaagaggtgtgttttgggtgggatgagggtgcagagctgtcacaggcgtggcccaggccaggtggaccaagaatgccattcaggaacagcacgtttgctcggcctgatggaacagcctaaactctcacaagtcacagccagtgcttttgttcacttcagaggagcaagggcattctgctggcttgagggggagaaaggagcttgttgctgatttccgctccatcctgccctttcccctgtctggcgacctggaaccacggtgggctgtggaacgtggggcagaagttggctggggccagcccccacccctgctttgacttggctccccacggagtttgggagcatttatttcagagatggatgggcggcggctgggcattggcaggtgggcgtcagggagaggaaagggaggcagcgaacacatccaggcgatgcctgactgtcctggggctgagcggcgccagccaggagggccaccatgcgcaggagagcctctcaggctgccgccttcccctttcccccgccttcccctttcccccgccttgggcacggacagagcctgtaacactgaggagggctgtgtcactcactgccggtcagctgagcgtgcaccgtgtgggtgcaagtaccccagggctaaaataacagatcccagcctccctccgagtccactgacatccaccacagcaccgtgtgagggaggcagccaggggctgtgcgtgaatcccgcacacgccagggtgtccagcgctccattcacgccccaccaccctcccaaagctgaagtcttaagaccctggacatgagcacagtgggggcttggagatggggaccccaacacatccccttcctgtgcactggggaccctgatacgtccccttcctgtgcactggggactctgacacgtccctttcctgtgcactggggaccctgacatgtccccttcctgtgcactggggaccccgacacgtcccttcctgtgcactggggaccccaagacgtcccttcctgtgcactggagaccctgacatgtccccttcctgcgcactggggaccccgacacgtccccttcctgtgcctgagaactcctgagacatcccctcactgtacataaggacccccaagatgtctccacaccatggggtaccaccctgttccttgtgggagcaggagaatgcaggagctacagtgaacttgtccctgtaactctcacagcgacagggcctctctgcggtggcagtgttgggagacgcgatgagagtgtcatccgctgtgagttctgcggtgctctggtcccccgtgaagacatcgtccacgacattcacactcactgagccacgtcctgcccttggctggaatgtgagggcggtgagacacccccatcctgtaaggaagtgtgcaccgagccctggtccccagatgcaccgagcccgtggcatctgggtggagcggcctccgcggcacagatcacctgggtgtagtgagaggcagactctgggtccctgggcctgcgagcctgagaccggatgaccaccagctcctggcagggtccacaccccgaggcacaggcagggggacgcatagcccaggtgtgggacctcctccttcaggccgggcggtgcgggtgcggctcagagcccagtgccctctgcctcctgttgcctgggccgccagcgtgacccacctggcatggacgcctggggactgagccttgtccggccccctcccagccctggctgtctccctcggcaggagctcggcaccccgcaggttttcttcccaggatgtgcgtctccgattggaaggtggaggagtcacagatgcccctttgtgtttccaggcctggactgggcaggccccggtcagggctgggggaagatgctcagctcatgttggacctgaaggttgtgggaaactaggcccggagtgcagcagtggaggccttgtctgaggggtcgggcagtgggggccccagcagagagcatggggccgacgagggggacaaagggacaagagctcaggagctttggaaagaggtctaggggcctagtgggctccaaggagggcagagaagccccacgtactcctagtaatggaggccgtgcccacctcgtgaaggggatttctgagctggggccgaaggcacaggatgtggtggcgtaggaagagcagtgatggaggctttctccaagatgttggccgtgccgtggagaggactggacgctgggccaagggtggccgcatccatggggcctggagcctgcggactgcaggaagccacagagtgggtggcagcaggggacctagggatggagcgagcccaggctccgtggcaggtggccgggggcatctccccaaggctctgcccctctgcccatcaggtgggaggtgcggcagatggggagtctggggggcctcctgcggaggagggtgtgcgccacggaaggctgctgagccctcattgtgtctggtgggaggcgggcgtcacagctgtgccgagaggcctgctctcgcgtgctgtgggaggggggagacgtggtgagggagagctgggcagggaccatgccgcttaccctcaggacagggtgagctgtcccagcagtggctgagcccgtgctgcataagggacttggcgtgatgtctgtgatcgtgtctgtggttggaagtgacgtctgggctggagctgacacccagctggagctgtgacaaaggacaggatgatcagggaaattgcagagaacaagggcgaggatggaagcttgaggggcgccgaggtgtggagggggtgtcggtggaagaaccctcaggagctgggctggggctggggctggggcgcagctcgtccccgagtccatggtggtgacgctcaggaggcgctggttccagtggggaggttggggaaagcacttcctgatgcctttgggtgtggaaagtggtgggggcagccaggctggttcagtgcaaggcctgaggtgaggttcaggtgcggcccacgggctgtggcagggacgcagcactcagcaggtgcctcagggtttgttggaggtgagggggtagcagagcccctcacacaggtctaggttgcaggttcatggcagctgggtagggacgggaagctccagtaagattcaccatgggatttttcaccagaaactcctagaagttagttctgtgtcgtgagaataaaaaagttaacatgtctttggcttcccatctgctggggagtgtgcccagtggcactgcggaaacccaggccggacctcacaattgcaggatgagcctcctcccttctatccggcaggtggccttctccaggcattgccctgcacctcgaggggcagcggggcttaagtcaagctctgtaaatgcggcacccgacgtctgaggcccgccacgctgcaggttcccatctccaaagcccgtggtgctgggcacggcagagccgtaggcggagacagggagccgggaggagcgtcagatgcctgtggcctctttacagctctgtcccctgccttatctcgctggctctgcccttggtcatcaggatgtgaggcggtgacggacacttcagtgctctgacgcactgtggccccggggaagcgtggtgtctgcagcctcctgggccttcccttctgcctggcttcctcctcctccacccgtccacctgtgtgtctgggtcaggctggcttctgcatctctgtggacagacctctccccgtgctgcagctgttttccttgggttgagcactgaaaagagcccctttgggttaggaggcaggtggacttccactcacatggaggaggagcctcctctgcccggaggagacggtgctgggagaaaatgtagctgcaggtggagattttctgataaccaagagtggatgttgtctgtttactgagtggaggttggggccggtgccagggttgtccatctcccctctgtcctgcatggcatggtggcagagataccaccatacttcagaggcagcagcaccctcgccgggtgccggatctcccagggtccacctgtgctgccctgccctggggtatttggagctgagttccaattaagccaagaaaaacagattgttttacttagaatttagaaattctcctttttttttttttgagatggagtctcgctctgtcacccaggctggagtgcaatggtgtgatcttggctcactgcaaccctgcctcctgggttcaagcgattctcctgcctcagcctcccgagtagctggaattacgggtatgtgccaccgcacctggctaatttttttggtatttttagtagagatggagtttcgccatgttggccaggctggtctcaaacttctgaccttatgtgatccgcccgcctcagcctcccaaagtgctgggattacaggcatgagccattgcgcccggcctagaaattctcttcataaaacgtgtttgagattggcacaggaagtttcaaacagaatcaggattcaccataagaagcagataaatacatttgaggcacccagggtgagtgatctcagcggaattcccctttaagcttcctagtagcgcgtgcaaaaaggaaaacgtgtggatctaagactgtgcacaaacaaaagctgttcttctgggaggaaccaatccctcagcaatcacacttgactccctcgaaggaaagctggaaggggagagggcgtcaggatgcaggtcccggtgtctctgtgcagctcatcctccttcagaggccgctctgcttctgtccatccctccaattgccagtggtgtcagcatttggggccgtgatcagatggaggaagactggcaagcagtcacccccgacaggactctctggctcagcctccccaggaatatgctgctccccaggcacagcggaagacctgctgcgtttcatcttccggctgcctgtttaaagcaagggaggccatgcccccagcggggtcccttgtgcctggacccaaggcaagaatagctcaggcttgttcctttttcctcaagttcctctcgggcgggcacggtgtgtcgcctggacctgcatgtaaacatcagggcggagcaggaatcggcctccaggagggtaattgcctggcgtactctgtcccaggtagtgggtgaaatgaaagtaaaaagccagctggtccctcatgcagattttaggggacaaagttcagcatagaaaggtcctgttacaaggagagggttgtggcgagcccagggcagcgcgcgtcctccccggcagctgatcctcgccatgggggacggaaaggctgtccggatttccgtggcggaaatgaaaagctactacctgtattctgagtggtgctcctggctgctgtccgtggctgagggtgagtctcctcgtcccctgtgagtccctcgcaggtggtgtgctcggagcagtcgaggcggcctctgggtgaggcagcatggaggtgccctctgtggatgccccgtgctccacagggcagtctgtgtcccctgtggaatttgcagtagctcagggagtggggatgagaagcaaatgagcttttcaccctaaagttatcatctgatcctaatttatgtcacagttaccaaaagcaaataacctccttttgtctggcaagcctgagcctcacaaactgtgcaaacagctgggggctcagcctgcaccaggctgccccgcgtcttgagagctctgatgtcccggggccatggctgcaggtgcaggacagagacaaggccgtgaccgaacactttgctggtccccttgaccatgggacacccggtgacgtgcctgaggatcggccccggcacaccgaagcccggtttatgcagagcttcccacggtcagccgtgcagggagctgtgagccccggccactcttcctcttcccgtcccgtggtcagtgagcccccagggccgtgcgtggggctgagcaggtctcctgcctcagaaggcatttccttcattccacctcgaaatccagaaaatgccctggaacaagggctcgccccttcactggctgaatgccatctgtgtgtctgcctggcatgacctgcggtcggggtctgatcctgcctgtgaagacacagtctctgtgaggatggggccgcggccggatgccatgtggcgctttcccggggcccagagtgctgagtccttgtcctcagagttgcagctttgctgtttataaaactgcatccactctcttctgaactcacccgttctgcagatgaggagagtcaggaagtcacggagagaaatgcgcatcacagggttgtcagagcgtcccacgaacggtgtgggaggacacagcagtagacgtcagcaccaccaccgccccattcacacctgggcttcccccaaacctcccacctccccacggtcccactgccctcggaggacccaccgcacaggggtgtttaagacagtggcggtgctcccgggagaccacggggtgtctctgaggacaggcggtcccctgggccccctggttaggacagaaacgcaagagccacgcaaacctctctgtgacactggggaccccctgagggagggaagccccatcggagggtctgctgggcgggcctgcctgcctgtgggtggacactgggccgagggtgccaaccctgcccacggggcctcagtcctgcagccgggtctgcactgcgccctcactcccctgcctgcctcacagaccgtgggggctcccccaacagtggcgcgtacgctgcactctgccagggccgtctagggttctctcaggactgtggggatgcctcaagggtggcaggagccacttttggccaatatgcagttagatttgataagaaaacaagctggcgtcctgcccaaggctccggggaggtttcaggtgggactcggagccagtgtcggagctggagcacatgaggtcgcggggccacagccaccctgggctgccgcatttccatctcggtgggtccttttacacagatggcacccggtgaactcactcagtggagctgcctttccctgaagccattccttcacccggctgcagggccgcagacagcacgggccgcagggtctctgcagcttgttcaggttcagattggatggggtcccagaaggcatctccctccacctgccccttccagcgctttcccgaaacgctgttgtctgcagccacgcagagggtggcgtgcgcctggagcacaccttgtggacgcagcccagggctcgttgtctgccccctgatccacccagcacaaggtcagcaccagcacccattggtctttttcctctcttgcttttcactcactgctcacactcccttcctcagacaaattaaaaccaagtcggagaggcccagcaggggaagcagagttggccttctgcagccgcacagttgagtcctggagttcagagattttagctgctctgcccaaaacggtctggcagactaaggaggaggccgggtgtgaggtctcggcctgcgctgcatgcaacgttttcacttccatggtagtggcagaggaaagggaagtcctccatactgtggcttgctggtctttgcacggtggtgagagggttgggcgttgggctccctcgcccccatccggcctctcatccctgtccagggcctggaaggggccagtgtgtgtctggaaagtgtgaagtctggcaggggtgtgggaagtacccatgagcaccatcgctgtgggcggacagtgatgggattgtccccctcgtcacagcggacctgtgagaaatgaccagaactgaccctgcccagcccacaaggggacagcctcatccaagcaacacacacccattgtcacagttacttggaatcctgctctatatttttgttcttcagagaaggggaaaagggctgggcatcagaagattgctctgaataaacagtgtgtttagaagagagtcacagggtcaggctgcggggcgaggaggcctccttctggaggtgcacatgccactcgtcttggggctgagaccaggagtttgcaccgattcagagggaagtcgacggcatctgtggcagcgcacatgtacacaccgtgtgtggtggtgcagctgcctctgcccgggatgcatgatgctctctgtggtcctcgtctactgtgttttttttttttaattctacatggtgagccaaaaaggttgttaagcacctttggggtacagccctgccatgataagaatgtatttctaaaatagtggaaaggaaagtcgtggagaaggccagcacctgcccggtgtggggagcagggcccgggcacgtgaacctttccctgcggagctggtgcctgtgggtgcacgggtgtggtgcgttttaattctcggcagctctgtgcggcctggagggacgttctgtcctgagcaggggatggagctaccacacccgagtcctccctgagcaggggatggagctaccacacccgagtcctccctgagcaggggatgggctacgacactggagtcctccctgagcaggggatggagctaccacaccggagtcctccctgagcaggggatggagctaccatgcccgagtcctccctgagcaggggatggagctatgacaccggagtcctccctgagcaggggatggagctaccacacccgagtcctccctgagcaggggatggagctaccatgcccgagtcctccctgagcaggggatgggctacgacactggagtcctccctgagcaggggatggagctaccacgcccaagtcctccctgagcaggggatggagctaccacgcccgagtcctccctgagcaggacatggagctaccacgcccgagtcctccctgagcaggacatggagctatcacgcctgagtcctccctgagcaggggatggaactaccacacccgagtcctccctgagcaggacatggagctaccacgcccaagtcctccctgagcaggacatggagctaccacgcccgagtcctccctgagcaggggatggagctaccacaccggagtcctccctgagcaggggatggagctaccacaccggagtcctccctgagcaggggatggagctaccacaccggagtcctccctgagcaggggatggagctaccacaccggagtcctccctgagcaggagatggagctaccacgcccgagtcctccctgagcaggacatggagctaccacgcccgagtcctccctgagcaggggatggaactaccacgcccgagtcctccctgagcaggacatggagctaccacgccagagtcctccctgagcaggggatggagctaccacgcccgagtcctccctgagcaggacatggagctaccacgcccgagtcctccctgagcaggacatggagccaccacgcccgagtcctccctgagcaggggatggagctaccacaccggagtcctccctgagcaggggatggagctaccacactggagtcctccctgagcaggacatggagctaccacgcccgagtcctccctgagcaggacatggagctaccacgcccgagtcctccctgagcaggggatggaactaccacacccgagtcctccctgagcaggacatggagctaccacacccgagtcctccctgagcaggggatggagctaccacgcctgagtccttcctgagctcttagactccatgcgagttcagtgatgctttcttttctaatttgccaatctcttaaaccagcagtccccaatctttctggcaccggggaccagtttcatggaagataacttttccacagatcaggggtagggatggtttcagggtgaaacggttcacctcagatcatcaggcattagattctcataaggagctcacagcctagatccctcgcatgcacagttcaccataggttcgctcctaggagaatcaaacgccactgctgatctgacaggaggcggagctcaggcagtcctcactcacccgccactcacctcctgcttaccccctgttcactcacctgccgctcacttcctgctgtgcagcccgaccagtaccggtctgtggctcggggcttgcagacccctgtgttaaaccattcagatctgtgggaaccttgtctatcctgaaagtgcaggaactaccacacccttcgtcactttcttatgtttaaagacccctggaacttacagaatgtggtggctacaccaggtccagccctgtcgtgggatatttgttccaaaccctgcagtgtcaggtaagttcggggacaggagaccactttgtcttcaccccagagaagcctgtttttcaaggacaaagtaaagagtgtgctaagcaaacccagtgcaagtgcttatcccacatacggtgccttgagaagtgtgacataataaaccacccggtggccgaggcggggagcagtggctggcagagaccctcgcacagtttccttcagaatcacatggaggggtctgctcttgcaaggagacctttgctttccatgattgccaagagcagttcagaggactttccacgacttctatgtacaggcacgaattttcagaaaaccaaactgctttctgtgtggagctaagaacaaatgaattagcagaagatgacaaaggtcccaggggtgcttttcttcatcccgtccttcttcacttacttgggaagtgtgtgcccagcgtctgctctgtgccaggccaggccaggcccaatgctgcagggaaagcaaagaatcagtccctgttccctaaacaacgggcagggatgacctggggtaaggagaactggcgtgcttatcagctttgaggagagcgcagctggctgaatgcgctcctgaaaacccgctgcctcctcccctgagccaccaccctgcagccatgtgacagtaaactaggtgtttgctggtacattgttgccacagagacaaaaacaaagaaagcctgctcggcctccgccacctggctctgcacctggggctctgtacctgggtccagctgctctgtggggcctgcaggaggggacgggacaggagctctccttccaggaagcagtctcagctgaacttgagtgtggccacagcactgccctcactgaggctttctgcgaaatccggccgcctgccacctgcttctgttaactttgtacacgttgtgtgggacctgattcgctgtgttttggggggcatctcccgggacctgatttgctgtgttttggggggcgtctcccaggacctgatttgctgtgttttggggggcatctcccaggacctgattcgctgtgttttggggggcatctcccaggacctgattcgctgtgttttggggggtgtctctgaggacctgattcactgtgttttggggggtgtctctcaggatacgaacacctttcagacacattatccagttacagtactcattccacaaggaaataatagcagatttttaaagtgtgacttcattagaacattggaaattttattagaagttgctaagtatttcaaaaatctatcagaagtttgcaaatgattttataaagacagaccctcaagatgacagctcaggatgcaactgaaatttgcttttttgagtgtatttggcgtttgctgtttgtgaccctgattttcatgctctgcagcagtctgtgctccctggccgggaaagggggtcatttgctcagagccaggagcccttccctgcgggttaagttaccggaagtcatgtctggcagggcaggatttggctggttctggtctcaaccacagccgactccacagggcttggcctatgtgggattcagcccacgaaaacaatttcttgttaaaagcacctgtcttaccctccctagtgatctcactgtatttaaaatatttatttaaacaaggcaagtattccctttttattacaggttgagtgccccaattagaaaatccaaaatgctccaaaacctgaaacttttgagctctgacatgacatcacaggtggaaaatccacacctgacccgacagtcacagtcaaaacttatttcatgcacaaaattaaaacagtgtataaaattaccttcaagctacgtgtatgaggtgtgcgtgaaacataaatgaattttgtgtttagactcgggtcacgtcccaaatgtctcattatgtatatgcacatagtccaaactctgaaaaaaatccaaaatccgaaacatttctggccttaagcattttggatatgggatacccagcctgtaggagatacttggccatgtttagtgggagccaatggatgtatacctaagaatctgcctaaacctcgaccgtgcttcctgatgtcatgaggcccagtcggaatgtgcccgacttccccatctcagtgagggcagtggaaggggaagccgtgctcctgtggggagagccaccacccacccaggtgctccagacgttcccgccgtgcgtctgtggtggccacgtctcatcctcagtggctgcacgtctgttccttgggagtggattagggaaataagcgtggcctgtaggaagctgagtttgaagcagtgagctgggcccactgaataatgatgtggaagcttctcagcccagtctcgtttttgtgaaatggacactgaatattctagctggggaaaggtggaacttggcacttacgtaacttacccttctccccttggtgtttcgtagccaatcatttttattgcattaggtctcctatactgtaaatctacagaacatcgggaacactgaaaagttcacctcagttctggctttaaaagcactgactttcacattatatttgagctaggacaaaagaaaacatttctctgcaatgtgtgttcatctcgtaagggtgtctacactgaggtcagaccctggtgcaaaccccaaaatacttacagtggcagccccggctcagtctctgccaaacgtgcgcgggcatcaggcaggagtccatgggccatgggggtgaggagagagcggctcgctgccttgagaagctcccgcttctgcagtaaggtggcttttaagccagagattaccacgcgctgccgcggagggagaggtagcgcggggcatggggaggccacagagaggctgtactgacagaggctgggggaggatctggtgatggagacacgatggcacagccccggtgaagccacgtgatgtcttcgtgtgaacatggtggcgggggagcgccgggcacacaacatggtgggtgttcctgggcagaggcttggtgggcagtaggggccgacctgagggctctggggtcaacaccggtccaggaatttgactgttagccacagagaccgccaggagggcttttaggagatatgtgaaatgagactcagctttcagcaaggaaatcagggagcaggtggcagtcgggagggactgcatggaaacaagtggcttaggaccaccctagtcgttcaggcgtgggatgaggctccaggatcgcagccacagaagtggcagtgggaggggagggggagggtgcctggagagaggtttcagggcaggagggacggggcttagggatgtttcttggagagagggagcgagaagtcatcgtcaatggccccacgatgtcaggcttggaatttggggtggacggtggtgccatcagtcaagagagacttcagagggagaggttaggtgatcccatcccattttagcaccagaagtggctgtgtgagctgggaatggggtcctgggtgaagatgacaccacagataccttggagatctgcctccagttaagagacgtgtttgcctcctgggtgggtaggattttcccctcccttagatcggaaggcgaagaaggtgagatccacagctcgatttcccttcagataaaaggcacaatcacaacagcagcaaacacaccttcattttaaagacagcagaggaggggtggggtgggagggcagtacccaggacagggtcccagccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgtcactgtctgtgccggtgtctcgggcgggggccagtgtggctgccaatggggcaaggtgcgtgggacgtcaagctgacgtcactgtctgtgccagtgtctcgggcaggggctggcagggctgcccaggaggctgtcggtggggcagttcctcatgaatctctgagctgagtttgtaaaagtgtgtgagagtggggaaaatatgggtgaaaatattttcagacatttggattcccctttggtgagctgtctcgtttcttcccgctggtcagggatgtggctgcttgaacagctgggcgcggtgaccaatgtgtggagagccgggaagcctgcggtgaggccgcgcgatgtccttcatcccgggcagtaaatccagccccgagggtggggcatcctcccgggcacaggctctcctgcctggggtcgccgctgcgggcaggacatatgggcctcccaagcggtcccatctacacaggtcgggtagagtgagtcggaaaggccaccgaggttgggggctgcgcagccagtgggctgggctcaaacccaggcctgcgcttcccctgtgagcccaggcagccctcgacctgtgtgtggctcggttttatcgcccaaaaaggggaacaacgcctgcgtccgtgtgcaccgggctgcggagacttccccaggtttggctccaggacggtccccaggggcgcctccctccatcccctcctgtcctgtcacctttctgcacacggtgtcgcatcctctgacctgcgtggcactcacgtgtgtctgcccctcccgtgttctcctctccaggatgcggctgtttggtggcactccgctgtgtcgaggcactgtgcccgtgccccgggctcccctcgttttacagactcgctcacggaggctcagggcgtctctgagggcacgaagctcatgtcagccagcagaatggggatgtagaccggggctcgctctcgagcctgtccgcctcctgaacatgcctgtttgctgagcatatgattaagagaaagaaggaaagagggtccatttgagagcttagggcagcgcccagtataccgtcagcactaagctgtatgagagcttagggcagcatccagtatacagttgtgcttagtacgtgttggcactgcaactgctgtccttgccgctgtgtgagctgctgctgggtggcagtgtctcagggctgccacttctgccccaggagagcagaggggagctggcggccgaggtggggtcggtggtggggtgagcctgcggcgttgtggctccaaggcctgctggcctgaagtcacccccgggatgtgccccgtgtgggaccgtgcgggatgcagggaggagcgtggctctgggtgtggaggtggcgggctgctggcatcctgtcaccgaaccctccttccacaggaacgggggaatgagtgggagagcagtgggagagtgtgccctctcccccagactcctctctccctgtggcatgagaagggtgggatctggcttaccaggtgagtgagcaggcgtggcccggaagtccgttcagtcctgggcgcacccacaggaactgacatccgcatgccaagcagcacctggcggccaccggggagtgatgccgggtgcagcctttacattcatcccaagcacagtacagccctgccctcaccccatgccaggctgactttcaccagatccaagcctgacgtcttctctccacatagtcccgagttcccctcccagggccccatttagagacctccccttttcccgaagccaccagactcatgcagtctccaaggctgggctagccctcgtcatcttctaaggttatcctacatcacaaaggtaaatggcatttaaaataaaatgtaggccaggcttggaggcgtgcacctgtaaccccaggagactaaggcgggaggaccacttgagctccggagatcaaggctgcagtgagccgagatcgcattattccactccagcctgggtgacagagcgaggccttggctagaaaaaataaataaaaggcgttgactttagagagtttctgacaaaagaatggaaatgtttctggtccctgcatctagccagctgtagtgaccccgacacgccaggatgggccgtgctaccctgggctatgtgtgcagcggggctgggacgggccaggctcgacctgtgctgtgattttccacccagaacgtcgcaaatgtttcccaccatgtggaacgtctgttggggaaatggtgttccagagtgtgcagtgcccttcagaggccctgcgtctccatcttttctccacggcatcctgcgaccgtgctcctcaggtgtgccccacgggcccgggaatgtccttcttggatgcgcccgatggtcccgagactgtcgtcctcagatgggttcatggcccaggatggcatccaggctcctggtgagccctgtgggtggagacctggtgccgcccctcctctctcctgagtcctgatggctggcagtgccgcccacggcacctggacgggggctgtgttgtgttgtctgcatctgtgcacagctgagcccctgcctaggatcctcagctgctttctctggcttcaccacccccatgaaactcctgcacagatctggacgcaccctggcagctgctgggccagtcccgccctcgctatctcaggtgtggccgggcagctgtgggagctgggcctaggcgggtgctgctgccagccccgggccgccctcgcctgcactgctttcccagctgagcggctgcttcccgtgaacggagggactctgagatcatctcgtcctcacgtctccatctggggagagcaacttcccagctcagtggcagacccagagccccaaattcccatcgagagcctcgggtgagtcttgagaccaagaccactgtgggtctggcccaggaaaacacactgccctctctctgctgcactgaacccaggcagcagatgccatctgcgcttccaggtttgcgatggggttgctgctgacgcccctgtgcagggtgggagccgaggagctggcagacagactctcagagcagtgttacacaggcagctcctgcagacacctgtgtagacatccacgtcacccatagctgggaccccgtacgtggacagcagagtggggggcatgggtgtcactgacctttgccccgtgtccactgtcccttcagccccagccacctggtgagccgcgccctctgcatctgctgctacagaggtgttttatttgacttaaggtttagctgtttgctttggcagcaggtcccaccccacagcctgatggctccagacagggctgaccaggtttgtaaaatgaaattgtccatccgggaggaggagaaagcaaccccccatccaggtcggtcaccccaccctcgtccgtcacacctggtgccatcactcccacagctccttggggtgggaagcgatgggtcgagttcctgctggacacgggcctcaggccccccgggtgtccccaaggtgcagggaccagcgtggtgacgctcattgttcagagctgctgatctggggctggcgtgtgtggtttcctctccaggcagggagcaccttcctgtttaactgattgggacagggcaggagtgggctcttggctgaggtgctgggcctgcccgcagcagcagctgtatgaagccggtgcgtcggctctgtgccctgcgtgagcccatgtgtgcggggcctttgtgttgcacttcactgagggccccggggtccactgggcacctgctgggctcaaactgcagtgcctgggccactttccatcctgtgttccgaaccccgtgcacagcgcagctcctagacacggtcattcatgtaatttctaggcacatttgtaaagcacaacacacaaataaaaggtaagggccaaataaagcacgaagtctcctcactgctgttcttgggaaggcagaacttaaacgtgtgaaaaagctggaaaacagcataccaaatacaacaactagaaacccagggccctggcatgtcagggaagggggagctcagagccaggccaagcgtgaggaggccgtgagccacaggcctggccggggctgttggggaaatgggctggggacatttctggagggttccggagggtcctggaggcctcaccaaggaggctggagtgattggttacattattcatggagctgactgggctcccaggacgggtctgaaatcacaccaaagggaagcctgcaagaaatcacaagaaatgtgctttcctgggggatgggatggtcgtgtgttcaaaatgtgtgtccctggggaacggctgtgtgtctggcatcgacttggcctggacttggcttctctactgcgctcccgatcccaggtgtggggtcgattctgtcttgcgccgattggaggcctctgctgtgggtgtggtttcacgtgcactgtctctggctaaaggtctaggtgcttggaacagcttttatgaatcggaaactggacagaaaccagcctgaggccgtgcgagctcccacggcccttggaggaaagctgtttcccatctccagccagagaagctgcagggatgcctttggccttgacttggtcagcagggagctggaagggtcaagagctgtgggtggggagccctcagtctcctggactgagtgagaaacggtgggtgagcagccatggccacagcgatgagcccgggatggtttcccgtgtgtggttcgggccacgtgttccggcctctgatgggcattactgtggccccccagggacacagagcagggccagccctccctggcacagggccattgtgagccagtccctcctgaagatggccaggtcctccccggcttggggccagaccgcctgggtctgccctatggtgactgttgcgtggcccccttgcttgttgagcaaatccatgagactccactgtgtaccctgaaggagcacagcctttgcccaccagaaacttcagtgtgacaagacatcgggggccaggagagacgcacagaagaggggagcagctgatttctcggggtccttgcatctgtaccaggggcccctccttccccacacgacgccctctccttagaggacagcctctggcaccgctcactcactgtccctctgtttaaaaactgaggcccttctgtgagagcctcctgctcagaacacagtcctctttttcggctgatctttgctcactccatctgcatcagccgctgtacggctggctgcctgagacgtcccagccctccgtgtcctccagtgctgggagcaccgagggaggaggtgggccttgggcctcgggggtctctgcaggccttgagcacattgtgggagagggggtgtttggtacatgtgtcccaagcctgaggcctctgggcgtgctttgctgttgggggttggaagctggaggtgaggacacgttggactgtgctcagctgtgaggggacccaccgtgtggcaccgtgatctgctcctgtgcccctgccgcctgataatgtaggagttgtgcctgcaaaacatgcttcggacattagagtcggctgggaatgaagatgcctgcaggccccagagcacaggcagggctgaagtgcgggcggcgagtgggctgggaatgaagacaccggagggccccagagtggaggcagggctgaggcacaggtggcgagtgggccgggaatgaagacgccggcaggccccagagtggaggcagggctgaggtgcaggtggcaggtgcatcggctggtgccgtggtgacggcgtgaggggccatgatgccgtggcctcccccggggctcgtgttccagggatagctcatctgggatgcgttctgacggtagaagataggaacacagagatcccagacacaggaggtctgggtcaatgtgcacagcccaaacctgctgtggctcagggggcagctcacaccgtgggtaccagccagccctaggtccaaacttacagggaaggatggctgggctggggaggacaaataattatggatggacatcacagcccctcggtggtcgtgagtgggtgcagaggggcttgcagaagcgacattcctgccccagggatgaggctgcctctcagaggacccaggcgtggaggaagcagtggcccctcttaggcatccctcccctaagtgtgtgcagcgtggagatgagagtcttggcccaggaggaagagtgagcttccagacttagctttggtgcttgtcagcgcaatcatggctgcaagaaaagcctccatggctgatgttcccagaggcagggcctggcgaggccacgctttcctctccagcaagcgtttggacctgagggagccgaggtttccagaggcaggagccaggtgtctggcatttggggtcagccacccccagaagccggtgttcccagcgggagaagctgaagcctggagggctggctgtgctgtgctgggcacacgcagggcaggagtcagtgcacatgtaaggctctgcggagaaaggcgccggaagaggccggggccagcagggacatagcaggccggggtcccacccaaacccagcacccctcccaggccttctcggctggggctgactccagcagtgggtgtgatattctcaggagatgtgcgttgactccagcactgggtgtgatattctcaggagatgtgcgttggtccccttagctccttgggattttcggctcaaactctgggcctggacaaatggtctcaggtaacttgggagctcgtcagggacagaacctgagtttgaacgagctctctgtgggactcccacccagggcagcggttaggagccccctcctggactgccagttttcaagtgacgtatttaagtatccccctcccggtcctggaaaagtagagaggcagccgggagcctgccttctgtgttctcggtgcaggggtattctgagaacggcccctgctcacacgggtttaaaaggaactcagtgaccacagacggatgagaacagcggacgcagctgcctcccaggcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccctgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcaggtgcgtggggcgcgggcgggtcctcgcctccccggaaggtgttgtggggcgacagtgcggggacgccgggcgggggtggacgttctgggcccagccctgtcctcagaggctgctggggcagaagcccggggctgggggatgccggggatggatgttggggtgggtgcctccgagaccagaggagccctgttccttggcagggaaggtgtgcacgggccttgcccgatggatggtttagggccatggccctggggtccctggtgagcagtggggccgcctctgcccttggcctgtgagggactgtctgtgctggtcccagaaggctgggatcacctttccactggctcctttgttcgaggtttttcatagacaggctatgtggacaaatgagggcagcgcccacgtctggctggtggaggggctgcggctcctccttggaggggacgcctggccactgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtggggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgttaaaaaaaaaaaaaaaaaattaataggctgggtgtggtggcgtgtgcctgtagtcccagccacctggggggctgagaggggagaatcatttgagcccaggaggtcaaggctacaataaggtatgattgcacaactgtactctagcctgggtgagggcgtgagcaggtgcaggtggccaccccaggttatggggttggctgtggagcactggggaaggctccagggtaagcaggggtaggtggcccccgtgggttttggggttggctttggggcaccatggaaggcttcggggtgagtaggggcaggtggccccctgggttatggggttggctgtggagtaccgtggaaggctttggggtgagtaggggcaggtgaccccctgggttatggggttggctgtggagcaccgtggaaggctctgggttgagtaggggcaggtggccccctgggttttggggttggctgtggggcaccgtggaaggctccggtgtgagcaggggtaggtggctgctttaagagaggttgtgtcccctgggtgccccctggttttgcacccctgaagccctggccaccccatcctgcagttccctcctgaaggaccaggcaaagccaggaccaccctggacaagaggaggaattgtccttctgagccctgacggttccgtgatcagacccgggacctgctccaggctctgttttagtgtctcacgtcctcttagggtacattgaagaagcattgtcggtgccagggtcagccagggtcagccaggcctgtgttcctcactgtgcccctcctcactcctgcagaggcctagggacctggaaggaacttgccacctgtgggtgacctttctcagaaggtaaaatgcagggtggggcgagccccactggccttggagagtctgtcctcgggcccagagggtgccagttgggggaggcgcagaaggactgagacacttggattccacagagaggtcaccgtggtacagtccagactgttgtttttaattttaaaggaaagaatttgttatgacgactgttctcattctcctttaggcatttttaacatgtgttccaggcagaccaggctgtggcccttccctcgtggctggtgcaggccacgcctccccccggcccagcgagtagggaggtttggctctggcatgaccctccggggcacaagtgtcctcggggagctggtccctactacatagaggccacctggcgtcacttggcagaggaggacggggcaccaccctgcagagaagcgtccatctgcccgtcagtgtgcggccacacttggtggtcctcttcaccttggcctcttgttgagcgcacctcccacctgcacagcatcctgcgtcgtagccaacaccacctcctccatggacctcagtctgcagccgtcactccatgtctgcagctggggccctggccagcccccatggcgcagtgctggggggttcctctgggtccctgtagcctccataacataacctgggagcaggaagatccccctgggtctgctcacctggtggggggcagccatcaccaaagccgtctgcctgcatcaccggctgaattgcagccatgatcccacaaggaagccttgtctcagctttacagaggaggaggaggcccagagagagaaagcaactgcccagagtcacacagctcagggaggttgtgttcagggtgaggtctgtgctcccgcagggccagtgagtgtctttcctgtggcagccgctggcccacgtgtgtggtgatgacaccaagcacacggaccacgcgtgtgttcagatgctgcctgggcttcacgttggtgcccatttctctctggaccttacgaagacaagtttgcggaggcatggcagcccgtgcatgctgttggtgggcacgtaagttggtgcaggtatcacggaaaacagtgtggggtatggaggttcctcaagtaattgaaaagagcactgtcgttggagccaggagtccccactgtgggtgggtatcggggaaaggagtgagcgtgttaaagagccacccgccctccagagctcaccagcccacacgtggaatcgaccccagtggccgttagtggatgggcgcgtgaagatgatgtggggcacacacaatagagtgctgctgggtctttgttagaaaggaaagcctgtcattcgagacagcacggatgagcctggaggacagtgctgagcaaaatcagccacaggcaaagccacggcctgctgagtaaaaccagctgcaggcacagaaaggcaaagccacggccccactcgtgtggggtgtcagagacgccgacaagcacggtggctactgggggctggggtggggaagcctggggagatgctggccggaggacacagagtttccgttgtgccaaatgaatgaagtctgggggtctgttcgtggtgggccatggactattcgtggtgactgactgtggtctgtttgtggtggccgtggcgtgtttgttgtggccatggttggtttgtggtggccgtggtctgtttgtggtggccgtggttggttctgggtggctgtggtctgtttgtggtggccgtggtctgtttgtggtgaccatggttggttctgggtggctgtggtcagttcatggtggctgtgacctgttcaaggtggccgtggcctgtttgtggtgactgtggttaacgctgtatttgtacctgaggtttgctgggagtggatgttgggtattctaactgtaaaaggaaatggcagctgtgggaggtgacagtcagtcaccagtgagtttggtggtggctatggtttcacaacgtgaactatatcaaaacagcacgtgtgcgccttaaatacatacaattatttttctcaatatagctggaaaaaatagccagaagctgtaagctcaggaagtgatgagccagccaagggctccgttcacaacaccctgcacagtgaacagagctgagtaaatggggctgcttagcgaaaatcatcggactcgaagctccctgatggctccaacatcttccgtgactctgggcaactcctgtgcaatgggaggccgtgccctgccatgtccccgccttcctgcccacaagcctgccctgtcccagccactggggtctcactcacccatcagcctggaaacagacgcatgtcggcaccctcccagcccctctgcgagagcctctccatagcctcgctgttgagcccgtggcagtgaaggtcccaggcgctggagcagacggcgtgggctcagtcctggcactgcctgccctgcagtcctgggctgcttacagctgagcctgaccttgaattccccgtctttaaaacaaggatgatgaggcttcatgctccctaggtcctcgcgaggactcactcaatgcactggagccaggtgtgagtaggaaacctgcctttctggcctgatcctccccccgggagcacagggtggtcctcatctgaaccccgagggggtctccctggcatgccctttctccctggacccctagccattccaggtgcagctgccagtgcgacccctcctgcggacaggaggtccatgtgagggctcagctgcctctgaaccggaaaggcgctggcaggcagtggctgggagagcaggcgcaccctgggcggcctccaggagagaaagggagacgtgtgcatctcagtgggggctggcgggagacactaaggtgttgaagaccctcgggtctgggccctgtggaaatgctccctgcgggtgccaccagccctgcccactcagcagtcacttgagaacgccccgagcatctggcccaggaggctcggcctggagcctcacatgtgcggaggtttggctcagcccccaagggcaggcccaggtctgtggcggggtgtggggaggcagcggagccatgggtactgtgtagcgggtagggctgtgaccggaggtggcaaagccggcagccagcccggcccttgggggagagggtggcagggtcagggtctctgaactctggaaggaacctgcgtccctcatcctgaaacccggcctcctgtgtctctcagacagtggctctcagtcactttggtctctggtccctctgccccttgattttttaagttgttctagctcagaagccattgtgtgtatggtgtgactacaccccagccagggcatgagtgcacacagatccagggtccgtgcagagcccgccaggtgtagggtggatgctgaggcccacctggctgaaactgcactcaggccattttactgatgtcaggaaacgttcatgaaaatgcaagctggtgagcaggcaagtgcccccctgcatgacagaccctcctggtgcccctggctcagacagtgtgaccttgagaacagcgggggtctaacccctgaccccagcgtccgtgtcacctgggagcctcaccttgagacccctgcgttgtggttctgaaatcacttgagtgggccgtggccaccgtgaggcggagaaagaggaaatacctgccagaagatcaaattgcaatccgtgtaatttaaagatctcactgggctttgttggcgattctagagtggggcagcactgcattccatgaactagaattaagagctccagtgaaacacgcagtgcggggccggctgtacagacagggctgaggaaagcagaaactgtgcaaacgcggttcggcggcctcagtcactgtcctttgtaagcttggggagtcggcgggagagacgtgacccactggccacttcaggcggctctgtgtcgtaaggatcagtttcacattaggtgattgccggacttacatcaagcttgaagaagcagaagatccctgcacacacgtgtggcccagaccaagagccgtcacgtgacaaactttgtgcttaaatgggtttttagtatgtgtatcttttctttttcttttttttttttttttttgagatggagtctcgctctgtcacccaggctggagtgcagtggcacaatctcagctcacagcaacatccacctcccaggttcaaaagattctccagcctcagcttcctgagtacctgggactacaggcacctgccaccatgcccagctaatttttgtatctttagtagggagggggtttcgccatgttgaccaggctggtcttgaactcctgacctcaagtgatttgtccaccttggcctcccaaagtgttggcatttataggcgtgagccactgtgcccggccaagtacgggtatctttttggcagtgtgaagaatttatttaggcttgactgttttaaagcaccataatgaatgtataattaagttatgataaagtcttaaccctttgttacaggggaacggtaatgttgtgagtggctgtgtctcagcccctggactccagcagtcaccctcataggagtcccacctctgcgggcagctcagagcctccatgtttttatatttaattctcatggttaaattcagtgccgtaactcatggaattaagtctttttaaaatctaagcaaactgtctttaagacagaaaaagttgggtaattcttcatctatttgaagtgatgctctctggatgggctgcatcctaagaatgtatcaaaagtggaaattctgaccactgttttgattgtccttttacatattaaacaagttgagagcaagaacaacaaaaagagggacctccgtgaccacgccgaggaagacagagcctggcctggttggaagattggcctctcctctgtctcctgttttctccaaggtccgataacaactcagtttcccttggagtgtggggacttcattttgattttcagtctgatctgttggggtctaggcaggagcttggtcccaaacaacacacccatgtgtgctgaggacacgctccaggggattcttacgcccgcctgcatcagagaacccaggtcttgtgggcgaggcagcgtggagagggagcgcagctctggagacggcccccagggcttgcgggcgggcgggcgaggcagcgtggagagcggagagcgaagctctggagacgacccccagaggagattggccaagtgcggatgtgcgagtcctccctgcccgaggcgcaaactgtctcactccaaagggcgtccggagggttctgcggggcggctgtgcactgacacctgccccccacgtgggagtccgccggctcctggcccttgccggttggtgttgcgcgtctgagatgacgcccctgcggtaggagcggggtttccctgatcaccgcttcttttgaccatcttttctggcagggccttgtatttttaaaatgtgtaaaggttaagctttctgagatcagaaaaataatatttagtgaaccatgtgatttaagtcactgtgtatgtgacatgaaatatttatacctaacccactagcaaatggctcgttaaacatatttgagatttaatgtaagtgagaattctgccaaccaagtcaggataaaccttaaacatcgggaatgcaaaatcaaacagatcctttaacacacatcacaaacagaggtgtggacgccccttttgtcccaatggcagggacggggcgctggcccccagggtgtcctgtttatcccctgacccacacagtgtcaggagcttgtctggaggggacggggatgctggcctcctggggtgtccttatctgaaggctgtggtttcaagcatcctccttactgaatttagattttgttccgattttgtggcctgcgtttcttcttactgccctgctctgtggccctgttcttcctgggtttggagatcctcaaggatgggcttcgggaaggcctctggccggatgatctggtgacgtaatcccatctgacgctcagccttggactttgaaaaggcacgactgtcctgtctgatggacaggatgcagaagcctttgggaatgggcattttgccagaataaataaaagaagacaattggcaaaagatggactgtaccccatggccccaggctgctgtgtggagagacttgtcctctcctctgcccacggtcaccagtgagcaccagggacggggtttcctgctgcacctgggcctcttcctgctgccaggagctgccttgctgcctccacctgtgacagtccaccccccataccccccccacccgcaccatgagaggatttccagggcccacccgcctccagtccccgttctctctgctgctttcgaggtcaccctgggctggaaggggtgcctgggatactgctcagacgtcttggccgccctcccaccccgcaacaccccgctcctggttttcaggatgaaattgtcctcaaataaagcaagcttttgagtcaacttgcaagaggaaggaagtttgcttcagtcgtctggttttgttggaacaaagagatctaaagatagacacatggtccccctccctggactgccattgccaggaccctgtttctgtgaggaaaagtcagtggtggggcctcacctgtgtatcaggtgagccaagggcacctctgcccttcccacgcttgggaaatctcaccacgtcgtccccgtagtggccagaagagattggccctcccaggtggggctgctgtggtcggtgctggggatgggcaggggcaggcctggccaccccctcgtcggccccacctgctgcctctgcccgcgtggcaggggaatggacggggcagcctctgccgggcctcagatgtgaggccctaaccctcccctctcagacctgcctctgagcagtggggtcatcactggggagttggttggagcagggctcagtgagggagctgggcctggcctggccttgggtggcacatacgggtcaggggcccaccacctcccagacgtctgacagcacagagccccacagaggccatgctcgcctgcctgcatctcctctggggacctgtctcctgaactgagtggccactattgttcctccgtgcgcttcttagtcttatggctgcaaaattaagtagactggaacttttaaagaaactatgatcataagggcagattttcccatcattcttgagtgggttcaaaaaatcaagaagaatgaaaacttacacacataaatggaagaaacgcccagcgccctgaaaatcccagggccccgcctgcagaaggcctccatgaagaacggaagaaggccaacactctggtgtgggtcagagagcatccacaggcctcttcaggttcacagagtggccagtgaccacttcagatgtagcgatattttagagtttatttgtatgagggcttagctgtgtgcagtttctgatcacacacagggggatccctgcttttcatacccaaaatgaggcatttgatctgagggacaatatttagagtttgtcctggcccagagagtccagaggcactgcgggctgccagcaggtagacagtgcagtgcagatgatggacaggtggtgtggacggtggacaggtggtgtggatggtggacactgcagtgcagatggtggacaggcggtgtggatggtggacaggtggtgtggacggtggacaggctgggtggatggtggacactgcgatgaggacggtggacactgcgatgaggacagtggacaggtggtgtggacggtggacactgcagtgtggatggtggacaggtggtgtggacggtggacaggcagtgtggacggtggacactgtgatgcagacggtggacaggcggtgtggacggtggacaccgtgatgcggacggtggacaggcggtgtggacggtggacaccgtgatgaggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggatggtggacaggcggtgtggacggtggacaggctgggtggatggtggacactgcgatgaggacggtggacactgcgatgaggacagtggacaggtggtgtggacggtggacactgcagtgtgaatggtggacaggtggtgtggacagtggacactgcagtgtggatggtggacaggtggtgtggacggtggacaggcagtgtggacggtggacactgtgatgcggacggtggacaggcagtgtggatggtggacaggcggtgtggacggtggacaggctgggtggatggtggacactgcgatgaggacggtggacactgcgatgaggacagtggacaggtggtgtagacagtggacactgcagtgtggatggtggacaggtggtgtggacggtggacaggcagtgtggacggtggacactgtgatgcggacggtggacaggcagtgtggacggtggacactgtgatgcggacggtggacaggcagtgtggacggtggacactgcagtgcggatggtggacaggtggtgtggatggtggacaggcggtgtggacggtggacaggctgggtggatggtggacactgcaatgaggacggtggacactgcgatgaggacagtggacaggtggtgtggacggtggacactgcagtgtggactgtggacactgtgatgcggacggtggacaggcggtgtggacggtggacactgtgatgcggacggtggacaggcggtgtggacggtggacactgcagtgtggatggtggacaggtggtgtggacggtggacaggcagtgtggacggtggacactgtgatgcggacggtggacaggcggtgtggacggtggacactgtgatgcggacggtggacaggcggtgtggacggtggacactgtgatgcggacggtggacaggcggtgtggacggtggacactgagatgcggacggtggacaggcggtgtggacggtggacactgtgatgcggacggtggacaggcggtgtggacggtggacactgtgatgcggacggtggacaggcggtgtggacggtggacactgtgatgcggacggtgcccccacggtctgtgaggcaggcaggggattgaggacagtgcctcctggtttcctctcaggtcacagtcgctcctggtgagagagaaaaacttaccgtaaaatctgaacatccaactgcgcagtctaggctgccgtcggctgcaccagacacacattccagagaggtgtgcaccagtggaagtcaccttgccaggagcatgagatagtatttcatgctttactgattgactgtttctgtctttctcccacaaaagaagccatcgccgagacgtggttgcgtactgggaatgggtctgtgccctgagctcgccctgcaaggctctggggaagggccttgacatctgcttggctctggcaggtcccatgacaccgtggccctgctgcttcccccccaacaccagggttgtgtctggctcggaggcaaagcagtcccatagctggcagggccgcagccagcacggcccaggaggggcccctttgtgttccactgtgtcccgtgtttacacttgtttgtctgcaagactggaagagcaagatttaagtctgatgccaggtagatattatctggcagcctccgctgggaatttccaggtacaaacacctctgtcccatatcttcaggctgttagtgacctgggtcctcaggtgtggaaaaattgagcgtttaagccattctcaggtcatcagcgtgagtcctgcatcttttagagagaaattgtgtggatgttcaagactgcaaatgtggctatatgatgagagcgttggccagaaatcgtgtctgctccgtggtcagtggtcagtgtcccccaggcacagtggcctggcagccgctctgtagcagagaccaccagcctgtcagtccgtacagctttccctggagggtcttgctggccccatgctcccggctggtgctggctccatgctcctagctggtgctgaccccatgctccgagctgatgctggcctagtgctcccagctggtgctggccccgtgctcctggctggtgctggccccatgctcctagctggtgctgaccccatgctccgagctgacgctggcctagtgctcccagctggtactggccccatgctccccccgtgctcccagccagtgctggcctggtggctgcaggtgctgcagtgcgtccagagccatctggaacctgctgggtggggggatgggtgtgggggtcgaccctgctgttgccatcctgcctcatttgtgtccgtctaatggcgaggccagggttgtggcacagacccccgagggtcctgtgtgtgcggaggcagaggcccattccatggccaggttttcctcctgggccacaagttactgcacctgcaacaggtgcggggcaggggtcgcctgaacattttccctaatgtgggtgggactcagaccaaagtgtatttatccgaggagccaggaccaagccctttcccactgctcccctgcctcccctctgcccaggtctctctctttgtccctccctctctctgtctctcagtccctctctctgaacctcttatatcacactttcaaaattgatggtgaatcactcaacacacagcttttatgcgctgagaaacaaaggcctccacgtattggaaactgaaaagcctttttccagccacgtgacgccactcccgtaggtgcctgtggatgtgccagctccgtgtgggatcgggtgggcgcttgcagggtgaggcagcttcctgggactgacacgtgccgtctgctctttccgtgcagatgaaatcatgcaccaggacatcgtcccgctctgtgctgccgacatccaggaccagctaaagaagcgctttgcttacctgtccggtgagttccagaagctgggatggggtggagagggaggggtctggggccgggtgtgggccgagcagcccccgtggcctggcccaggctggagctgggaagggtcatgcgaggggctgtgtattcactgccttgggtctgacctgtgacctggctctccccatctctgtgaagtgggcagctccatgccagttggcacatggccactgggaggaggtgggtggaggagggtcagggtccccagggggatgtggcctgggcacccctgacagcagcctccagggacagatggagtggtgtgtgggtggccgagcccatgggcctcagtgaaccccagttcctgctgcatctgggcacctcccaggccacgcctctgtccactgtggcctccagccctgcgtctggcacacctgtggaggtggtgcctgcagccatggggacataatgaggctcccagcacccctgtgtgggtacagcaagggcacctgcagtggccccgagctatgtagatgccgttcttatgtgaacaaatctgcccaacaggacccgtcagaaaaaacaccatgcacatgcatgcccaccctgggccatcagggtgccccgatgctgaggagggtgccccgatgccgaggagggtgccccgatgctgaggagggtgccccgatgccgaggacgcggtgctcttgggagctcagcctctgcccctctgcattcccgtcagcatcccggcccccaatccatggctggcacggtggggcctccatcccgcacctgcacctacagagccagcctgcaccccaggccgggccttggggtctgagggaggctgactgcgaggtgcagctggtgagttttatgagaccaaaatcgaagagacagccagcaacatgatggccagaggagaagtgctgtgcagtgacttggtccctgcttcccatggccaagtggcccaggaggaggaaggagagaaagcagggggtctctggagaactgaaaactcccagaggacaagggctccaatccccctgtgtcggggaccaggcgtggtgatggctcaagagaggcgccgtggtttctgccggttcctcctgcgtccccagcctctccccgcccctttcacaaccccaaagaggctcacagctttgccaccaggagggccccgacctgggcctccagccttgaccttcctccagttgccaggcagtgcccccaccccagcggtgcctgggagggcagagtcccaggacggccccagccacccaccttttctcgatcgttcctcagacgccagcccaggagctctgggggggattttgcagatgaatttaaggccccaaatcagctaactttaagatcttccttggtgggcttgacccactcagctaagcccttagaagagatggggctcttcctggcatgagggatcccaggtgcaagaaggatttgacacaagggggttctctgtgtggccccgaaggaggcagaggccgcctgaccaggacaagagccgccccacgggcagccgccaggaacccggggcctcaacactgcagctgggggcacagctctgccaagcccctgggggagctggagagactgggctcaggatcacagcccggcaacccctccacgtgggcccagagaccctgagcagagacccgcaagctgataagtgcctgagcgtcaatggtcttgggaaccacaccaaagcctccgtcggctcctctccctcctggaatataagatggagtcccctgtggtactgctgcccccgcgtcatatgctgcccccgcgtcgtatcctgcccaccccctggaggcaggctgcctccccatccccctgcctcccgccaacctcggggcctttgcacagccggccctctccatgcagcgaatttcttccgcggggcttgtggctggcccggcccctcaggccttgctcagaggcacgccctcgtacatgccctctccctcctcgcctgcgctctgctccgcccccttcgttacaccacctcacgtcctcccgtgtgtggcgtgggtccctcctgagggctgggtttgttcacagctgcctcccggcttctagaggtgcacccagcctcagagccatgtactgagggctcagccatgggcccatctggggtgggaccctggcacaccacgctgttctcaggatccaggtcgtagcagcagtaccacgtctgagaaggatcagtgtcggctggcgcttctcctgcagatgtgcgcggatttggaggaagcctgtggcagcctcgggtgtgtgcgttgccaatcgccccgtcccctcctcaccacgtccagcactgctgtgtcctgaggctgcgcctgcactccgggttcctgccatgaagcccccttttgtgtcctcatgacaaaggccatgcactgggggaccgaaacaactggggctcgtctctcaggttccgtggggctgtgccccttccggaggctcctcctgctttggggacgcaggtgttccttggtgtcccttggcatcttcatgcagccgcctcacctgtacgtcggtgtctcctcttctgcctcaaagcccctctgcctttctcccgggacacccgtcacgagatttagggcccaccgtataatccattatggtctcaccctgaaaactttgttacctctgctgcaaagacttctccaaacaaagtcatgtttacaggctcctgggacagggagtggacgtgcctttcaggggccgccttggactcagggtaaatctggctcagaggtttgctgtcttgacagctgccctcaagggggctcccctcccgccccagcatcacccatgggactcgctctccctgtctcgctccactcgaaggaaacacagactcccccgcccgccactcctgcacactgaccaccatggggctggggtccagctgggtgaggcccctcattgtgactggagcccacaggtcgacaccccagcctgttccgtggacttttgcttaattccctggtctttggatgcctggaatggcttccgtgaagtgccagagcaaaaaactaaagatgtcaggaaggaatggctccgaattttccttttcaagaggagactgcgtttctttccacttgccctgctgatttcccctccctgcgacgttcgtgccagccctgtgctgtctgccgcggagccatggctgccactgtgacatgtgcggtcccgtcttctccctccattgtctgtagacgcacaggtgccacgcagaaccctacagctctgtccagatcctggatccagatgaggcagcttttgaaaggcggccaagtgagggatgcgtaaacctcgggggctccggactcctgtacgttgccgcccaaagtcaggacgagctgcggaagtcacacctggactctgtgtctgtcatccgcagacagcagctccccattcagcctgtgtccctcgtaatccacaccctctactcacagtgacatctgccccaaaagcgcttcgcttaaccctgaagctacgagacctgccaccctactgtcccctctagttttctgacatttgaggaacaaggaattgggtgtaaaatcaggaaatatcctacatgtaaattcttgattattcttgtccttccgggcagagctgcctcctgagtcatccgtttgactctttcttactgaaggctgagggttggggggtgcatgggtgctccaaacccagaggcaatggcgcgtcccctggcatggcagtcggagcaggccccgaggaggtcgtggtctcagaactcagtccttgtgtcatcctagaaaagatacttcaacttgctgaccgtcagcaagagctaaaaacagggcgggagaatttaccactgaggaacttatgatctgaagtgaaaaacgcagagaacagacttgccaccggtgaaaaccacaaagctgaaatggaggccctgcccggaacgcagaggccaccgccactgtgcgtctcactccctgcaatggacggcggcccccctcccactgcccaggcggctcttgggaatttcgttttgcttttacgggaatgtggcatggtcagcggtggccatcagccatccaggaacctggatttgacaggattgctccatcccatgtccaggcagcctcaggtgtgtggagacagggcagacttaggagttcctcccctggcctgtgctctcctcccgggaagaacgctggagaccttcgtctcttctcctttcctcaccttccccaagcgctcgctgcacaagccccctcctgccttgccccttctcccaccccatttcggttttggtcccagcttacatctcgtcctaaggattaagtgtttgtgcagctgagccgcagttctcaggtgagctgcagggctccagcatggcacctgcctgggcagtcctgagagagggattcgaagtggggaaggaccccggagtctccctggcacgtggtctgaggctccagccaccagacccgaagctcagtctacactcaccaaggcccgacggctgctccaacctgggaggaccgatccgatcctgcgctccctgaggccgatggctttttgacacccaggcttcagccacagacagacagacgttccctgcccgtgggggtttgcccttgctggagagaaacagaaatggacagaaggtcactggggtggccctgggtgttctgcggagaatcaaagtcatgagacggagacaggaatcccgttaggtttgggcagagtcgcacgtgctcctttctggacctgcttcaaggaatccgatggtttcacgacatccaaccagttgctataggataaatgtttgtgtccctccaaactcagatgttgaaaccctaaccccagaggtgatgtttggggaggtgaggcctttgggaggagattaggtcatgaaggtggagctcccaggtgggatcagagcctttataaggggctgaagagaccagatctccttccgcagcatggccatgcctcaaggagacctctgaatggggaagccgccgtcaccagacaccaagtctatgggcaccttcatcttggacttacctggccagagctgtgagataaatttctgttgtttgggcctcccggcctatggtggtttgttacggccgcccagacagaccaacaaacagcctgtgtgaaaatgcgagccataaacgagtggtgttgacaaaggcatcctgtccaggtaggagttccgtgtggctaagtagtgtctagtttcagaatgtgatgccttcttgatgtcatctccacactggcaggaggaggtttttatttagttcttattttaagatttttctacccgacagttaacttaggatacagatgtcatagtaaattaaccactggaatgctttcattcctaagcagctcatgtgggtgagtttctaaagccgtgtttgggccgaggcatcacacaagagggtgtccctaagatgcatcacgtccgtggagaaaacaaagcaggacacacgtgtgagtcgtcacacccttggtcacccggcttggccgtcacacatgcctcctgcccaggacgcgtgtgcgtgtgtgtatctacctgtgtgtctcaactcaggctgcttgctgtgacaaagtcccctagactgagtggtttaagccacagtttatttctcttggttctggggcaggaagtcccggatgaaggcaccggcagatgtgctgcctggtgagggctcacttcctgatttacagactgcagccttctcgctgtcctcatgtggccaggcgagcagagcaagcccacagaatcccattcacgggagccccactcccacggcctcctcccctcccacaagccccacctcccagcactgtccccgtgggggtcagcatttcaacacatgaattcaggggaagacagacatccagtccataacagtgtatatgtgtagctgtgtgtatgtgtagatgtgtgtatgtatagtgtgtgcgcgtgtgaatgtgtagctatgtatgtttgcatgtatgtgtagtgtgtatatgtgtgtatgtgtagatgtgtgtatgtgtagatgtgtgtatgtgtgtgtatgtgtagtgtgtatgcatgtgcatgtgtagctgtgtatgtgtatatgtgtgtacttgtagatgtgtatgtgtgtgtatgtgtagctgtgtatctgtatggtagctgtgtatgtgcgtgtagctgtgtgtgtatatccatgtgtgtatatataggtgtgtatgtttgtacatatatgtacatatacatacctacacatccacatgcatatgtgtgcagctgtgtatacatgtgtgtgtaggtgtgtgtctagctgtatgtgcagctatgtatctgtgtatagctgtgtacatatgtgtgtgtttataagtagctgtgtgtgtaactgtatgtgtgtatatgtacatgtatgtgtgtataggtagctgtgtgtagctgtgtgtgtattaaactgagtgtgtatctcacactaaagcagatcccgtaggaaccacacttctttctggtgatggggatgagagggagttgcatctgccttctgcccctagcgagtggatgtaggcccagttgcttgggtgcgagagttcacatgcaggtgtgacaggtctcagccaggacagtggtttttggacgtgggtggggaccggaggctgcccctggtgctgtgtggacagggtgctgttctgaaccacagaggagcttcggagccctctgtcctctgcggcgttcagtccgcctccagttactaggccgggtgtagacacagaagtagagcctgttcttggtgccattggccccgggtcctggcactgcccaccttggtggggagggtttctccagagaggggctgtgcccccagctccgcgtccagcggtgttttgctgcctcataacctgcaggtactgggagctttggcgcctgcttttcagtctcagtggacagactgggatttccactcctgacttgggaagaaagaacagggtctttgctttgcattgaggctgtggtggagcacagagagttcagagatacccagggtagcagcagcctgagaccagcaccagctaccaactgaacgaggctgtgcggcccaggccaggcccccgtgcgatttcagctccgggtcacctggcccccatcctctcccctgggcagctggaggctccaggccttcctgtggctagctcctgccccaaggctgccctgctgactgcaccctcgaccctgtggctcaggctggcctctgggggtccccggtctctgtggttccagtgaggcagcagctcccagatgccacctccacactgtgggtgggccagccagtgctgagagggagccactctccacctctgtgtccaccatccactccaagctcccaggctgcctccacgttgtgtccaccgtccactccaagctcccaggctgcctccacgtttgggcatgaggggatcttgttgcatccgctcctcttcctagctgggccctccacagccagtgtaccccaaggagcagcttctccctcccacccacccccgccggccaggggtcctcatgccgtggcccatgcccatttgcacagggacgcagggggtctcacacacaggcagggtccgcccccagctgccgtcggcgtcactccacacacataggcttctgggcggtgctggaagcttctggcccctgaacgttccccccaggccccgtttcagggaaaggaaaggcaggcgcaggctgcggccgtttccacaatccacctcgtagctggggcgtgccgcttgcctcggcttgtcccggcagaacactcttacctttaatggcgactgaaaagttgccacgagttcctgatcattgtggtaggtgctgcgtgaagctgagacgtgcgtgagccacatcccagggggctttgagcccccaccgcggcggcggctgaggggaggcttgtcgtactcgcacaggaggacacagggctgcagtgttcactccagggcctcttatcattgggatctgaggaattttccgagaggaagtgcgaattaacaatgatgaaaggtttgtgagtgagtgacaggcacgttctattgagcactgcatggggcattatgtgccaccagagacgggggcagaggtcaagagccctcgagggctgggagagttcggaggatagaagtcatcagagcacaatgaagccagaccctgcagccgccttccccttcgggggcttccttagaatgcagcattgcggggactgagctgtcccaggtgaaggggggccgtcacggtgtgtggacgcccctcggctcagccctctaagagactcggcagccaggatgggctcaaggcatgagccctcaaaggaggttaggaaggagcgagggagaaaagatatgcttgtgtgacgtcctggccgaagtgagaacaattgtatcagataatgagtcatgtcccattgaggggtgccgacaaggactcgggaggaggccacggagccctgtactgaggagacgcccacagggagcctcgggggcccagcgtcccgggatcactggatggtaaagccgccctgcctggcgtggctgggcttggccaagacccagaagcagaagttccggaagctggagacagtggctgtggggggcgcaaggcggcgggggactgtcgctgttacgagacaaagctgcagttgtcggaggctgtgtgcaccctgggtcttctcagtgaggacgtggatgaggggcggcgaacccaccattatctgttctccataaaaagctaccctaaacttagttagcttgaaaagccctattttacagatttattcttcatttagtggctcagaagttccaaaagggctcagccaggtggttcttcactccacgcacggggcactgactgtgtcctctgctcagctgtgtcctcatgggggctgggctggaaggtcctgggggctgcagtcccgcacctccacctccctgccctttcacaaagtccaccctcaaccctgggtactggcctcctcagagcaggtggatgcagggtcgtgggaccacctgcccaatgactacagggcatgagagggcagctgcagtgttctgagtcccaagctcacttccgctgagtcctgtgggcaaaacagatcgcaaggccagacccaggctcgggggagggaaatggactccgtccggccaaggcagtgtggcagggtcagtggccggctccagcaggcagacctggagcccagcctgtgtgactccaaagtcagtgttcgaatggagctctttggaattgaattgcttaaaaggcgccaatgtcggagaagctagacgatacccacaaacagtacagttaggcaggttattagtgcacatgcatatatggaatattatgcaatatttaaaataatggttacattgtttaaaagcatggaagcggtttgttctcagtgtcaggaaggaggcaggagacaagcttctctatgcagtatcacctcaacaaggttaaaaaagcccatagaaaaaggcttggaaagaagcatgttgaattgtcacggtagctgtcccatggtggccaaaataacgagtgattgtctaaattcacatcacttttgtgtactttccaaatattttcttcaagcagcacacatttctttcaaataaaaattatgcaacgatgaagaacatgcctcagttttaactgaaatactgggtgctgatgaaaacgggccgacatctgtggaacccccgggggcatggagccctcggctaagggtctgcctctggtctctccccaggtgggcgggggcaggacggaagcccggttatcaccttccctgactacccggccttcagcgagattccggacaaggagttccagaatgtcatgacctacctcaccagcatccccaggtacgtgcacccagagcccggcagacattgtggtttggggcagagtccctgtgagatttcaccagggtggggtccctgcaactatgggatgaggcagagtccctgtgagatttccctgtcatggggtccccgtgactgtgggtcggggcagagtccctgtgagatttccccatcatgcggtccccgtgactgtgggtcagggcagagtctctgtgaggtttcatcatggtggggtccccgtgactgtgggttggggcagaatctctgtgaggtttcatcatggtggggtccccgtgactgtgggtcggggcagagtccctgtgagatttcaccagggtggggtccctgcaactatgggatgaggcagagtccctgtgagatttccccatcatgcggtccccgtgactgtgggtcagggcagagtccctgtgaggtttccccattgtggggtccccgtgactgtgggtcggggcagagtccctgtgagatttccccgtcatggggtccccgtgactgtgggtcagggcagagtctccgtgaggtttcatcatggtggggtccccgtgactgtgggtcggggcagagtctctgtgaggtttcgtcatggtggggtccccgtgactgtgggtcggggcagagtctctgtgaggtttcatcatggtggggtccccgtgactgtgggtcggggcagagtctctgtgaggtttcatcatggtggggtccccgtgactgtgggtcggggcagagtctctgtgaggtttcatcatcgtggggtccccgtgactgtgggttggggcagagtctctgggaggtttcatcatggtggggtccccgtgactgtgggtcggggcagagtccctgtgaggtttccccattgtggggtccctgcaactatgggatgaggcagagtccctgtgagatttccctgtcatggggtccccgtgactgtgggtcggggcagagtccctgtgagatttcaccagggtggggtccctgcaactatgggatgaggcagagtccctgtgagatttccctgtcatggggtccccgtgactgtgggtcggggcagagtctctgtgaggtttcatcatggtggggtccccgtgactgtgggtcggggcagagtccctgtgaggtttccccattgtggggtccccgtgactgtgggtcggggcagagtccctgtgagatttccccgtcatggggtccccgtgactgtgggtcggggcagagtctccgtgaggtttcatcatggtggggtccccgtgactgtgggtcggggcagagtccctgtgagatttccccatcatgcggtccccgtgactgtgggtcggggcagagtctctgtgaggtttcatcatggtggggtccccgtgactgtgggtcggggcagagtctctgtgaggttccaccatggtggggtccccgtgactgtgggtcggggcagagtctctgtgaggttccaccaggctggggtccccgtgactgtgggtcggggcagagtctctgtgaggttccaccatggtggggtccccgtgactgcaggatgaattagggtctctgggagccatcattgagttccccgtggctttgctgaggggttagagctttgtcagcatcatggttccgaggagctcaggagtctgcctcagatctgatctggggtccgaatccagctttttcgctcctgagctgccgttttttcctggagctcggaggcccacctggaggcccagttgctcagcagtcgggatctgacttagcctgagcgctgctgtgctccctcgtataccatcactgcgcatgcctgttcgatcagcagagttctgcggtgcgagggcttctgtgttcttaatgccgaggagcccatctgcacgggacctgatgctcatgggagcagagcccgtccacgtggcctctctgtgtcgtggtcaggccctgggggcgtggccgcctcctgccctttccaggaaagaactgaccccagaggtaccagaaaatccagttaacaaaaatggttccctcaggctgcagttttttgttttgttccagacagagctgggtccctgtcctctgaaaaggtagggagcccagttctgtgtctccccagcggcgggcaggagagcagcatcaggccggtgagctgcaggctgacttgggaggggtgccgcgggggtctctcatctgatgtgctcgtcccagcctccaggaagatgctgagaatgtcagcctcacaccagacagtgtagttgctgcttccatttggggtatagtgaacacacaccaagtaaaaacagaaatatccttaaatatggcatctgtatcccgcacattacataaggtggcaaaacacagaggagatgtttaaccatcagcgtgaaagtgcagccgtggccattaccgtgaaggttcttcattcttcagtctttaaagacaacagcgcactgggcctggtaactgagagctcagcccgtcggcctgacctggaaagcagcacattgatcccctgataaatatcacataaccaccagctggcagcagccagcctctgcagtcatgcctcaaggagagggagagcggtgggcacctctgtccacttggcgggttgaggtgggagctggaggagcagggagcctcaccggtgggcctttcgggggcaggacgtcttggtgggcagaaagaagggggctcgtgactgactatggtcaaagccctggacatggcggtgtcctggtagccccaaatcactgtgtgttgggtttgtggttttgacctcagtctcttgtctgttgtgagaatcttgcaccccctatgcgccaggctctgctggctgagctgagtgcacggaggaggggctgggtctcgggccgagcggccgagctccctgaggggctgatgggaccggcttggtggggcaaggctgcgatgctgcagacggtttccacacattcctccctggttctcagccacactgtggcaggaaggcagttattaagcccatgttatagatgaggcttaataacacggtgatggctggagaaaggggatggctgggcaggggagcgcccgaaggctcagaccacatggccgtaccccgaggacgtaggctccaggtgtgctgtggccagaggggtgtcctggggagggcggtcatctccaagcctccaggcctttgtctgtcacctgcacaggaggaagggcctgtgtcccaggggacggccggcctgacaggtacatccgccccctgatggcacctcctggcatggggctaaatgagattctgtggtgtccacactgaatgctgactggtcagactcatgctcagaaatcagggctgttgtcagtgcttgctacttggagccatgagctggggcgcctcctgtttgttgaaccttcctgtctcttttgtcttagaaacttcatggagtcccttagctacccacatccctttctcaagatttttctagaatctgcggagttccttagctacccacatcccttttcttgagatttgtctagaatctgcagcactcaaaggccacccatcaaggccataagagtgtggtaggcggcacgtgttcatgtgtgcacgcctctgtttatccgatgttctggaaccttccatggcctccttgctgctgccccacttgtctgtctgcttctcctgagatccaggaatctcagatgggtccagactcctgcaggacaagacccactcagccacctctgtagattgcgcatctgtgagtcgcacagcctggtctggctgaaggtggccggagcgcaggcccagtccccgctgtggacacgcgggccccaggttgctcagaggcagctccatggatccccactgttcacctgtgtatggaaactcaggttttctggtcacacttagataataaaaagtggaagaggcctttctatcaccaaacgctctaaatcagatcctggaaatgccagcttcattcagccatgagcagtgctgctgaccgtggagctgtttcccccaccagactcagtgtgggtgtctgagtgtgtggtgtgagtgtgtgtaatgtgagcctgtggtgtgtgtggggtgagtgtgtggtgtgtgtggcgtgtgcggggtgtgtgtggggtatgtgtggtgtgtgtgtaatgtgagcatgtggcatgtgtggggtaagtggtgtgtgtggtatgtgtggactatgtgaggcatgtgtggggtgagtgtggggtgtggtgtgtggggggtgtgtgtgagcgtgagtgtatgcgtgcattctacccacgtttcctttcttcccaggtaggtctcatcagtgtcagacccaatgctccctttctatctggaaataaaactctttgataacaaaacccaacctgtgtgaatttgggaggacgcccatgtgccctgatcagaaggacccacagaagggaagctgcgggcctgtaagagccacctgtcccctggctgtcccggcatcctagggcgcagcagccgcggcagctcccctggatttctgtgagcacggggctgcaggcgtgctgtggggaccccgtgcctccagggtgttgccattgagcatgtccttccagagagagtgaacaattcttgacacatttctaagggaaatcttcttcctaagggcatctacgggatgccttcttgagaagtgcagagtgtgttaaaaatgtgggggtcaatcatggcctctgcagataaaaccagggtccctgcaagccttgcaggtgcagcttggcagaggggaccgtcccagaggaagtctctgcatccctggcgagcaaaattgccaggctagtgacaaggaggagacctgcccactgcgccctgagggtgctgtgtccccgggaagtaccctctgcgggggaccctcttcccaaggtgggggcggggctgccctctgctggagacgcggagcattgcggctcggtcccgggacatccctgggagaccaagagagggaggggagcttggaccttttcttccaggagatggtggacgagaccctggcacaggcggttccccagcacgcagtttccagacagctgcacagccagcacattctttaagtgggaaaaaagtgaaattgaccaggcctgttctttcacatgtcaatgcaaattaaatggacaaatctctcgtgaaggctgcttttaaggggtttcaactgttacattctaaaccaagcatcacttttatcaatttagaaagaatgttgtattctaattttaactttccttctgttttcatatgcaaatgccaggtgtcccaatttaagcactacatctgactatactcatcatttttggaatattagactgaaataggtttgccccaaatggtttggggcacctgttaatataaaccaagtttttggtccttggaaagacgactcatcagggcgaagggggtgagctcgtgctttgctgactcaggtgtctgccgacgcccggtgtggactctcaggtgtccgctgacgcaggtgtggaccctcgggtgtccactgatgcaggtgtgggccctcgggtgtccgccgacgcccggtgtggaccctcaggtgtctgccgacgcccggtgtggactctcaggtgtccgctgacgcaggtgtgggccctcgggtgtccgccgacgcagatgtgggccctcgggtgtccgccgacgcccggtgtggactctcaggtgtccgctgacgcaggtgtgggccctcgggtgtccgccgacgcccggtgtggactctcaggtgtccgctgatgcaggtgtgggccctcgggtgtccaccgacgcagatgtgggccctcgggtgtccgccgacgcaggtgtggactctcaggtgtccgctgatgcaggtgtgggccctcgggtgtctgccgacacaggtgtgggccctcgttcgtcagagggcaggttcggatctctgaaaaccctatagcccttcctactcctaatggagctccatttaaccaacatcggccaggccttgataggagccaaggtctcagagaggcgatagagaccagcgacaagcagattccagaccctgtatggcccccttagaaccacatggccggggaggagatgcacaggtagacggtcagacctgtgtgtccaggcactgcttgctgagaagtctcagtggtcagcacacactgggaacacaacagcaaataaacagagaaaattgtggcgctgagacaatatgtcagctatggagggcgtacagggcagcagggctgtgggaaaacaatgtgagaaagaaagagagacagagagacagagacagacagatacagacagagagacagagacagacagatacagacagagacagagacagagagagacagagacagagagtgacagagagacagacagagacagagagagacagagagaagagacagagagtgacagacagagacagagagacagagacagacagagacagagacagagagagacagagagaagagacagagagtgacagagatagagacagacagacagagacacggagacacagagataaagagagcacgagggaggcagagggcaggggtggcagcatcactgcagacaaggaacttaatgtaaactgggaagcattcgtcacagagatcccaggagggcgccagcggcatctttgggggcagcgaacgcaccagggggcaggacagagtgccggggagtcgggggctgtagggacagagtctgggaggtgagacagggtctgtggagccttttctgaggagctgtgttttctgtgaagtgggtgccaaagagttcatgagctgccagaatgcagggtggagggagaatgcggggtggagggaggagctgggagatggggaggagggcggcggccctcagagaagggacgaggtgggaagcctggagcttgctggaggagcagtgtggaaggaattcactgaagctgatgatgacgcttactttccatgggcctggctcaaagctcccagctccttgggaggtagggactccatctaccagccagcttgccgggacaggggtcacattcagcccataagaggcatgtacacatacagatgcacacacgcacctacacaggcttgcacatgccacacacacacacacacacacacagatgcacgcagacacgcaggcactcatgcacttacatacacagatgtgcatgtgtataaccacacacgtgcgcacacacacacatgcaagtgcatgcatacccccccacagacctgcacatgtacacaccacatgcatgcacagtttgtgtggtgtatggggagggtgcatgtgggacgcaacagaaacacgaatgtaatcattaggcttccagtcaagaggagagtcctcctatctcactgattctaagataagcacctggagccaactcggtttgtcgtccccctgcggtgacctgagcaccctgtcctgctgtctgagctggagggcagctggaccccagcccttggaagagccccacttctcgctgtgggtttgatttcctattgaactttgaattggcttttgaatataaggacaggaagtgtctgtgagcgtgtgtgagcgtgctaaacaatttaatacgtgtgcattaaaaagtgaagcttccacttcacctcctgcttccctcccccacagctaactgtggagctgcactggggtgacacccaggctgttcatccacgtgtggtgggacagcacaggacatgccgcctcgcagcttgctgcttctgttcagcggtgtgtcgtggcgcccttctaccttggcgccatttgctgctgcctttcattttatatatttttttttcatgttttgagacagggtcttgctctgtcacccagactggagtgcagtggcaggatctcagctcactgccacctcaacctcctgggcccaaggtgatcctcctgcctcagtctcctgagtagctgggactgcaggcatgagccaccacacccggctaatttgggtattttctgtagaaatggagtctcaccatgttacccaggctgatctagaattcttgggttcgagtgatccacccaccttggcctccaaagtgctgggattacagatgtgagccatcgtgcccgcctgtgccttccttttaaaggcttcctggcccctgtgatgtaagcggacctggtgtgctcacttgggctggcccccgtgacgtgagtggaccccgtgatgtgagtggaccctgtgatgtgagtggcccccgtgatgtgagtggcccccgtgacattagtggaccccgtggcgtgagtggcccccatgacgtgagtggcccctgtgacattagtggaccccgtggcatgagtggctgccatgacgtgagtggcccccgtgatgtgagtggcccccgtgacattagtggaccccgtggcgtgagtggcccccatgacgtgagtggaccccgtgacgtgagtggcccccgtgacatgagtggcccccgtgacgtgagtggcccccgtgacattagtggaccccgtggcgtgagtggcccctgtgacattagtggaccccgtggcgtgagtggcccctgtggcgtgagtggcccccgtgacattagtggaccccgtggcgtgagtggcccccgtgacgtgagtggcccccgtgatgtgagtggaccccgtggcgtgagtggcccccatgatgtgagtggcccccgtgatgtgagtggcccccgtggcgtgagtgaccccgtgtgctcacttgggcctgttcgcgggcatttcgtggtccccactgtttccctgttggggtcactgctgtaaagggtcgccccgccatggtgttctgtctgtgagattgtgccctgtttctggcagttctcaaatgctccagctgggtgatttcccccccccaccccaacggagttggcagtttcagggctacccttgtctgccatctctggctggcctgaggctgtgctggccccggtcgccctccatggtctgaagccctgagtggaagctctgccacccacagccagcctcgttaggaggaaccaggagacatcacgcggcccaggtgtctgtgcgctgtgctgggtgggaagccacctctcaggtgtgtttcccgtctccacatcagcattttgttcatggagtctgctgcttctgagcactggggacaagtcgcggaggccctgccattccttcctccgggttctgcacgcaccgcggtgaccacctccccccgaggtcctctccccgcaccttcccaaaacgtgttccccaggtccttttctgttactgctgttgaattcaacagctactgaccacctgtggccatttaaatgtaaaatgaaagcaaaataaaattaaaaatccagcccatggcaggcagggctgcctctttttttttttttttttttggagatgcgtctggctctgtcgcccaggctggagtgcggtggcacgatcttggctcactgcagcctcaaccttcccagctcaggtgatcctcccacctcagcctcccgagtagctgggatgacaggcgcatgccaccacgcccggctaatttttgtattttttgtagagatggggtttcaccatgttgcccaggttggtcttgaactcctgggctcaaatgatccacctgcctcagcttcccaaagtgctgggattactggcgtgagccaccatgcccggccaggcagcctcattttcattcacacatgaccaatggctgcttattgggctgcacgatggttatgctggctccgtcctggaggagtgagtgccctcaccctcaccctcaccctcgccctggtctcaccctcgccctcaccttctccctcgccctggtctcaccctcgccctcaccctggtctcaccctcgccctggtctcacccacgccctcgcccttgccctggtctcaccctcaccctggtctcaccctcaccctggtctcacccgcgcccttgcccttgccctggtctcaccggcatgagcagaaagacaaggcccggggttgcagtgtctgtgctcagggtccagacacagctcagaaccgaccttccttggggagtgacagtccccggaggttaggggctgctgtggccaaagagccacagatcggaggtgaggaaggtctgcccgaggtgaggaaggtctgcccgaggtgaggaaggtctgcccgaggcaaggcaggcccgcagtcccgggcggtggcatcagggtgagcgccctgatagcaagggacctatggcgcccacaccggagggcgggaaaaggaggaagagcatggcccccgtgaagcccctcgggaggaagggttcctgtccacgttcagcacccccgtgcagacctcaccattcccgacgggaacacttgtgatattcacttccaaccacacgagggtgcagctgggcaaccgcagcttttggaaaaatgttgaaactggggcggcttctctgggtgactctgacgctctcattgcttcacgtttaatttttgtgtcctgctgtaactaccatgtagtgcacttatgaatcgtgcatattttactctaaggcctgtctgtaaaccctaataaatgaccctactcaggtaagacgtcctgacagtgaggtttttaatatttacaagccacagaattatttcctgcagccacagagacttccttggcgggaaaccaggtcctctgacctcacccggctctgcagtctgttttgccgttttccgcctcaaaccccctctgcgatgtgcagctctgggtgtctgatccctcaggggtcctgtctcccctcctctggccccctccctggctccttcgcctgctgcctttttcttccatgaggatgcggttcccgtgtcccccaggacagcttcgtggccggccgcctccatggattcgggtgggcacaggtcctgcagggagctcctgtgttatctgccctccccgcgaagctccttggaggatggagattttaaggtcttactgtggtgtgagcgatcagagaccccagtgtttaccaggtaggctctgggctcagaccccagcgccccacttgttagctgtttgaccctggatatgtcattcacttctgcgttcctcagtttctgcacgtttaaaatggcagaggcccctttggtagtgagtctgtgtgacaggcgatggggccttcctctctggtacagcaggggcctaagggatgtttgacctcagcaggtagagtatcatctccgtggtacagcaggggcctgagggatgtttggcctcagcaggtggaggatggctgcaggtcaggattttgcatcacaaacaacactgctgcagtcacattagtggattttgttattatagacaacactcgtgtctataattccaaggacccattctccatgcccagaggcacctcagtcccacagaccgcagcctgattctgagttcgcagttggccagtgttgcagaagctcacagaggagtctttggaaatgagaatgacgccaccattctcttttaattgtgtcataggtcttccttccttttatacataagttaactgaggctggtttgctttccacagccagagttctaagacaattttaagtaacacttttctttcgctatttctttatgaatgtgttgggttttagggatcacagatgtgcttgggcaaccaaggctgcctgtgtctctgtgctctggggggcttttcctacgagctttgcgtgagatgccagctgcccacaggcaactgggcacagagagcaggagaataaagcaggccagggcatcaggtggggctgattccatggagggcaacggcagtggtgggggcaagtgcggggtgggtgagtggcagcagccacccacagaaggacgcgctgtcccggccccgcatccccaggagtgcgtgtgtcgcaggcgaccctgtcctctcacccaggagccctctgagctcgcgcctttcttcaggtgtctgcgatatcatgctccccttgtgttcctcctgcctcctggctgctgccagtgggtggccccccaactcctccaccagaccctgactctcagaggactccaagcctctatttgtgttattcctatccagtccatggggttcagataccaagtggaacttttaacaaccatgaattcctaggcctcactctcaaatcatcacatcagaatatccaggagtggcccgagaagacctgcgttgtagcaagctcccggatgtttctcttgcatccatctggcactggtctgcacactggtgtttggaacccccagacttgaacttagtgccgtgcggtccagcggccctcctgtccatctcagtgcagagaggggctgggggaggtgcaagcgtgtcatcctagaagaattcctctcgactaacagcctgccgtgttcttggcatctgtgcacagtggagccccacaagctggctgaacccttggcttgcgtcctaagctctgtgtgctgttaggatgatgataacgaccacgatagaaagcaccttgctgagcccctaggagtagaaggtggagggcaggccagggcagagttgagctagacagagtgaagaacacaagttctggggaagcagggaattgtaaccaaagatgaaaccacccctgcccagcggcaccatttgtagggaccttggagagttggttgaacatctgcagagcatggggtcggagactcaggtcagactaaactggttcagagccaggatacccctttcgacctgggttacatttgtcatcattcatgtaaatgtttctgttagatggaaacaggttcaaaacccactacctacttccattctggctctaatagagtatcttgtagccaactgatatttccacaaagagcaactgtaaaacctgggtaaaattttgtttaaaaatatgtttgagggattgagaggctgcagaggcagccaggacttggggagccaggttctggaattttacagaggtgagccccactttctgcatttcatggtgaggtattgaacgctttgccgctgaggtcaggaacactgttctcatttctattcaggattgtgcttggaggtaccaggcagacaacaagacaagaaaagaaaagtcttaaggattgaaacagtaagaaacacaggtatcattcattatttgtagacaatgtggttgtgtatgaagaaaatccaaattaagtaacagtcagactcttaagctgagtaagtaatttagcaagatcaatgggcaggggtcaatatactaaacttaattgtattttagtatttttatatatatcaatgatgtacaattggaaaatgaaatttatagatatcacttataatcacatcaaaattgagtacataggaataaaatcatatctaataaaagacgtgcaagacttctaagcagaaaactgcaaaatgttattgaaagaaattaaaggggccaggcacagtggctcatgcctataatcccagcactttgggaggccgaggtgggtggatcacgaggtcaggagatcgagatcatcctggctaacatggtgaaaccctgtctctactaaaaatacaaaaaattagcagggtgtggtggtgggcacctgtagtcccagctactcgggaggctgaggcaggagaatggcctgaacccggaaggcggagcttgcagtgagctgatatcgcgccactgcactccagcctgggtgacagagcgagcctccatctcaaaaaaaaaaaaaaaaagaaagaaattaaagtagcatgaataaatggaagaatattttagttcacagattagaagacaattagtattataacaatgttaattctctctaaataaacatatagatcgaatgcagttcccaaataaaattccagcaggtttttctttatttaggtgtgaacattggcaggctgcctttacattttatatgaaaatgcaaggggtgaggaatagtcacccaactttgaagaaaaaagttgaaagctgatactgccaaatattaagacattattaaagtgacagtgattaacacagatggtgtaaacagaagagcagcagcacagaatattgaatccagacagaccacacatctgcagtctcttgatttatttattgatttatttatttatttttgaggcggagtctcgctgtgtcacccaggctggagtgcaatggtgctatctcggctcactgcaagcgccgcctcccgggttcacgccattctcctgccttagcctcccgcatagctgggactacaggcgcccgccaccacgccctgctgattttttttgtatttttagtagagacggggtttcaccgtgttagcctggatggtctcgatctcctgacctcatgatccgccctcctcagcctcccaaagtgctaggattataggcgtgagccaccgcgcccggccattgcagtctcttgatttatttcttaagtgatactgtagcacagagggggatggacgtcctcagtaagaggagtggatgtgattggctgtctgtgtgggaaattatgaatgctgatacctgcctcacaccatatacaaaagttaattccaaatagatcacaggtgtaaatgtgaactctaaagtaatatagtctctattctcgacaaacataggaaaatgcctatttcagagtaagaaaagatttcttacgcaaggtttaaaaagcagttatcaaaaaagcaattatcagaaaggaaaaggtcagtaaattgggctacattaaagttaagttactcttttcatcaaaatgaaccatgaagagatcgacacggaaagccacagtgtggaagcagatgtttgcaatatgcacatccaataagaaacttgtttctagcctatacagagaactacacaccaacaagttaaaggagaatctagtagaaaaacaaccaaaagatgtgaacaggcatatcataaaagaggatagccactagacacagaaggcttcctgcctctgggaaatgccaattaaagccatatcaggacgccactctgtatccacaagagtggctaaaattctactgacagacagtatccagtgctgacaaaaccatggagcaaccagaagtcacgtgcatttctggcaggtgtacatttgtccacatctacataattacagcaattcctaagaatatgtccaacaggagtgtgtattgtgtgcactagaagacatgtataagaagctcattgtcttatgttcagtttagccccaaactggaaacaacccaaatgtccattaagagtagaatttattaataaatcatatttcatcatatatgtataccataacccagcaacaagaatgaacagacaccctactgcaacaacatgggtgaatcccacaatgttgaaagaagccagacagcaaaaaagcacatattgtatatttttatttggacaaaattcaacggcaggcaaaactaatgtatggtgacaagagtcgggatggggcaccctggacggtgggaacggcctctcagtctgggcactcgctgccgtcactcacactctgtgcttctgcatgatgtgcattataattggacaaagtattcacataaagaatggtgtcctccaaggaaaagaacttaggtgccacctactctatcccagatgggccaaggtaaccgagtcgcactgtgcagggagggccttcctgtgtgtgtgtgtgtgtgtgtgtgtttcttttcctgaggacacagccaccctgctgtgcagggacccttctcccagactcctcttctcatcttgggtgcaggttgacgtttgagaagcaaagacaccaagggtccccttcctcccacccaggcctcacgtcccctcagcgcctcctggccacgcactgttgattcctaaggtctgctgccctctgcaagcactgctcctcccgtgtcctggcctccacctgcccctgccctgggacaaagcatcctcctcgcccccaccatgtccacgcagcagaggcagatgtccaggcactgggggaacgtggtgctggggcctccccgccccactggtagagaggagccagcctctgcttgcagaccatccctcacgctctgctcctgtccagtgagctgtggttgcacccgcaggccagtgggctgtctgcccacatgggtgggggaccatggggctcccaaggtcacgagccctgagtggtttgggtctctgtcacagaagacgcagccagttggaacattcctgaaactttatgagaccgctgggccttttttacttatttgggccaaaagtgagctcattggcctcaaactcagctgctgggaaactggccagggcagcccctccaaggccaactgttgcggagttggcagctgatggggcatctatgggctgtgtttgtgccctgggtgcgagggacatttctggggtggctgccagcttgagttattctaccccaactcctccggcaccatcaccttcatccctctggtgactctggggactgcttcctgctgaaactgggcagaagccacaccaccctctccctcagacacaggccacagatgtgggcatagatccgagctccgtgagccctgggtcctcactcctgtgagcagatccaggtcctgcctcacggttttgggcagtgcagcctcgggaatgccatgggccgtgggggggcggggaatcacgtggccctgccctcatgaccacagtcagtatgggggatcatgtggccctgcccccgtgaccacagtcagtatgggggatcacgtggccctgcccccatgaccacagtcagtatgggggatcacgtggccctgcccccatgaccacagtcagtatgggggatcatgtggccctgcccccatgaccacagtcagtatgggtagaggaggtgctaggggctctttacatcctcacgtcagaggcttttttagtccaggctttgcaccttctgagtcagtgttcccgaaatgtggtaggagaggagacatggggctgagggggtgtggacgagtgtccacctgggccctgcatagggggcaaggtcgtggtgggggctgcgcagggcaggaggctgagtgctggtgtgtgggcatctggggtcaggtccctgcttggtgggaacattaggaggccgccagggtggacgtggccttaggggcagcacacgtggtgtctgagccaggttcccctgtccgtgctcacagctatgtgactttgggcaagtgactaaagctctctgtgcctggagaggatcatagcaccagcctcacgggatggtcgctggagcttgatgaatagctgtagggctgttggcacagtgcctggtccatagcacagctgaggatagtctctaaccctgaagaagcatgcctcctgcctgcaccccgttcccacacatgccctgtgcccgcaccccgttcccacgcgcaccctgggcccgcaccccattcccacgcgtgccccatgcccgcacccacgatggtgagcatggctggggcaggaggaaccagcgctgccttcctgcccaggacccacaccttctgcagctgagcgacagtgactgccccattaacaccacctggaaaccagtccgtccttctcgttgagaaactgatttcctagtatgcattttttgaatcgaataaatttatgacaccttagatttcacttgcaattttgacttctaaaaaatgttttagtcgttggtaactggtttctcattgaaaacggatgcctatttgtgatactggtgttcccattacaatgtaacacaaagatttaaacgtagagtgagtggaagccccacacaggcaggccgggcggcatccagtggcatcgggcgcctttttcgtggctgcagcgtcagcctgcactgccgggtgtgaggcagacgcgcacttaacggcgtgagaagccagatgtgggaggcaccgggcactgtgggcagtgaggcaggagcttggccgcgtgtggggcagaagctccatggctagaatgggatgtgtttgggtcacgggtctgggggagggtgcgttctggctataactggatgtgtttgggccacagaggtctggggggtgcattctgcatccagcagctctcacatggcagtcgtggtccccgttgctggtctgggctgttgtggagtagcgggggcatttgtgggcgaacccagaggctgaaattccaccccaatcagagctctattccagggaaaaggggagaaattgagtcaggctttgttgttctgcaaaacagtgacgccgctcaggcagcgctgcgggttacagcatactcagtggcttcatttcactctcacggtaaccgctgggggtggattctacgattgtcctcatttttacagaaaaggaagcagagatggttcacagccaagtcacctgtccagggtgatgcctttgcggggcccaccagagcccgccagtgtcgcagaggcggtgagcccctcccgcccaacacacagccccttggcaggggctcttgagcaaacctgcaggtgggcagcttggggcgtttctcagctagcatcacccctgcttcaggacttgaaagcatttgactgggttcgctggcctgaggattacgtgctcggtggaaattagtcattctgggctcttctctccttcactctaggaggactgggacccagagagctccgggatcagctccctggcttggagtccaaaggcagctctgaccacgccgcctggggcaagagggagggcagctgggttccatctccgtggcctggcacatccaaggtccctttgtggaaaaggcacgtgtagcacctgttactggaggataacctgtaactttgtgcctctcccaagggagcacacaggtctacacgggaagtaagattccctgtacccactgtgtctcacagttcagaaaaagtcgtcaaagtgctcagactcaagaagtaaataaggaaatatgaaaacatgactttatttctttctttttttgagacagtctcgctctgttgcccaggctggagtgcagtggcaccatcacagctcactgcaacctcaaactcctgggccaagcaatcttcccacctcagactccccagtagctgggaccacaggcatgcgccaccacactcagctaatctttgtatttttcatagagacagggtctcatcatgttacccaggctgatctcgaactcctgggctccagtaatccacccaccttagcctcccaaagtgctgggattgcaggcgtgaaccaccacgcccagctgaaaatataactttaaaaaaaatcttagctccgtaagaactaagccagatcagaaaacgaattctgtctgtggcccccacagctgtgaaatggagtcgctgactcgccatgctcgtgcacgtgcttagtgcccactgcagaaggctgctttgaatgaaagctagtgtttattcgtgtactcacccagaaggtttctgctgttattgaatcaaattaccctacatgtgaggcatttttcacggccagatgcagacagggacacagacgcagcagcacccaccacacatgaacgttcgggggtcactgcctcgtcttcatgtcttgggagttgctgtttctgtctttaaatccgagcgtcagaaggatctgagacacccgatataaatccctggcttgttaatgatgctcacagagagcggccacgcccatagactgcataatttatctccatcctgcagaattctgattttcatgtaaacctaggacatgttcagagacttggaagttagcgattctagcccctgccttaggcatgcccgtgtggttgtttctgctttggattggctggtggtagcagctgctggcatcacgcaattggcttggctgcagagtgagcccacggaagagggctctccgcaccgactctgtgactcaggcttctactaccaggctcatccgaggacggaggctgtcgttatacaacgcgcaagtgtggtctctgtcacagatgtggctgtcgcagagagtgctgcctcctctcccgtttccagcagatgcttgggaaccttcagaagtcttggggattttctcccagcaccgtagccatgccaccacgagtgaatccttaacgtggaccagcacgggcacctcagatgccaggaccggcgtgatgtatgcgccataagactgttttggagggtttagtcagctggtcacccaggaaaggaaaatgactcggctcttactgtggaatagcaaatgactgagctcgggagagatggttctgcctcaatctgtgactcgaggtggttggtgttaggctgagaaataagaacacaccaaaagtgcctgcccttccgtagatgagagcaggttctgggactgcggggatggggctgccggggcccccgtgtgccatgcctctcacctggtattgcagaaatggcatcatgaatatgggggatcgctctcccaagaggttttctgagggatttcgtgggcagccggcttcccacctgcacacattaacggcggcgtctcttcctcactgcagcctgcaggacgctggcatcggattcatcctggtgatagaccggcgacgggacaaatggacctccgtgaaggcgtccgtcctgcgcatcgcagtaagtgccacccggggctctgccctgcgcccggcccctccctgggctgcatgaccgcatggtgcccttcctctgtgtctgccgcagttcctgctttgtgctgagtgggacagagcccagtcccggcgggtggaggccggcgccaaggccccccctgcttgggctcccaaggcactggtgcctgggtgtgagttttcccagatgaaggaactcttagggagcccaatgtgacttgcaaacaatttccccaggcagagcagcccatatgtttccgaacaccaagtctgagatgctcgggactgaatatgcctcttacatatttatacattagtgattttctcctttccaaatcgggccatctatctttagctgtgacactgaacgagccaccaccgcctcccttccccagtgggattgaacatgcacttcctcttacacaaagcacaacagtcctgaccaggcaggacgggggctgtgtgcagagacgctccaggctggaagttggaagtggtactgcacagctttcctatgtgattttctcctttccaaatcaggccatctagctgcgacactgaactagccaccaccgcctcccttccccagtaacccagcctcgcatgtagccaccctcctttccaaggactttcccttggcatccgagagtctgtttgcagattctgcacgctgccttccatagcagaaggggagctgggtttgctgttggttttaacccagagtaatcatttaagagggaagagattaagtcagcagaagcccccaaatcttatttttgtcggtagctcccacccgtatgcatgaccccggcatggagcatttttcacccacgctcgctctccccgcctgtccgtccaaatttcattgctgccaaaggaccaaaaaaggctgcctgtctgccaagaggtgacccagagcctgggtccaggcacctgcatgttctcacgcccgccacagcccgtccctcccaggctctgggaccctgggtcctcagctgtgatggcacaattgctccaagcattccccagcaccaaaccccagtgaagtcagattctcccagtgaagtcagattctcctggcctttcctgggtcccgcgttcagactacctttgggttccccagcctctcggtggctgctggctggtgcgccaaggtttgaggtatactgaaaaaagtcattcctttccccgcacattgcctcattccttcatcttttacaagaattagaggccccatatctgctccgatgcccacaaccttcatcgttttggtgcaagcctgtccctgagccgctggttctcatcgaagtctttaggatgaggcatctccttgcacccccacggcacctctctgcccctcgccgcggcggatccccgttcctgaccctgactcaacctggcacacaccacctatggcatcgttatctgaaataattcaaaacgcttcaggatgcttccaaaaaagtagacgtgtatagaatcggtcttcctttgttttaacagtgcgttcgtttgcttttgcgtcactataaagacgtacttgagctgggtaattgataaagaaagaggcgtaattggctcacagttctgcaggctgcacaggcttagcacctgcatcttctcagcttctgagggggcctcagggagctgccagtcgtggtggaaggcagcggggagccggcatcacatggtgagagagggagcgagagagaagggggaggtcccagacttttgaacagccagatctccagtgaacttactgagcgagaactcacccgtcaccaaggggatggcgctgagccattcataaggggtcacgcccagacttaatcacctcccaccaggccccacctcagcactgggaatcgcatttcaacatgagacttggaggggacaaaaatcccatccatatcaagcatccccagaaatgcagaaagttctttagataaaagccatcaccagctaacagccatgtgtgcctttcattattgtacgtcttaaatgagtttgcacatgaagtcataggcaactctaaaaattaaatcataagaacccacggggtcagacacacatggacggacaacagatactcttgggaagcacccatccgtcctgggcgggtcccacaatgctcccagcaggcacgtcgtcgtttaaacaacagacaacaccgttacagccgcatcttttatgcttacctgccgctgatataaaccagccatcaggacgactcttagcaacacgtgggtgtaggagtcggcctccctgccagggcacttgcggtgtcaggacgcacctgggtgcctttcatgcccgtggggtccaggcacctgcatcttcacacacctgccacagcccgtccctcacacggctcatgcctcactacatgtgccccgtcccctctgctcacgcctcgctacgtgtgccccgtcccctctgctcacacctcgctacgcgtgccctgtcccctctgctcacgcctcactacgcgtgccccagagcctccgctgatgcctcgctacgcgtgccccggcccctccgctgacgcctcgctacgcgtgccccagtgccctcgcacacacatcaccacgtgtgtgtctcagattaatcagtcactcccgggttagatgacaagagcttccccagatacgaggttactttttaagaaatacaaaaatcattttctaaaagcaaagtatttctgcgaggtcaccctacaggatagcgaagcagcccacagcagacccgtgatttaggtgtcgatcttcagctgccgagtgtcctgttccgttcaccgagtgtgtgatcggatgaatttcttaagcaggttggctcatcttgaaagctctgtcttgtgagcatcataactgaacagttagtgttttagtttttatttttgcattgattcttacaccataaaaatatggctttttctgtccttcctttaattctcagaattgaccaacattggtttggaagtaacagaagccagcattttccagcaaaatcacccagaattctctctgaacaccagtgctttcttgctataataatttacggtctttttttttttttttttttttgagacggagtctcattctttcgcccaggccggactgcagtggcgcgatctcagctcactgcaagctctgcctccccgggttcacgccattctcctgcctcagcctcccaagtagctgggactacaggcacctgccaccacgcccggctaattttttatatttttagtagagacggggtttcacccacgttagccaggatggtctcaatctcctgacctcgtgatccgcctgcctcggcctcccaaagtgctgggattacaggtgtgagccaccgcgcccggcttatggtcatattaatacacagactctgtgtagttagcacgtcctgaggcttttctctgtcccaggcactgcctgggcatcacggatgtgagggaggaagtgagcaaggctcaccgccagctgggtgaggacagttgaggggcatcacaatggggtcacaggcaggggcagcagggagcagccaggagggtggctgagccatggggagggggcagagttaggccccacatgccaggccccatccacctgggctgtgaccctggagagggcgtcttcctgtccccaggcccctgctacccaggagcccgccgcctccagaagggtttggtgcaggaggggcatgagaaaccggcaggagatgatgatggtggacattggatgggccaggagacatggagctcacagccctggtttcatgaaggagaagtgggccacaaggccaaggaggcaggaggcgggcagtggtggcactgtcataggagctggttgtgcatgtgctgaggcttagagggtcactggtcaagggagtgagggcagctgtggacccagccaagcctaggtcctgggcagaccaggaggggtgagggtctctgcagtggggaaggggtgggtggtggggctggcggggaggccccaggctctgtccatgagccacgcactccttggagagggcagaccagggatgaccccttgggcatcttgattcagttttttggaaatggtgcagttgacctgacgtggggacaccaagtagtggctgcagcggggcacctggacgccaacccctgggctccaggccttgacagcgagctttggctggcctaggcttccacctaaagtggctttgggaaaactagcacttagcaacagtccaggccagccgagccctcaagcaggtttccaaacaggcacaggctccagctgcccgaccccaccagggtgcccagctcatggtgctgcgggcgccacaaagcaagcccgtggcagagacttgcctccaagcgctcggccaccgaggaggacgcagcgcttacataatgtgccgggatccggggctatttttagccaccatatgtgctgtcttaagagctgagctctccctaatttggggtgttcttttttcttttctggatgccttcagcatggcttggaatagaaaaattagacattggaagagccaaaatccagtgttcctaaaaccaggctcccaatcgagagcaagacccatgtgatgctgagggcgtgtgggagaaggataggttcacagctacccacccagggggcagaaagatgagatcctctgagaactcacgtctcttctcccttaggcagttgtgcggtcctcagatagaagcatcttttataaaatgctgttgcaacatctaaccctcttccactgtactgcatgtgtgagtgtgtgagtgtgagtgtgtgactgtgtgtgtgtgcgagcgagtgggagtgtaagtgaatgtgagactgtgtgagtgtgtgagtgtgtgcgcgagtgggagtgtaagtgaatgtgtgtgagactgtgagtgtgagagtgtgtgtgtgtgagagtgagtgtgtgtgtgcgtgttcacattttgggaatttgtaatagagtatatatattcatgtttagagctagcctaaatcaaactaaatctagatcctcaagtaggtggctggagaaagtgaatctgatttttagactgcatggggccacaactctctttcctgtaacgccggtgcagtctgtgtgtgcaggaaaggtagaaaacaaggtgtctgagggaccccggacttctaggtcgtccagcaaatctttcacatttgcaaagtacgattgtatgcggcccccctgtgccagctactggggctctggggaggagctcaccgtgggggcggtgggggcggtgggagccgtgggggccggggcggtggaggggggggtggctgggggagcggggaggcgggaggagcagggggggcgggggcggggggggcggggggagcgggggggtgcggggggcggtggcggggggaggggggcggcagggggcggtgggagcggtgctaactccaggaggacttcccggcggaggtgatgcttggtgagagcctgacgggaggaggagttgtccagatggaggggggcgaggagcttcccctgggaacacaaagcagctggctgccgagggagagagggccaggtccgtgtgcccctctcggaagaggcgagaccgtcccccagggcagggaactgaaatgcgcgctgcataactgcggcgacacgggggtgggggacccagctcttcccggtgtggctgagctttctcagaacaccgctgctgtgtgcagcaagcacctgcccaggtgagcacagtccccccgtggtggacagaaggggaccaggatctgcaggctgtctcctccgcaccagctgctgtggcaaatgcgtttcagcgcaccctgcgcgttcaccaaccgccgattacaggggaggagctgggcttcggggcgacgagggaagctgccgatggggtggggcggctctgggggcggcctgggcctttctgtctctgaagcccgagctctctccctactccggtggtcccagggccacggcggtgggcggtgccggtcatgcagaatattgcagggggaggcagcccgtgaggcttccacgacgctgagagcgtctatttaaacgactgtccttcatccgagggttcgctcctcccacctaagggtggatttgacagccttggggtatccagcaggggtgggagatccagaggccccaagcccttcttcactgtgtatttcctggaacatggaatccaagggtccaataacgggcggcacgagccactttgctctctctaaagacctcggaggcgacacagtgaataacaaggttgtcttagtccgggtctgctgcttatatgtcaagagtatctgaaactgggcactttacaacgaaaaagaattcatgccttacagttgaggagcctcacctggtgagatccctcttgctggtgggtcctgaggcgacgcgggacctcacctggcgaggggagagtgagccagcccagggctgcccccgctgcttacaaagccaccaggcccccacccacccccacgacagcccgttaatccgagaatccgtgaatggatgaatccattcatgagggtggggccgtcctgacccagtcacctctgaaaggtactgcctctcaatgctgccatgagtttcgaagtttggtagggacgaacattccaaccacaccaaatgtatatttcagaattgctaaaagaatccattttaaatgttctcagcacagaaaactggtgagtgggtgaggtgacagatcggttaattggcttgatttaatcattccactgaggatacctatagcaaaacatcactgggtgccccgtaagtagatacaatcatgatttgtcagttaaatgtagaaacatttttttaaaaagataaacagagaaaaagaaagagctctgagacccgggctcgctcagcggttttttctcgcagagaagaggaaggagcccgggggtccctgggaccaggtgcctcatgaggctccgtgtgggccgtggaccctgcaggccacgccggcttccctgactgataaacccagagccaggccttgccggtgagaggccagggactgctggctgagcttctccagcgctgctcttcactcccctggatgcctggagcgagactatttgcctggtttatttttttcagcttagagctcgttgcacggagtcagaacccctgcatcccggtggctcaggcatttgagtgaaggtcggatcaggagggaggggagatgcagctgccccacgcatggaggagaagagctgtgagctgcagcagcctcgtgtctttttcctctcaactttcagttcagaaaaatttcagacctacagaaaacttgggagagtctcacagtgaacaaacctcagctgtggccataaacaaagtgcccattcgtgtgtgtgtgtgtgcgtgtgtacaaaaacacacagacatagacacagacatgtacacacatcacacagacacatcacacagacacaaaacacatcacatagacacatacacagacacacacatatatatacacatatacccacacatacatcacataaacacacacacatatcacacagacatgcatacactcagagacatacatcacacaggcacagagacacacatcacacacaaacacacacatatatgcacatatacacacatcacataaacacagacacacacacacattttgctggtgagagccggctctgccatcgtgtcagttcatcccggattgctgacatggtgtctcctgagtggagctgccctctgcataaccacaggcgagtctgcatcgcggccacactgccctctggatgcccacacatggggctttctccacgtgccccgtcatgtccttcctgtatttgttaaaatccaggtccagtgaaggacggcgcccccgtcagctgtccacccttctcagtcgtctctaatccacccagttgttggtttttgttttgctttctgtcttttgtgagattgagatttgcgaagggttgaagccagttgctttatggaatatcctttcatctggtttccttgtaattaggttccacgtggtcctttggggcgggaatcctggtgggtgagcttctggggcagcccgtggaggcccaggatgtccatgtgtcccgtgattggggcggtgttgtgtgctcagacggccaaggaggcgtccggatttccccaggagaaggtgcctctcctcttggtaatcagtgggtcatgtgtggtgatgctcaggacggggcgaaggtcccgtggctgaggtgtccactgaccgtttctgcctgaatgggtggttcggtggtggttgccacagggctgtgttttcaaggggagcagcaggtgcctggcgtctgcatccacacctgcctggagcctccttccatttgttactctgtctcctcctgtgtccctgcagctgtgtctccagtgatcttgcctgtactctccgcctctgcagagtgaggttttcactgattgcaaagtaaacatgcacgccccttcagggtcctggtccttagggagctggttaacaagttgaccagaaaaacaacccgaatactcctcaactcttgatgggagctcagttcacacggctccgaatcggcgaaacgcaaccaacgctgggcagaaccttggcacaactttgctggtgtctgctgagaagccgaggggaggttctggggcttggcttgagctgcggggtgagtgtgggagagacggcgagctccctcccatcaatcaatcaacagactgtcctattttcatagtagtccccacccaaatgtcattcgagtccaatctcaggatcctggatgcacgcctgttctccaggtctgcttcccgtgaaattcgtggagattattgtacattcgggagtgggagtgcgattggatgtgtgtctgcagattctccctgtattttctcccaggctttctagaggaccatttgctagaggaccagtccccaaacggccgcgcttttaggattggttttaggagtgatggcctcacgcacacggcagcggccattctgagcactcgtgtctgaacatctgcaggaacagggtccacgcccattgttttcctcacccggtccagcgtctctgattccggctctaacgtcttcttcatctgttaacacagagacacaaacaaactttcaaatgcatattttttatataaacttgtgtttactgtttggctactgtcagacaaatgtagttggtgaggtttcagttgctctgaaattaaatatataatgtcaagctggataggtgtggcttggagcagaccttaaggaaggtgatttgaacttggggagggtttttcaaacagggttccccaaagtacccagttctacaaagttcccagcatgtcctgttgctttagctgcattggtaaatacatgcagcgattgttttctgagtctctaagaatattaactcagaaaccagtgaactctttttctatctccagactacagtgctgtggtcatcacacatatctgttcctaagttcatccaggtcagcccagaaaatgagcaatattgttttcatgttagatagaaacctataggattactttactgttgagtaatttacaaaaagacttgacagcctccatcccaaattcttcatccagttaccatttatacttacccccatcttttaaaataaagtttttattttagaactttccccagcttttaatacaaacggtcaactccaattcagagaaaattttatttgctgttatatttattcaaagtatgtgtttgtgtacatcgttagcaccttctcactcagctaggatcttccaatttattctatttaatataatgatccaataacttaaaatacgaaaccctaaaactgagccaaggaagagggggtcatgtttgatgctggcagagcctcagggaccagccttgctgcaggggtatgcttcactcccagaggctttaggggcaaatagttgcacctgctggagacgtggacccccccccccgccacacacacacacacacacacacacacacacacacacacacacacacacacacacacacacacctggcttcatctctgagcttcaggctctcagcttgtccttaaagatccaggtgataaaaacgacagtgaaacgtagaagagcgtgattcatcgcaccatcagaaaaagactggttttccgtaaatagtggtgtccaatttcacagcagtgtgagggattttcagtccgccccttgctgagacacagaatctgccctggggcgtcccactctttggggcttgcttctcgaaggaggactgcccaggcgcctcgtccaccaggatcacactcctggcagatgctcagctcacgattccctgcttgtaattcagcctgtccgtcacagcatcttacccacacgtgctccctgcagaaggtgaatggctgtggccttagtctatgtccaggcgtcgtgtgagatggtggggcagagagggcgcagatgcagggcccctccagagcacttccctgggggccgaggctggagagaatgggtgtggagagcagcggagacaggagagtcccccggaagccatcagcctcccctccctcatccactccgcagcagacacccgcagaggacctgccaagtgtgccggccactgagggccgtggtccctgccctccccacgcaatgcagatgaagcagaggtctccatgggaggggtcctgtgggaaaggtgtgcagtgtccacccagtgacaggacattgtccacctgccctggacggggagggcagccgcccagtgaccgagcccttagtttatgcacaaggggcaggggcacatctctggttttaattcctacaaggcaggtgacctggtccatgtttgggtgctgagtgtttgggtgctgtgtgtttgggtgctgagtgtttgggtgctgtgtgtttgggtgctgagtgtttcggtgctgtgtgggtgtggagtgtttgggtgctgagtgtttaggtgctgtgtgtttgggtgctgagtgttttggcactgagtgggtgctgtgtgtttgggtgctgagtgtttcggcgctgagtgggtgctgtgtgtttgggtgctgagtgtttgggtgctgagtgtttcggcgctgagtgggtgctgagtgggtgctgtgtgtttgggtgctgagtgggcactgagtgggcgctgagtgtttgcgtgctgtgtgtttgggtgctgagtgttttggcgctgagtgagtgctgagtgtttgggtgctgtgtgtttgggtgctgagtggttgggtgctgtgtgggtgcggagtgtttgggtgctgagtgtttaggtgctgtgtgtttgggtgctgagtgggtgctgagtgtttcggcgctgagtgggtgctgtgtgtttgggtgctgagtgttttggcactgagtgtttgggtgctgtgtgtttgggtgctgagtgtttaggtgctgtgtgtttgggtgctgagtgtttcggcgctgagtgggtgctgagtgggtgctgtgtgtttgggtgctgagtgggtgctgagtgtttcggcgctgagtgggtgctgagtgggtgctgtgtgtttgggtgctgagtgtttgggtgctgagtgtttcggcgctgagtgggtgctgtgtgtttgggtgctgagtgggcactgagtgggcgctgagtgtttgggtgctgtgtgtttgggtgctgagtgttttggtgctgagtgtttgggtgctgtgtgtttgggtgctgagtgcttgggtgctgtgtgtttgggtgctgagtgggtgctgaatgtttgggtgctgagtaggtgctgtgtgttttggtgctgagtgtttaggtgctgtgtgtttgggtactgagtgggtgctgtgtttaggtgctgtgtgtttgggtgctgagtgggtgctgtgtttgggtgctgtgggtgctgaatgggtgctgttttggcactgagtgggtgctgagtgggtgctgtgtgggcgctgagtgtttgggggctgtttgggcactgagtgtttgggtgctgagtgtttaggtgctgtgtgtttgggtgctgagtgttgggcactgagtgggtgctgagtgttttggcactgggtgctgagtgttgggtgctgagtgggcgctgagtgtttgggtgctgagtgtttgggtgctgagtgtttagtagctgcgtgtttgctgtgtgtttgggtgctgtgtgtttgagtggtgtgtgtttgggtgctgtgtgtttgagtgctgtgtgtttgggtgctgagtgtttgggtgctgagtgtttaggtgctgtgtgtttgggtgctgagtgttgggtgctgagtgtttgggtgctgagtgttttggcactgtttgggtgctgagtgttgggtgctgagtgggcactgagtgtttgggtgctgagtgtttagtagctgcgtgtttgctgtgtgtttgggtgctgagtgtttgggcactgtgtgggcgctgagtgtttgggcgctgtgtgtttgggcactgagtgtttggatgctgagtgtttgggtgctgagtgggtgctgtgtgtttgggtgctgagtgttgggtgctgagtgtttgggtgctgagtgttttggcactgtttgggtgctgagtgttgggtgctgagtgtttgggctctgagtgtttggacactgaatgggtgctgagtgtttaggtgctgagtgtttgggtgctgagtgtttcggtgctgtttgggtgctgagtgtttgggcgctgagtgtttgggtgctgagtgtttaggtgctgagtgggcgctgtgtgtttgggcgctgagtgtttaggcactgagtgggcactatgtgggcattgagtttttgggcgctgtgtgtttgggcgctgagtgtttgggtgctgagtgtgtgggcgctgagtgggcattgagtgggtgctgagtgtttgggcactgagtgggcgttgagtgttcgggcactttgtgtttgggtgctgagtgggtgctgtgtgtttggtcactgagtgggcgctaagtgggtgctgagtgttttggtgctgagtatttgggtgctgagtgggtgctgtgtgtttgagtgctgtgtgtttgggtgctgagtgggtgctgagtgcttaggtgctgtgtgtttgggtgctgagtggtgggagctgagtgtttggatgctgagtgttttggcgctgtgtgggtgctgagtgtttagtagctgtgtgtttgctgtgtggttgctgagtgtttgggtgctgagtgtttagttgctgtgtgtttgctgtgtgtttgggtgctgagtgtttgggcactgagtgggcgctgtgtgtttgggcgctgagtgggcactgaatgggcgctgtttgggcactgagtgggtgctgtgtgggcgctgagtgggcgctgtgtgtttgggggctgagtatttgggggctgagtggacactgtgtatttgggcactgagtgggcgctgtgtgtttgggcgctgagtgtttgggtgctgagtgtttgggtgatgtgtgggcgctgtgtatttgggcgctgagtgggcgctgagtgtttaggtgctgagtgtttgggtgctgagtgtttcggcactgtttgggtgctgagtgtttcagcgctgtttgggtgctgagtgtttcagtgccatttgggtgctgagtgggtgctgagtgtttgggtgctgaggacagacttgtcaaggtcttgctactaggattccacaactgtggaaaaggcattgtataatcctaagtgaggtcccagccacttatgttgcaatcccagagctgggttggaacttggggtgcgcgatctagaattcccgcctgagatcatgttgtcagcagtagagatgagcccaggtgtccctgcagccagcgtggctggagggcccagacttggcccacgccccacgcgtcccctgacttcagaccctaccccagcttcctaacctcagggccctcttcttatggtcctcgctaggccagcctgaacattggagtgtggctggggcagtgcccaggcaggacatcctggtgagtcggtcactcctcctctagtccttgctgctatattcctttcgggctttagggcaatgccattcttttctatatgtcatattttaggtgcatttaacttagttatccagaaatcaaactcagttgcttcagtttctttttttggtgatggggtctccctggatttcagcatctggacataacttggtgtcgagagcaaccatcactgcacgtctgtcatcgcggcttttgagcgcttccttggtgcaggtgtccactgaacgccacgcacgccttggtccatttcatcttcgaaagggtgtcatgagtaggcactgccggtctccccactttcccaatggagaagctgagacacagagaaggggagtgacctacccaagttcccacgccttgtaagaggcagagccagtttccaaataaattcatgtaactgtgtccaaggccgtgtgtgcacaccagggcacaagattatttttatttttgtaggtaacacacacatgtgtctatgttgcttttataaaatttgacaagtgtcttggtttcctggggccatggtaacaaagtaactacagactgaccactgggcgcacagaagctgttccctcccagccccggaggcggagtctgaactcaggtgtggccggagggggctccttccaaggctatggggagcgtctctctgctcgaggcctctcctcagcttctggtctggctgcctcctgggtctccctgggtgtggaagcaccgccccggcctccaccagcaaattctctgggagctctccacgcggtgctgggatcagggcctgccctaatgacctcactttagcttggttacctctgtaaagaccgcgtcaccagccaaggtcacgttcggaggcactgggagttaggcttcgacatcataatttggggggacacagctcagcccctaacaactgtcgtaagctttggacttttacatttgtaagcagcataacgttctgccaagacatgaggcttttcctcttttcttttagaaaagagatgcctttcacagaggccagcatctctaccatgtttatctcagcataaacctgctgcgttgaggatgcctggccgctagctgcgcgcccccggtcagcccagcgtgcaggcaccgcactaggggggctgctgtctgcagagcacgctgcaggcccttgtctctcgccctctctcacaggcatctttcccggcaaacctgcagctcgtcctcgtgcttcgcccgacgggttttttccaaaggactctctccgacatcgctttcaaattcaatagagatgactttaagatgaaggtgccggtaagtgcgccccgcctccatcctgcggtagcagaacggaactcattgccgtcctggcccatctgtgatcatcgaaatcctcgaggagctgacttcagggccacacggtcaacaaaaccccgcaggacctggcgggaagttgcacctcctcaatgctgccagaagcagtacaatcctttcttcccccacccccgcccccagcccccaccccgccagaggtgcacagagcatcaacctcagagaggccaccgtgtgggcatcccatcaggacgcgggtcacgcgacattcatacccccaggagaactacagaacttgagaccctaagggctgagagtccgcctggcccacccgcgaggaactcagcccaggccctgcctgcaccccagggatgagagaagggctggggagggggctgtaagcatctctggacctgggagggagcacccactgctgacagggatgggccggacctgtcctggagcagccaacagggtgacccctgccccatcgccaccacactatcccggcacagggcagcatctcccaacactgcccactgagaaagcaccttcagtcctgatctgctgtcctttaaagaacaaaggcttcacaaagtcccttagagcctgtggagcccggtcaccagcccgagctgtgtagctcccccggagagccctggtcagctgccttggcgagctcacatcttctctgccacaaagagaacagagacatatgggccagcaccaggcaccgcagagcaccccatggcaccagccagatgctactggaaaccaggcaatctggggtgcaggtcgctcactgtgaagctactccctgtgcgctgggaatcaggtggcaccagccctccctccccaccctcgttgcgctacagcctcaatgccaaaggtgcaagagcccttctctgacagggaagaaaacggcctggggcctttccccatgtactgcccccttcccctcccctcccctcccccttgccctcccctcccccttgccctcccctccctcttccctttcccctcccttccctctcccccttcccctcccctccctctcccccttcccctcccttccctctcccccttcccctcttttctctcccctccccctccctcctcctcccctcccctcttttccccctccccctcctcctccccttcctcctcctctccccctacccaagacagccctgggggtcacaaggccccatccactctgcccacccccacgcagtccactctgggtgtcacccgtgaccctggtgcctggcctggggcagtaactgcaggtgcagggtgttctgcatggcacccatggggctctgtgccatcgtgctttggtggccccagaaccaccagcttccaagccattgggaaactctgtgcatgtaccgttttttgtagccttggagaagccttagtgtctgaacagtccattccctagagacgaccagcgacaaaaccgtgcagagcagggactcgtgggcagtgggaggctcatgtcctgacaccaggatgagctaggcattgcgtgtgcagctcagagctcctctgacagctcctctcgtgatggcgtgtgcagctcagcaccctgcagacagcacctctcgtggtggcttgtgcagctcagcgccccgcagacagctactctcttggtggcttgtgtgtgttatggcccttatgatggagataactccgtgcgccctccttccctgctatttggcaggcactgcacactagccataggctttgtgaccacagacgtgtcacggggagcaagaccgacctcacgggtcatccatgccacaggctcccctgcacaacggctccacagcaagccgtcaaaatgggtttcacagaaatcaccggcatcttcaaactcacagccccacttagataattcttgaaattagagtggatgatgtgaaggatgcagttgttgacacgtgtgtgtccgtgtttcagtgccgtgtgctggactcagccatagaaaggagacatgagggagaacagtggccccggcacctctgctgccgtgactgactgtccaaacccatggatggagtgacctcaaaaagggcaagagaaatgcagaaaaatgaagacaaggcgtgtgtagaggagcttatgcggccgtcgcaaccacaggttttccacataaccataaccgtgtgggaactgccagccactctccccgtccggcctcagtggtggtgtgttgatttcaactggtgtctacaatgaccgcggggtattttcggcaggaacagggacaaaaatgatcatctctcccatcagagcactgtttgatgatgttgctggaggaggtgtaaacgcctgttgcatgtccttggccatcacaggccgcactcgtgtggagttttgtgcacctccaacagcaccatttgctgctcaccgtggcatgatgagctcaggcacaacgtgcccatttacgaaggaggcagctgagacacagagtgggcggctggcctgcgggcgagtgggacccacatctgggtccacacaggtccgaagccaggcgcccctgtccacacagccacccacaatgtccaggcgcccccatccgctcagctgcctacagtgtccagacacccctgcctgcacagccgcccacagcgttcaggcgtccctgtccacacagctgcccacggtgtccagacacccctgtccacacagccgcccacagcgttcaggcgtccctgtccacacagccgcccacagcgttcaggcgtccctgtccacacagctgcccacagcgttcaggcgcccctgtccacacagccacccacggtgtccagggtttggataaaatctaggcttggctttgcaagcagtcagacgggaccacaaaatgggtctcctgaggtttagctcaggggttatttgacaccacatcatgttttattaaataccgtatcagtctagagtggggactccactgggggtgattttgccagatagtcacggcagcagaggtgccggggccactgttctccctcatgtctcctttctacggctgagttcagcacacggcactgaaacacggacacacacgtgtcaacaactgcatccttcacatcatccactctaatttcaagaattatctaagtggggctgtgagtttgaagatgccggtgatttctgtgaaacccattttgacggcttgctgtggagccgttgtgcaggggagcctgtggcatggatgacccgtgaggtcggtcttgctccccgtgacacgtctgtggtcacaaagcctatggctagtgtgcagtgcctgccaaatagcagggaaggagggcgcacggagttatctccatcataagggccataacacacacacgccaccacgagaggaggtgtcggcggggcgctgagctgcatcccatccgcacatccatccgcagtgtccaggtgcccccacccacacagccgcccgcagcatccaggcagacgtggtcctctctgtgctgctgggtgttctgctgatggggcagctcttttgggagccaacaataatcccaaacactaccacgcattccctttctcctccaggtcataatgctgagctccgtaccagacttacacggttacatcgataagtcgcagctgaccgaggacctgggtgggaccctggactactgccactcccggtggctgtgccagcgcacggtgagccgcgtcggggccagcggggctggctgataccagctcgagtacttccacagaatcgctcttgcattacaacacggccctttccaaaaacacattcacattaacagtcgttttctttcccaagaatgaggagatggtctcagtggaccttagtcattgtaaagaagtaacgtgagtcataagtttgggagtggctttctctgggcttggagaccaaaaaaaaaaaaaaaacccttgcgttgtggtttgcaacactcactgctctcaacggggagaggcagcgcaggcacaggcgactctaggtgacgggcacacgtgtagagtgtgcctggtatgtttctgaagaggtcaaggagggcaggacgctatgggagggcgttcaccgtctttgcgtcagccggtctcacctgatgggtctgtgtgggaacggtttccgccggtgtctgctttcagggcagcaggaggtgggtgcagtgcacaaggcatgcaattgtgttttctctgtccccaaggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggtacatggggggtgctccggctggaagctgtggggggctccggtcagtcagaagctgcgcggggctccggtcggaagctgcggggggtctttcgtcccagcgggagtttgtgtcagcagcacgtaagaccaagaagtcagcaggcttgagatgccttttgatggcaattagctcggcaacctctccgacgagaacggaataaaaggagtgtaaatgaaccctgtagattgctggctgcgcctgccattctggcgttgggtcaaccattggccctgggtggccgtggcttcaggagtgggaccaggggtggctcctctcaggagcacttttggctgtctgtgcggggagctcccgaatagacatctcttgcttctgagtgtgaccgagacaggatgtctgtgccggtttctcatgccgagcaggcgatgaagtggcggttggaattcctgtttgcagaacactcccagtgctcacgtgtccacagcgcttgctggaacaaacgtattctgaggagcacgtgctccctgctctgtgctgcccctggcccaccggcacgctgctggctttgcagcaatggtagcccagggccatgacctgctggtgtgtccccgaggactgtgcctctgtgctcaccgggccgctccaccgtgaggacactgaggaccaggagcaggcaccatgagaaagcctggtctccagtgactctttcaccttaacccgttgccctgagtgccctgtaatggcagctctgccccggggcacacaggagtgagggaggcccccacatcaccccgcctgcccgcacgaccccacagaagagactgggaagactcgggggtcggggattgaccccttcctcagtccccgccccctcaagagcaaggccccacgaggcctcaccaccagcctgcgctgtgtgcctggacggggccgggacatgaggctgcattctctccacaggaggatttgaggctggcactgaaagaggggcacagtgtcctggagagcctcagggagctgcaggctgagggctcagagcccagtgtgaaccaggaccagcttgacaaccaggccaccgtgcagaggtgaggcccggctgccttcctgccctcatcctgtcccagtccatggcaggatcctctcaggcacacagcttctgcaaaagaaacaggccacggaaatagcaagcagcgtggcaggcaaccccactcctggccagggccagcacagcagccggcctccgagcctctgtgtgggcctggctcctcctgctgaaatgcttttctctcgaaccccacagaaagccactgttttggggacaatttcctagagcaaacgcccttttgccggcatgaaggaggcgttaggggaagcagaggcgatgggagtgccttagacctggggcttctgcattccaagcggggcttccacagacagggagaaagcctggggttctccttgctgcagatagtgtttcttactttcattgtgaaaggtgtgattctcatatttctcccttgggcttccagctttatagcagcacagggtagggcactcgtgtggttggcatggtgctctaggatgtccagaactccctgagcatccccctcaccccccgagaactccccgagcctccccccgtcccatcctccccaagactccccaagcctcccatgtcccatctcgctggtgggtgctatcagccctgcctccgagctgaggagcagggcccgcacagctggacagcggcttgtccggcagggccgtgcggggcgcacccaggcctggaccaagctggtccttttgactctcagctgcctttgactcccacgcagcgtggcccacaccctgagctgccttctctgccagggacatgccaagggccccggggactcgacggcgcatccttgaggggctcctcgtagatggggtgccgtgacccacgaggcagaggctgcagcacagcccatgagggtgggccctgccctggcctgtgtcaggcaccttgtcagcttcccaaagactcagtttcctcatctgtaaagtgacgctgatccgtgcacacgcctggcagggtgggcgtggggctgactgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggcgcacagctggagtgccagctactcggaggcagaggtcgcagtgagccgagattgcacctgggtggcgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtcccagctacgcagaggcagaggtcgcagtgagccgagattgcacctgggtggtgcacagctggagtgccagctacgcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgtggaggcagaggtcgcagtgagccgagattgcacctgggtggtgcacagctggagtcccagctacgcggaggcagaggttgcagtgagccgagactgcaccactgcacccagcccaggtgatggaaccagaccctatctcaaaaaataaattttaaaaaaagtttttaaacttttaaaaaataaaaatgaacaaactcggcggctcagcctagtcgcagtgacctagagggagagaagcaggaaggaaaggacacagcccctgatgctttctccagggcctccctcccatgctgacggccctgagtgcccgcgcccgcagatcccaggtttaggtgcagggagtgagcggaggccaggatctcaggaaggcccggggtggagatgagccttggggtcgcttgaacacccaccgcgctccacgttgcatggggcgccgtgggccacacagacggtcaactcctcctctttcccaggctcctggcccagctgaacgaaaccgaggctgccttcgatgagttctgggcaaagcatcagcagaaactggagcagtgtctgcagctccggcactttgagcagggcttccgggaggtgagtggccctgggtggagccggcagccgccctgatgctcacggggcctcctgtgcctgcgccctggtcccagtgccgggagctgagccgtgccacccagttgactttggcttaatgcagaaaagtctccgcttgccaggtggagcctgtgagattaagtcaggctgagccttgaaatgcacgattgatgactgcgtcattgtatagaaaggtgattgaaaatcagctcactgggatgcacttacactgcattattcgtaaagtagcaggaagcctttgctctcccttcatagtcatttgcatgcccttttattcaacatgcatgtaggatgtgcctgctgtgtgccagactgtaggacggcgtcacagtcatgaggtgcacagcgacacggccagtgcagccagacccagacgtctccctcctgcggcccttcgtggactcacccatgtccctcctcagcccccggcaaccactcatctgtttccgtggctgtgcttttgccatttcaagaatgtgacattaatgaatcccacagaatgtcactctcgggatttgtttgtttgctcagcacagctctctgcagacccccaggtgccggtggctcactcattgtgttccccggtgtggacggaccacagttctttcaatcattcacctgttgaagggtatctgggttgtttccggatttgagtattacagataaagctgttacaaacattgatatactgatgttggtgtaaatgtaagttttcatttcttgggcttaagtgcccagaatgtaattgcagggttatatagtagttgcatgtttcgtttaagaaaatgccaaacggttctcagtgtatgagagactagttgcttcccctttccccagcacgtggtggggtagtgattcttcatattatgctcacatcctgatgtgtgtgccatctcacggtggttttctgttgcgtttccccagtgttgatggtgctaaacacctttccacgtgcttatttgccattcgcatatcctctttggtaaaatgtcttatttctgttgcccattttctaactggattgtttggttttgtgcttttgttttacggttttgttacattttgagaattccttatatactgcagatactagttctttgccacatatgtggtttgcgaatattttctcctggtctgtaacttgtcttttcatcctctttaacagggtttttcacgtagccaaagcatttaattttgacgaactccaatttgtcaatttctccttttaaggtttatacttttggtcctagattccaagtatattcccctaagcctttttcccctcaaatttcatagttttacattgaagtctatgacctaatttgagctaatttttgtataaggtatgagaattagatcatgatttgttttacctctggatgtccaattgctgtagcactgtttgttgaaaaggccctttcttccactggatttcttctccaccgttgtcaaagctctgggcacatttgtgtgggtctgttctggagactctctattcaattatgtttatctacatacctcttcctctgtctgtaccacaaggtcttaattgctgcaactatataatgtcttgaaatcaagtacactcattcttccctctttgttttctttttcaaaattgtgttagcttctagttcttttgccttttcatggcaattttaaaattatcttgtctacatatatgaaaacaaatttcctggggttttcataggagttgtgttaaacctatattttaaggagaagaaatgtctttactgtgttgactcttctagtcaacaaacatggtattcccaacatttgatttctttcatcagtgtcgagtagttctcagcacacaagttcagtacgtattttgtttgacttacctttaatattccactttaagaagtcatcacagtattatatttttaattttggcatttatgtattcattgctgcacatagaaacacaattgatttttgtatatttatcttgtctcctgcgaccttgctgagcacacgtatttgagatggttttttgtgaagtccttgacattttccatatagaccatcatgtcatgtgcaaataaggacagtttggtttcttcctttttgaagatatgccttttattctaccccccacccacaacaccctgccccactgcgtactgccccaactagagcttccaccatatgataagagtggcgagactggacatctctgctttgtccccaaccttaggaggaaagtgtttagtttttcactgtcaggtgtaatgttagttgtaggattcttgtagatgctcaataaaactatctgggcctagagatttctttgggagacttttaaaattatgaattcagtgtccttaatagttacgcaactattgaaactatctgtttcacaatgagatatagtagtgtgcttttcaaggcaatgtgtagggttgtttatagtattctttcttatctttttgacgtctgcagggtctgtagtgatattccctgtttcatttctgatatttgtaatttgcatcttttccttttttctttgtcaatctagattgagatgtatcactcctcatctttccaaagaactcgttctttgtttcattagttttctctgttgttttctgttctcagtttcattgatttctgatcctacctttattatttctacaaattgctttggtgggaacttacattctttatttgagactgttcctcttttctaacatacatatttaataagaacactataaatttccctctcatcactgatttagctgtgttccacaaattttgatgtattgtattttctttttcatttactccagctttttttttttttttttccaatttcccttggaacttcctctttgacccatccattctttaaatgtatgttgtttggcttccagtgttcagagattttcccgttgtctttccattcttgatttcaagtttgattcattgtaatcagagaacatactctgtatgatttctgttcttataaatgtgttgagatttgttttgcagcccaagaatatggtctttcttggtatatgttcctcacttgaaaagaatgtgtattctgctattgttaggtgaagttttatacatatcagttagatcctgttggttgatggtattgagttcttctatatccgagctagtttctgagaggtggtgcattatccataactcagtggctgtgcgtaacatggagagaagtctcactcatcagctgtgccagatgcagggggttcaaggatggacaagaatcctgccttcctggccttcaaccccaggccatctgaactacaacccccttggcactgggatgtctgcgtacacacccattctcaggatcatttccaataacaaaaattaaaagcttttgtatttaaaggaataagtggtcatatgttttaaaaatcaggccaggcatggtggctcacacctgtaatcccagcactgtgggaggccaagacgggtggatcacctgtggtcaggagttcaagaccaacctggccaacatggtgaaaccccatctctactaaaaatgcaaaaattagctgggcgtgatggctggtgcctgtaatcccagctacttgggaggctgaggcaggaaaatcacttgaaccagagaggcagaggttacagtgagccaagatcacgccactgcactccagcctgggcaacaagaacaaaactccgtctcaaaaaaaaaaaattaaaaattaaaataaaaatcatttctatgacacccattgtcttcctgccaacagcagaaatcgtagacattagaagttagtagcaagctagaagggactgagttacataactctccacacctaggatccagtaggaatgctgacaattccagtgtccatattgctgctggctttcggctcccagggcctttgtccttgcgtgatctcatcttctcctcatgctgttttcaggcgtgtggttgataaacggaggcacacacaagccacagagaaacaattgttctgccagtgaggtcactggtgggtagcgtcgacccagaggccccacggtccccgcttgattggtgaccactcggggccgactttgcacctgtctgactgtggtccctgcttgattgatgaccacttggcccgactttgaattctgtcatttccctgatctggagcactggagtgggttctctctgttcaggtgagggagacacccccctgagatgggccctcctctgttccaggtcaaagccatcttggacgcagcgtcccagaagatagcaaccttcacagacatcggcaacagcctggcgcatgtggagcacctgctgagggacctggccagcttcgaggagaaatcaggcgtaaggcggggtcccggcgggggcggcgggagagtgtgggcagcatcatcaagtgctgctcaggaaggcgcaggaatgggcctcccgcctacggagaacggaccccacagccccccggggatgtccatggggtggggggtgctgctgcctgtacccctcccctcccacaccccacccacagcacatggccctgcccggcctcctctgggtcaggtccctgcagacggtcaatgcctttgctgggaccaccacagcccccagaagcacttgccacagaacagcttcggggattaagcagcatctcaggcatccgcagcagtaaacaaagaaatcaagacacacgtgtgccccgggacacacatcccgtacagcaaggcactgtgtgcctcgaacagaaagaggcctgagctggtcctctgggtggccgtccacaggtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacggtaggccgagccggaccccaccccactcccccccagctgcggaaccagcctcttcctcccacatccaccaccggctgacccttgtcgtggggagggcagctctttggctggaaaatgtccttgcacccttcgtttctggtcttgttggcctagagggtctttttctagaattcatttgccacagttttatttctttttttttttttttctcactgcaacctctggttcctgggctcaagggatcctcccacctcagcccccaagtagctgggactgtaggtgcatgccaccgtacccagctaattcttgtattttgtgtgtgtgtgatagagatggggtctcactatgttgcccaggctggtctcgaactcctgggctcaggtgatcctctcaccttcacctctcagagtgctgggattacaggcgtgagccaccctgcccagccaataatgatttctttaaaagatccagaagcttaaggcctggttgatcctactgcacttaccctgcctctccaggccccgccctgggtaattcactggtgttgtccagcactgtgtccccttgggattggccttgtccagcactgtgtccccttgggattggccttgtccagcactgtgtccccttggggtgctttggacagggtggcgggagcacgaggagtcggtggcccgggatctgtcgggaggacaccccggcagtgtgtgcctggacagggtgacgctctcaccctctcacggcgtcctgccctcggcaatgctctgtgtttccagtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggtaacgctgactcgggctctccatttgcagcttgctgtcccgagcagtgaggcattcctctgtgggaagtttgaaagaatcatttaatgaattatttgtatttatttattattattttttttttgagatggaatctcgctcttgtcgcccaggctggagtgcagtggcacgatcttagctcactgcaatctccgcctcccaggttcaagcaattctcctgcctcagcctcctgagtagctgggattacaggcgcccaccaccaagcctggctaatttttgtatttttattagagacaggttttcaccatgttggccaggctggtctcgaactcctgacctcaggtgatccacccagctcaacctcccaaagtgctggaatgacaggtgtgagccaccgcacctggcccatttaatgaattactaccaaataataggcatatgagagaaacacacagttgggaggtcaagctgaattttcctttcaacacagaaattatttccacgccaaccctgcgaggtggccatcccgcctccgctggcagactttgtggcatgggtgtgttcttcaggaagggcctggccctgggacctggtgatgcccttgagaccaggctcctcctgagccctccacatgcctggggaaggctgcaggcccctccctcgcatggagctgccctttcccgaggccggggccccgtcccgtgtgggggctgcatccccctctccgtccgtagtggccagggctggacacagctgcgctgcgctgacagaccccgcatggagaacatttaaagcgggggttgggcgtgccccggcacgttctgcgcctgactgtgtatttttagtgatgacaccaacatgtgcaaggcaccttactgagcatgcggtttcaggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggtctgtgtggccgcccggtgccccgggtgctgtgggaccctcgggggagccccgggcgttgagagcttggtacatctgaggcagccacctgcgaaaactgtctccacacgcctcctccccttccacctccgggccccagttcagggcctgagggccggttcccgccacccctcacccatgtttataaatggagttttgtcaggacccggccacgcccatcctgtgccacgcacatcttgtaggcatcgttgtggctgcttttccatgaggctggcagggttcagtggtctcagtgaagcccacgtggcccaaaactggaaacacagagctcccacagaggaaccatctccggccttcccagctccagcctctccacggtctgtcctttcccggtgctattgccaaacaacattcctcacacacggcccagaccctgggctccaggagccctgaagagccacgtccgcgcacctcagtccggcgcgcattgctggtcccaaacccgccctctatgccgagccaggcacggcgccatttcccagagactttcccgccacctctgtgtctcaaaacgaaccctcttcccatccttgctggtttctcacacacgaacccaccaggcgagctgctgccccagctttggcgaaagtcagctgtcaatctcaggggccccgggggccaggctcttgccttcctgtgctgggtcccaggcgaccttattttctgcctgttgggagctctcccaggtcggagcccacaggcgctgtgtccccgtgggctgtgggaacgtggggtgactcagggcagtgaggccccaccgtcctcccccttcccgcaccaccacctgtggcctcaaaggccaagtcctgcccacgccaccacctgtggcctcagaggccaagtcctgcccacgccaccacctgtggcctcagaggccaagtcctgcccacgccaccacctgtggccccagaggccaagtcctgcccatgccaccccctgtggcctcagaggccaagtcctgcccacgccaccacctgtggcctcagaggccgagtcctaccctctcctcggggccttttcccgctgggtgcacttcccctctccagagggtcagaggggacttcatgccccgctccccttcttcccaacaggcattcggcgaggctctgagaactccagctccgagggcggtgcgctccggagagggccctaccggagggccaaggtgaggcttgcccaagacaaccccgccatccacacccccctccttggttcacgctgggcctggttctccgtgtggccccccctcccgggcactgcccagctacctggccagctccccatcgtgggaattcagccctgtccccatacgggaactggtgggctctggccttgagagttggcccttgaggttccgtcccgcctttcagacctgacgctgtttttctccccagagtgagatgagtgagagccggcagggccgcggctcagcgggggaggaggaggaaagcctggccatcctgcgcaggtgggtgcgctgcccttctgtcctcacaggggccctccgaccgcagcctgaaccaccagatgccgtcaggcactcgagcagatgcctcacagatagaaggctggtgcagaagtcattgtggttcttacttttgcaccaaccgatacccagagggcctgccgtggctcgagcgtgtgtcctggtccccaccgcgtgaagcacacacacgccgcacacacaccactcgggattcaggagggaagagagggcgatggctgaatgcaacagtgaaggggcatcttcgccccagcaagagcctccacccgccactgccattcacaggagacaccactcaaaggccccaaccagcaccagctgcagcagcagtcaccagctgctcagggctcagtgtggcaggcagtggtgccaggcagctggtgtgtgggagggcatcgtctccagccctccttttcccctgggattcctggaccctcaaactcagggagtgttgtgcaaacaaaagcagttctctttcctccttcacctttaagaaagaaagacctcactggtgcagggccagggaatgcaggtccccagagcaaaactgggaaggagccaaacacccatgaggcacacgcggctccctcccagaggccctcgaggaagaggaggaggccacacaccgaccaggcacccgccactggcttcacactttgcactgtctccgtttttagtatttgcactgaatatgtttgcaagagacgcttggaaccacgtctccccctttcaccatcaaaactccaaaatcaggaaagaagaaaaggctcttcctgatgtgttgacaagcaggtgtccgcaggcagcgccagtgtgaccctgcagggttgggagacggcgcaaaattgggaattacaggaaactgagcttggtgtgaaagctgagtctgtcacttccggcttctgatggaagctggtgaaacaggatgggaaggaagaggggcttgccaagaagcgtccaggcagaggattgtccacacggaggagggtccaagcagaggggcgtctgcacggaggagggtccaggcagaggaatgtctgaatggaggagggtccaggcagaggagagtccatacggaagagggtccaggcagaggggcatccgcacagaggagggtccaggcaggggagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagggtccaggcagaggagtgtctgtacggaggagggtccaggcagaggagtgtccatacggaggagggtctaggcagaggggcgtccgcagggaggagcagcaagtgctcggccctgagacgcagaaggagtggccctcggctggcagttcctgggttgtgagagggagtccagagccctcttgctccccagtcctctcccctgtgccgagtccggggcctctgcgggccgacagctgtcttagaacaagcttgctgaacaacctcaacccaggaccagccccctggctccagtttctgtgcatcacataagcaggcagggccgtaggctgctgaaaggtgctcacacccacagcaagacctgcgcagccagcttgtgcaccctccccttctggatccagtgtggtgggtgcagggtcactccccggaccaccactgcccacctgctgtgtgtgagggcgtgggcagggggcagctccggcgatgccagacccccgccctggccacgaggggccacacagatacccaccacgaggaaggctcagggaggccgggcagcaggcgggcgtcttcttggcagaagagactcgggtggattctagggatgggtcctaggagtaggatgacttgcccatgagcgtgaggaactcagctcattttgcacaggtgggacccaaaagcccaggaggcgagtctgggaatccctcctaccaggcggtgtgtgccgggccaggggcaagacactgccggccagtctgggaaccagggaggcttcagccgccgtctgcagggtctgaggccgcgagctgggaggggaaccccgaggagcgtccagcctgtgggctttgggtcgccgccagtcccctcctgctgggcaggccatcattctaggtggcacctgtgagactgtggagcagaccattcctgctctcccagtgctaaccttttttgctctccacatgacctgccaccaggcacgtgatgagcgagctcctggacacagaacgggcctacgtggaggagctgctgtgcgtcctggaggtgaggctggactcggggagggccgactgccacggggactcccctgggccagctggtggggcttcctctgacaactgctgctcggagcagcctgctgtccaccaaatgcatgtgagagagcgcccacagcagcctggtcgggccccagacggggagcccctgggggcctatcaacaagacacagaccaggcagctcaggggggtccgtacaggggacaagtgtagtgataagaaagaggagctgacacacaacagatgcacaaaccacacacacatcgtcaccaacacaggccacagggtgcctgcgattcccggcacggggcactccagggcaagcaaaactcgtcggaggtgggaggcagattagaggtgaccttggcagtgggctgttgcctgggtgagcttgatgtgagtggtggtcacctgagtatagacaggcatctcattcacccagtgtgcacaggtagtgatcacctgagtgtagacagcgagtgtgcacaggtggtggtcacttgagtgtagacgggtgtccgaatcaccgagtgttcagaggtggtggtcacccaagtgtagacgggtgtctgattcaccgagtgtgcacaggtggtggtcaactgagtgttgacaggtgtctgattcactgagtgtgcacatgtggtcacctgagtgtagacagcgagtgtgcacatgtgatcacctgagtgtagacagcgagtgtgcacaggtggtgaccacctgagtgtagacagcgagtgtgcacaggtggtggtcacccaaatgtagacgggtgtctgagtcaccgagtgtgcacaggtggtggtcacctgagtgtagtcgagtgtctgatttactgagtgtgagcaggtcacccgagtgtagacataagatttgtgccctctgtttcagttacacctgaatcataaaaggttaaaagggagaagggtagaacctccaccccattcccccaaattggtgctgttcataatgcttttgctttgatggatgcctgtcccggtaacttagaaatcacccgagaataaagatgaagggctggcctggcccacagatgagccggcatccctggcccacctgcccccccacagcatcaggcccaggacccccgccgacctctgcgctctccctgcagggctacgccgcggagatggataacccactgatggctcacctcctgtcaacaggccttcacaacaagaaggatgttttgtttggaaacatggaggaaatctatcacttccacaacaggtgggcccttccccccgacacaggcacgcacccgtgatctcttgcagctaatggtgctggcttcagggggctggaatgggggtggaggccaggccatgcctggctagggaggggcgcccaaggggtggactcacagaggcacaggcttgagtgtgggtacatggggccatctctgagcgcccacgtggcaccgtacctggtggcctgtgtctaggcagccaagttgtaagtgagccgccagccgtgaggagagggctctgagcccgagtgcgccctgttttgtggtgcaggaaatgggacccgcctgcccctcatcccctcctcatcctgctgggcaggtggaagccggaaccccctcccaggtgtgtattcggccctttagggggtcaccgaaggccataccacatagcaaggcctgttttgttcccaagctcttgaaaaggacggcaaactaggcgttccttacccatcatgggggctgcttgtcccccgagcgacccgtggcctctccagtgcaggtggcctgtccggcctcttgtcctccactcctctgagctgtttggctgctttaacacagttttggggagctcatgggaaggtgtagggtgcacacgcagtgcagaatgccagggaggctgcagtggacagcccccgctgcgtgtcctggaaggaacccatgtgagtggctcccatgcggccatgtgcttggggaccagcgtgccccactggccatgggaatcgccagtgcttgggatgttgttctgacacctgtttcttgccctctcatcacctcacctgccacttacaaggaggcagcaggtctgcagttgaccaccaaggagccttccacgtccacggagcttgggcagaaccttagtgtcccttagtatctgtcctcatggcccccagggtctcagccagtcctgcacgcaggggtccccacagctttcagctgttgtgctcatgccccaaatccatcccccagacggttttcccctccagccggacttcctccaggggacagatgcaacagaaaacagcccaggagcctgggggcggcgctgcctagggccagggctcagggtgtgtctgcagagaacccacagacccacggccagttatgggggtggcgcctccagggccctgaaaggtcccatctctgtctttgcctgcggccctgtgagccgtgtgtgtgctgagggaaaagcagctccctccaacttctgtgtgcagccaaggccagaaatataaagagactcagcctggggctgcacctgctggcgcctgagagcttggtgctcaggacaggcgtggctgcggcgtctccaagtcatgcggggcagattgcccagagcaaggcgtaacaggcttctgaaaaatgacgtccatccacttgtcactggtccacgtgactcggcctgtctttcatactacttaaaaaccttctttgtctaggatattcctcagggagctggaaaactacactgactgcccagaactggttggaagatgctttctggagagggtaggtggtgttttgacgtgtattttgtcacaacttcttaaaagtactgaataatgacttcagattctactgcaagttcctattctaaccaactgaaatcacaaaatacgatgttttcaatttggctgagataccatgatgctcctgtacccctagaacctcctgaacccccagaacctcctgaaccccagaaaacctcctgaaccccagaaaacgtcctgaacccccagaacctcctgtaccccaggacctcctgtaccccagaacctcctgaaccccagaaccttctgtacccccagaacctcctttgcccccagaacttcctgtcccttagaaacttctgagccctgtgccttaaaaccttctgtgcccctagaaccatctgtgccctagaggcacccaggagcaattgcacttcacaatggggctagggtctgttttttgctaaataacaggtaatttgtaaaactgccagagaaaatgctagaagttctattatataaacaaatcaacaaaccacaccataaatggccttctaagaatggctgcggtggaaccccgtctccactccacgcctgtgctctgggaagtcaggggctctgggacagggagccccattaatggagggcaggccccccagcggagcctgggagccagtgccggccctcggaagctatggggccagcagcaatgcctcgcagggccgggaagacgctgcgtgatgcggtgcccgtccctcaccgcgtaatgcggtgcccgtccctcaccgcgtgatgcgctgcccatccctcactgcgtgatgcggtgcctgtccctcggtgcagatggaagatttccagatctatgagaagtactgtcagaacaagccccgctctgagagcctgtggagacagtgctccgactgcccgtttttccaggtttgtccccggaccttcctttagaacgttactccctttcctagccgactcctgaggaataatgaaaattgtgcaaaccaaaggctctgggttggttccaggaatgccagagaaagctggaccacaagctgagcctggactcctacctgctgaagccagtgcagaggatcaccaagtaccagctgctgctcaaggtgggctccgcggtgaccgtggcccggcctccccagcacctgctggccaggtgtctgtgccgccctggggccccgtccccatcgcgccctgcccctcccaggccaagggcacctcttccgagcctgtgctgaggctgggatgcctttcgaggtcctactgtgcgccactgttaggggtctgaggacgcaggtgagcagacgagtccccgtccccatgggttggcacacagcccagcccacatgggattctgtgtgatgtgctgacccgtccctccagggtggagccgtgcccggattatctggcacacagcagggacgtggggcggcctagactggggattccagctatgagtttgccatgtgggtccctctaaccttcaggcaggaaactgcaactccatgcctttggccagggttagggtggcgagaggaaactccccagggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatccgggtggcaggagggagctccccggggagcaggtgcgaggggtttgcacctggcatccgggtggcaggagggagctccccggggagcaggtgccaagggtctgcacctggcaggggtgctgccccatctgcagcaccactcagtctgtcccagctgcaggagggcaggcagggcagctccccacagaccaggggagggtgagcagcatccctacctcgtgccaagctcctgaggggtctgttccaggggagccagggctctccgtgtcccgacgcggttgcctcaccccatgcccctcaggaaatgctgaaatacagcaggaactgcgagggggctgaggacctgcaggaggcgctgagctccatcctgggcatcctgaaggccgtgaacgactccatgcacctcatcgctatcaccggctatgacgtaaggcgcccagatgcccggtcttccccgccgcctccgtggaatacaccagcccagcaacttggcggcctccctgcacacgcccctcgctttggtgtgaatgtgcaggttctgggcaggaggtctggggtggtccctagataagcccactcccaggccccacagccgggtccacagaccccacagccgggtccacagaccccactgggctctctgggacgtggagaaaatcaggaagcgtcccttgcttggagggcacgcatctccagcaggaacgcagctcagacctcctcactccttgtcttctcctggggaggaggcgtggctcggagcagacgtgacttctgttttctgggctgcgatttgcaggctggtgacttagagcaagtggccccagaaggcagatgtcactttccccgtagagccccacatcaggtcacagcttattcatcttttgtccgtctttatgtccacccagcactcattctcaggtgttttttttttaactaatagagttgatttattgcagcaatttttggtttgtgagataattgagtataaatcagaggccctgaggcttcccctagtgttgacatttagcatgggtgccacacctgccacacatggtgaactagcgctgatgctgattagtgactgagggccgttccccttggagctcactctgggtgctgtgcattctgcggtttggacaggcgtgtaacatcctacacccagcgctagagcatcacacagagcagcttcactgtcctagaagcccatgtgccccgccagtccatccctcctcccccagcccctggcacctgctgacctgtcagtctccacgagcttgcctttcctgggacgccctgcagctggaatcccaccgtgggtgggctttgcagagtggctgctttcactcagcgatgcgcgtccatggccccaggcccatcccgtcctgaacacagccctgctgtcgcacatttaggggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacgtaagtgaggccgggtctgcagcagcacgctcctggccacagaccccgacgggggaagtctgtaactcggtctgaggtggccacgctgacacccagctctcagccttaggtgtaggggtggggtattctgccattcttagccctcacccccaaagtatttccatcatttcgtgcctgcaccaacaccttttaaaaacaaggcagtgggttcactgtgcacgcgaaccccatctccactctctgctcgcagatggctgccgttggcattacggagaacgtgaagggagatgctaagaagttcgagatctggtacaacgcgcgcgaggaggtctacatcgtccaggtgggccacccaccctacccctggcctcttacacattgccacgaatggtttctcatgggaaccagtgcaaggatctgccatgaagttgcatcgagcccaggagcagccgctgtacacttcaggatgctgccctgggctgtcttcaccctgagctggacccagaatgaaatgtggggaaaagtacacatcagacggggtgctgcgaggaaacgggctctccctccccaggggagctcatgtgtccctggacggtgcaagtgtgcatctggcacgcagggccgattctcacggtggggagggtgccgtgccctgggtgccaggcacagttcttcagtcagtcccgtgcatggggcacagagggtcccgcaatgcggggccacccacagtgctttcctcctctcccctcacacgcagccacctgacctttgactcctaagattatctttggatgttccgagagtgaaaccaaagcgtgtttcctcgggggcctgagtactcacctcctggcgtttcttttggggaaacaggcgccaactcctgagattaaagccgcgtgggtgaatgaaattcggaaagtgctgaccagccagctgcaggcttgtagaggtgaggctgtcttcaagcgatcgtttcccgtagcttccgctccaggtgcatttttacctatgttcagagcaaccgcacagtccccccatgcgcaaggtgcctcggcgttgaagtaaagacgctcgttcacgtggtttgtctgctccctcctcgcagaagccagccagcaccgggcgctggagcagtcacagagcctgcccctgccggccccgaccagcaccaggtgagaatggacacgctgccgcaggcctgcgtttctggagcagtcccgagcaggccatttgcacgccagggtcctcggcctctgtcagtgggaccctgtggttattggggttttccttgaggcccctggtgtttatgtgctgacgggtccgtcccagagggtgtacttcacagatgtgtgcctccgacaatgcccagtccctctccagctcttcccggggtgggctgttccacagcacggcagtgcgcacatggcctgtccagatcacagccacgccccagcactcctcagacagtcggggctcagctgggagccggcactgatggcccagcacacacgtgggcacgtttcagactccgaccctgaccgtggcttcgtcgtgtctcttctgcccttgttttttctttattttgttcatccacttatttttttcactttatcctgtttcttatataagctacctttaatcattcatggaacaggatatggcctaaataaataatccgtagaacagtagttttaaaaaagaaacactcccccgcccccccccccgccccccgaaaaaaaaagcctcatacttcagagcaagtagggtgggcgtctgttctcatccagcccgtccgggtttaacttagaagtgtgtggcccctcagaagcaggagggtgggcatctgctctcatccagcccgtctgggtttaacttagaagtgtgtggcccctcagaagcaggagggtgggcgtctgctctcatccagcccgtccgggtttaacttagaagtgtgtggcccctcagaagcaggagggtgggcgtctgctctcatccagtccgtccgggtttaacttagaaacacgtgcaggagatgctgctttaggatcaggccgggagctcagagatatctgaatgcctcaggtcctcagggcgttctgaaagactaaccaggcaacacactatttcctttttgatttgtctgatgtcatcagtccctcaagaggaaactcaaggaacatcaagaagctggaagaaaggaaaacagaccccctaagcctggagggatacgtcagctcagcgccactgacaaagccccccgaaaagggcaaaggtgggtatgtgcagggaccgggcctcacacggaggcctcacacggagctgctcacggagtgctcactgcatccgagaaacctgcgcttcctgcagtgtgaagaagctttgcagagcattcagggccccttgctcccctcttaacagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgccccaaacccaccctcaccgtggtggcgtctgtcatgcatcgtgtgtgaccattcgtgcctccttcgtcacaagggcggccacgcaaaagcgtttctttccacccaatcacgtgttccctgatgctgtgtctcgcgcacagacaccagagttatttagaggtggctttccttcgggaaaatgaaggcgagcttttcaaatggaggcttgctcagaaacggagctgtccttggctttccaggccccctccttcctctccctgccccccacccccgccttctcccgccttctcaggtgagttccctgcagggtgctgaccttgctggctgcgtgtctctgctccgcctggtggcagaggccgctcagccatcttctggggcatccactagtgaacagggctgatgggacccttgagacggagacgtctaatgccctgctcacctgcgagagctccatgatgggaaatacatggcggggaaatgggcccaggaggccctggaagccggccctggcgtgcaggcggctcttctgggaagccctgaaggccagcgtggacaagggctctttccagagaagtaggagtgttttccaatttataaaatgcttttaagttggcctgagacttgaaacaaacaaacaaacaacagattctggtgctgcaaactctgctagcgcagaactaagaaaacgtccctagagacgggccccgaaaggacgcctctgagtgccgcagcccccactcccatgccctcccggcccctccttcactgcgcggcccctcggctccctgtgttttgctcacagaagctcctttttcatcggtggaaaggggccacaacgtcggtgtccccttccagcacgagcgcgggtcagcctcctcgccgcctccctccgtccttcacactctctctccggttgtatttctgcctcctcctcctcttgcagcttctcctaccagtcctgacaaaaaagccaagcggcatgaagtaaagagcgacccgactccctttggtgtgcgaggtagagtggcaccctcgggcacggcacccactctgcgttggcaggaagcgcggcccagctggctgtcaggtggccgtcaaggccacctaagggggatgctctcgtgggtctttatgctgcggaggcagacacgcggttgtgttcaatgtgtgatgctctggtgacaggtcctcgaggacagcacgcctctcagccaactcctcacagcaggtctatctggagcctgcggaactgcccaccccgtcggtggctgctggccacggctgctgcgctggtcacctggccgtgctgggtggagctgggtggggtctcactgcccagtggctgctgtcggctatagggcaccctgttccctgcccttccctgtggcacagtttgccccgacacttcctgctgggaacacagagcatagcaactggcagggccgacccggaccctcctttcccggggccaatgaggccgagctccctgtccgacccggaccctcctttcccgggccgacgaggctgagctccctgtggaacctggcccttctcgtttcctgcctcccttatattctcagggtgaaaactgccctgtgaagcccagagacctcccctggcctgttgaggaccttcaagtgcagggacggggctcatgtttgcaatcttgagttttcaaaaatttgcaaaggttcccaggggtgtaagcagaaccagccttcccattccgcccgcctccacagcctcctcacatgacacagcgagcctcacagaaccaggcagaagctgtggccaccctgggcatgagttcagaggcagggagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctcagcctctgcttccgtctcgtcatccatgaatgaagacagtacagccttgcagggtctcgagaaagccagtgtggtgttgaagccgggccactgcccgtgggtcatttccaccgtggtcagtgtggtgtcagagccgggccactgcccgtgggtcatttccaccgtggccagtgtggtgtcgaagccgggccactgcctgtgggtcatttccaccgtggccagtgtggcgtcgaagccgggccactgcccgtgggtcatttctgctgtggttggtggtagtgagcccaggtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacagcgctcttgatggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccagctcctgtgcacacacagcagcccccctttttttgttcccactgtcctcaatcagacttttggttctgtctggccagaggccccacgtgcggtgcctcagagcgactgggggcctggacggggagggcacgctggcagccaggccccacaggccagtccctgctgctgtagaggaggcacctgggcccccacccttgctgtctctcagcctcccttgctgggggcagctgcaggtgcactcaggaggccaagctgcaggtctgcaaccggaaaatcacagtcctcaattctcacacagatgcaggcctggtgtggtgcctggaaggctcaactgcctccagctgtgaccccaagaaggcaaagcacccgggtggggtggaaggagcagccccgtgctctgctggctgacagtggtgcccaggcccagctcccttctctgcacagacagcagagttccgcttagcacaggcttttccttgccagcgcagacgctgtcagccattggaactggcctgcaagacagcttgctgtggcggctttgcaggcacagggcacacaggcatccgtgcacgcagctcctctgtcctccccatgccccacaccctccatcgcaaggaaacgcttgcttccagtggtaccaaataggatttggaaccagtttgtgcccaagctcaaatctcgttagcatctgcctgtttccctggtgtgcatgtgtcctgcctcgatgcatttggcagcaggtgggatgcgctgggcctgctgcctggttgctggctttgcgtgtttatttagccccaatggcgtctcccatctcccccgcatgggaaaggccggtgctgccctctgggagcctggcaggaggaacactgggttggggaggggggcatgtgtggtcccaagtctggaagaagctccttcctcttctcccgctgggagctgcgtggccgatgggagcccatctccaccgcggcacctgcatggtctcagccttccggttcggtgccgctgtgccgggggctactctcttgccagtggggaccacagccctcggtatcccataggtcaagggcgtcaggccctctcagtgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagggcgtggcttcccagggcctggggatcgaggtctcccacagggtggcccagcaattggaagcagatggtctcaaaccctgaaacgtgccaggcattctggaagtttgcaggggtgtcctgctcagctctttatgaacccgggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacgggggctggtcaagtgcagaggagcagattaactcgtccgacgcagaggaggacggcgggttgggccccaagaagctggtaaccacggcttccctgtgggcacttggggtgggggctgccctccggggattaggggtgcttctggcaggtccacccaggcttgggtcttaggacacagccccagctcctcctaaccctggaaggtccacatgggcctgggtcttacgggcagtgccagctcctcctaactctctctggaaggtccacccagacctgggtcttggggcacagccccagctcctcctaactctctctggaaggtccacctgggcctgggtcttaggatgcagccccagctcctcctagctcctctgtctcagcagcactttgtgtttctgggttaatttccaggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaagctgccatgtgttaatcattccagtgagggttacaccaagaagtgtctgctgcaccttctgtgctgtgcgtggtccatgccccaaggctggaggtgcaaaggggacaggtcccggaggctctggaagggcagagaagccaggcgtggaagggtagggagagccctcggggcctctggcctctcccacagagacagcatgaaggaaggcctgggcgtgagaacagatgtgggggacacagaggcggaggccacgtggcaggaggggaaacaggctggtggaacagggtgcacggggcctggggagggatttggatctcattctttgtggggtgtggggagtgatcctggctactctgggcaccacagaggcaggagccagtacaggccatcacgtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaaaggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 1651 - DNA, 119208 bp, Homo sapiens
ggctgggtttctctagcacctcggcattgtctgcctgctcttccaggcgtgcagggcagtggtggctcgggccaggctctgggaggccgggcactctgaggaggtggctcagccctcttgggttctttcttgtgagttggcgaagcccagagtcaccagggtcctgagcacctgtctcttgtgaccatgcggcacccgcccggcttttagctgtcgcagcagagacccgaaggctgtggctctagcatcagggggtcgcctgtggtccctgcgtgaagaaccagagctgcctccgctttgtagcagcctttgtgacagggcggttcgatggccgagaagggagcatcccggggaaccctgcggcggctgtggtcactgcccaggaggcgccggggaactgcagggcgctcgaggccaggtgagatacaatggggtcgcagggcatgggggcaggtgctgtgtcccctctgcaggtgtcctctctgcgggcaggtgcctccctggggtatttctctcaccacttgaccagcaaaaacctgtgcagctcggagacttcttaaaaaggtagagataactgctgagcatcccactccaggtctgtgggtccagttttctttgttcatctctgggtcggccctgtcctgcagttctggaacctgggcttacgaatttccgctccgattggaaagacgagtggactcaaagcgagggaagcggcagtggtgggtttaatgaggctccccgggcacacgcggtctgtgggcaggtgggtgtcctttgcatcacaagaggtgtgttttgggtgggatgagggtgcagagctgtcacaggcgtggcccaggccaggtggaccaagaatgccattcaggaacagcacgtttgctcggcctgatggaacagcctaaactctcacaagtcacagccagtgcttttgttcacttcagaggagcaagggcattctgctggcttgagggggagaaaggagcttgttgctgatttccgctccatcctgccctttcccctgtctggcgacctggaaccacggtgggctgtggaacgtggggcagaagttggctggggccagcccccacccctgctttgacttggctccccacggagtttgggagcatttatttcagagatggatgggcggcggctgggcattggcaggtgggcgtcagggagaggaaagggaggcagcgaacacatccaggcgatgcctgactgtcctggggctgagcggcgccagccaggagggccaccatgcgcaggagagcctctcaggctgccgccttcccctttcccccgccttcccctttcccccgccttgggcacggacagagcctgtaacactgaggagggctgtgtcactcactgccggtcagctgagcgtgcaccgtgtgggtgcaagtaccccagggctaaaataacagatcccagcctccctccgagtccactgacatccaccacagcaccgtgtgagggaggcagccaggggctgtgcgtgaatcccgcacacgccagggtgtccagcgctccattcacgccccaccaccctcccaaagctgaagtcttaagaccctggacatgagcacagtgggggcttggagatggggaccccaacacatccccttcctgtgcactggggaccctgatacgtccccttcctgtgcactggggactctgacacgtccctttcctgtgcactggggaccctgacatgtccccttcctgtgcactggggaccccgacacgtcccttcctgtgcactggggaccccaagacgtcccttcctgtgcactggagaccctgacatgtccccttcctgcgcactggggaccccgacacgtccccttcctgtgcctgagaactcctgagacatcccctcactgtacataaggacccccaagatgtctccacaccatggggtaccaccctgttccttgtgggagcaggagaatgcaggagctacagtgaacttgtccctgtaactctcacagcgacagggcctctctgcggtggcagtgttgggagacgcgatgagagtgtcatccgctgtgagttctgcggtgctctggtcccccgtgaagacatcgtccacgacattcacactcactgagccacgtcctgcccttggctggaatgtgagggcggtgagacacccccatcctgtaaggaagtgtgcaccgagccctggtccccagatgcaccgagcccgtggcatctgggtggagcggcctccgcggcacagatcacctgggtgtagtgagaggcagactctgggtccctgggcctgcgagcctgagaccggatgaccaccagctcctggcagggtccacaccccgaggcacaggcagggggacgcatagcccaggtgtgggacctcctccttcaggccgggcggtgcgggtgcggctcagagcccagtgccctctgcctcctgttgcctgggccgccagcgtgacccacctggcatggacgcctggggactgagccttgtccggccccctcccagccctggctgtctccctcggcaggagctcggcaccccgcaggttttcttcccaggatgtgcgtctccgattggaaggtggaggagtcacagatgcccctttgtgtttccaggcctggactgggcaggccccggtcagggctgggggaagatgctcagctcatgttggacctgaaggttgtgggaaactaggcccggagtgcagcagtggaggccttgtctgaggggtcgggcagtgggggccccagcagagagcatggggccgacgagggggacaaagggacaagagctcaggagctttggaaagaggtctaggggcctagtgggctccaaggagggcagagaagccccacgtactcctagtaatggaggccgtgcccacctcgtgaaggggatttctgagctggggccgaaggcacaggatgtggtggcgtaggaagagcagtgatggaggctttctccaagatgttggccgtgccgtggagaggactggacgctgggccaagggtggccgcatccatggggcctggagcctgcggactgcaggaagccacagagtgggtggcagcaggggacctagggatggagcgagcccaggctccgtggcaggtggccgggggcatctccccaaggctctgcccctctgcccatcaggtgggaggtgcggcagatggggagtctggggggcctcctgcggaggagggtgtgcgccacggaaggctgctgagccctcattgtgtctggtgggaggcgggcgtcacagctgtgccgagaggcctgctctcgcgtgctgtgggaggggggagacgtggtgagggagagctgggcagggaccatgccgcttaccctcaggacagggtgagctgtcccagcagtggctgagcccgtgctgcataagggacttggcgtgatgtctgtgatcgtgtctgtggttggaagtgacgtctgggctggagctgacacccagctggagctgtgacaaaggacaggatgatcagggaaattgcagagaacaagggcgaggatggaagcttgaggggcgccgaggtgtggagggggtgtcggtggaagaaccctcaggagctgggctggggctggggctggggcgcagctcgtccccgagtccatggtggtgacgctcaggaggcgctggttccagtggggaggttggggaaagcacttcctgatgcctttgggtgtggaaagtggtgggggcagccaggctggttcagtgcaaggcctgaggtgaggttcaggtgcggcccacgggctgtggcagggacgcagcactcagcaggtgcctcagggtttgttggaggtgagggggtagcagagcccctcacacaggtctaggttgcaggttcatggcagctgggtagggacgggaagctccagtaagattcaccatgggatttttcaccagaaactcctagaagttagttctgtgtcgtgagaataaaaaagttaacatgtctttggcttcccatctgctggggagtgtgcccagtggcactgcggaaacccaggccggacctcacaattgcaggatgagcctcctcccttctatccggcaggtggccttctccaggcattgccctgcacctcgaggggcagcggggcttaagtcaagctctgtaaatgcggcacccgacgtctgaggcccgccacgctgcaggttcccatctccaaagcccgtggtgctgggcacggcagagccgtaggcggagacagggagccgggaggagcgtcagatgcctgtggcctctttacagctctgtcccctgccttatctcgctggctctgcccttggtcatcaggatgtgaggcggtgacggacacttcagtgctctgacgcactgtggccccggggaagcgtggtgtctgcagcctcctgggccttcccttctgcctggcttcctcctcctccacccgtccacctgtgtgtctgggtcaggctggcttctgcatctctgtggacagacctctccccgtgctgcagctgttttccttgggttgagcactgaaaagagcccctttgggttaggaggcaggtggacttccactcacatggaggaggagcctcctctgcccggaggagacggtgctgggagaaaatgtagctgcaggtggagattttctgataaccaagagtggatgttgtctgtttactgagtggaggttggggccggtgccagggttgtccatctcccctctgtcctgcatggcatggtggcagagataccaccatacttcagaggcagcagcaccctcgccgggtgccggatctcccagggtccacctgtgctgccctgccctggggtatttggagctgagttccaattaagccaagaaaaacagattgttttacttagaatttagaaattctcctttttttttttttgagatggagtctcgctctgtcacccaggctggagtgcaatggtgtgatcttggctcactgcaaccctgcctcctgggttcaagcgattctcctgcctcagcctcccgagtagctggaattacgggtatgtgccaccgcacctggctaatttttttggtatttttagtagagatggagtttcgccatgttggccaggctggtctcaaacttctgaccttatgtgatccgcccgcctcagcctcccaaagtgctgggattacaggcatgagccattgcgcccggcctagaaattctcttcataaaacgtgtttgagattggcacaggaagtttcaaacagaatcaggattcaccataagaagcagataaatacatttgaggcacccagggtgagtgatctcagcggaattcccctttaagcttcctagtagcgcgtgcaaaaaggaaaacgtgtggatctaagactgtgcacaaacaaaagctgttcttctgggaggaaccaatccctcagcaatcacacttgactccctcgaaggaaagctggaaggggagagggcgtcaggatgcaggtcccggtgtctctgtgcagctcatcctccttcagaggccgctctgcttctgtccatccctccaattgccagtggtgtcagcatttggggccgtgatcagatggaggaagactggcaagcagtcacccccgacaggactctctggctcagcctccccaggaatatgctgctccccaggcacagcggaagacctgctgcgtttcatcttccggctgcctgtttaaagcaagggaggccatgcccccagcggggtcccttgtgcctggacccaaggcaagaatagctcaggcttgttcctttttcctcaagttcctctcgggcgggcacggtgtgtcgcctggacctgcatgtaaacatcagggcggagcaggaatcggcctccaggagggtaattgcctggcgtactctgtcccaggtagtgggtgaaatgaaagtaaaaagccagctggtccctcatgcagattttaggggacaaagttcagcatagaaaggtcctgttacaaggagagggttgtggcgagcccagggcagcgcgcgtcctccccggcagctgatcctcgccatgggggacggaaaggctgtccggatttccgtggcggaaatgaaaagctactacctgtattctgagtggtgctcctggctgctgtccgtggctgagggtgagtctcctcgtcccctgtgagtccctcgcaggtggtgtgctcggagcagtcgaggcggcctctgggtgaggcagcatggaggtgccctctgtggatgccccgtgctccacagggcagtctgtgtcccctgtggaatttgcagtagctcagggagtggggatgagaagcaaatgagcttttcaccctaaagttatcatctgatcctaatttatgtcacagttaccaaaagcaaataacctccttttgtctggcaagcctgagcctcacaaactgtgcaaacagctgggggctcagcctgcaccaggctgccccgcgtcttgagagctctgatgtcccggggccatggctgcaggtgcaggacagagacaaggccgtgaccgaacactttgctggtccccttgaccatgggacacccggtgacgtgcctgaggatcggccccggcacaccgaagcccggtttatgcagagcttcccacggtcagccgtgcagggagctgtgagccccggccactcttcctcttcccgtcccgtggtcagtgagcccccagggccgtgcgtggggctgagcaggtctcctgcctcagaaggcatttccttcattccacctcgaaatccagaaaatgccctggaacaagggctcgccccttcactggctgaatgccatctgtgtgtctgcctggcatgacctgcggtcggggtctgatcctgcctgtgaagacacagtctctgtgaggatggggccgcggccggatgccatgtggcgctttcccggggcccagagtgctgagtccttgtcctcagagttgcagctttgctgtttataaaactgcatccactctcttctgaactcacccgttctgcagatgaggagagtcaggaagtcacggagagaaatgcgcatcacagggttgtcagagcgtcccacgaacggtgtgggaggacacagcagtagacgtcagcaccaccaccgccccattcacacctgggcttcccccaaacctcccacctccccacggtcccactgccctcggaggacccaccgcacaggggtgtttaagacagtggcggtgctcccgggagaccacggggtgtctctgaggacaggcggtcccctgggccccctggttaggacagaaacgcaagagccacgcaaacctctctgtgacactggggaccccctgagggagggaagccccatcggagggtctgctgggcgggcctgcctgcctgtgggtggacactgggccgagggtgccaaccctgcccacggggcctcagtcctgcagccgggtctgcactgcgccctcactcccctgcctgcctcacagaccgtgggggctcccccaacagtggcgcgtacgctgcactctgccagggccgtctagggttctctcaggactgtggggatgcctcaagggtggcaggagccacttttggccaatatgcagttagatttgataagaaaacaagctggcgtcctgcccaaggctccggggaggtttcaggtgggactcggagccagtgtcggagctggagcacatgaggtcgcggggccacagccaccctgggctgccgcatttccatctcggtgggtccttttacacagatggcacccggtgaactcactcagtggagctgcctttccctgaagccattccttcacccggctgcagggccgcagacagcacgggccgcagggtctctgcagcttgttcaggttcagattggatggggtcccagaaggcatctccctccacctgccccttccagcgctttcccgaaacgctgttgtctgcagccacgcagagggtggcgtgcgcctggagcacaccttgtggacgcagcccagggctcgttgtctgccccctgatccacccagcacaaggtcagcaccagcacccattggtctttttcctctcttgcttttcactcactgctcacactcccttcctcagacaaattaaaaccaagtcggagaggcccagcaggggaagcagagttggccttctgcagccgcacagttgagtcctggagttcagagattttagctgctctgcccaaaacggtctggcagactaaggaggaggccgggtgtgaggtctcggcctgcgctgcatgcaacgttttcacttccatggtagtggcagaggaaagggaagtcctccatactgtggcttgctggtctttgcacggtggtgagagggttgggcgttgggctccctcgcccccatccggcctctcatccctgtccagggcctggaaggggccagtgtgtgtctggaaagtgtgaagtctggcaggggtgtgggaagtacccatgagcaccatcgctgtgggcggacagtgatgggattgtccccctcgtcacagcggacctgtgagaaatgaccagaactgaccctgcccagcccacaaggggacagcctcatccaagcaacacacacccattgtcacagttacttggaatcctgctctatatttttgttcttcagagaaggggaaaagggctgggcatcagaagattgctctgaataaacagtgtgtttagaagagagtcacagggtcaggctgcggggcgaggaggcctccttctggaggtgcacatgccactcgtcttggggctgagaccaggagtttgcaccgattcagagggaagtcgacggcatctgtggcagcgcacatgtacacaccgtgtgtggtggtgcagctgcctctgcccgggatgcatgatgctctctgtggtcctcgtctactgtgttttttttttttaattctacatggtgagccaaaaaggttgttaagcacctttggggtacagccctgccatgataagaatgtatttctaaaatagtggaaaggaaagtcgtggagaaggccagcacctgcccggtgtggggagcagggcccgggcacgtgaacctttccctgcggagctggtgcctgtgggtgcacgggtgtggtgcgttttaattctcggcagctctgtgcggcctggagggacgttctgtcctgagcaggggatggagctaccacacccgagtcctccctgagcaggggatggagctaccacacccgagtcctccctgagcaggggatgggctacgacactggagtcctccctgagcaggggatggagctaccacaccggagtcctccctgagcaggggatggagctaccatgcccgagtcctccctgagcaggggatggagctatgacaccggagtcctccctgagcaggggatggagctaccacacccgagtcctccctgagcaggggatggagctaccatgcccgagtcctccctgagcaggggatgggctacgacactggagtcctccctgagcaggggatggagctaccacgcccaagtcctccctgagcaggggatggagctaccacgcccgagtcctccctgagcaggacatggagctaccacgcccgagtcctccctgagcaggacatggagctatcacgcctgagtcctccctgagcaggggatggaactaccacacccgagtcctccctgagcaggacatggagctaccacgcccaagtcctccctgagcaggacatggagctaccacgcccgagtcctccctgagcaggggatggagctaccacaccggagtcctccctgagcaggggatggagctaccacaccggagtcctccctgagcaggggatggagctaccacaccggagtcctccctgagcaggggatggagctaccacaccggagtcctccctgagcaggagatggagctaccacgcccgagtcctccctgagcaggacatggagctaccacgcccgagtcctccctgagcaggggatggaactaccacgcccgagtcctccctgagcaggacatggagctaccacgccagagtcctccctgagcaggggatggagctaccacgcccgagtcctccctgagcaggacatggagctaccacgcccgagtcctccctgagcaggacatggagccaccacgcccgagtcctccctgagcaggggatggagctaccacaccggagtcctccctgagcaggggatggagctaccacactggagtcctccctgagcaggacatggagctaccacgcccgagtcctccctgagcaggacatggagctaccacgcccgagtcctccctgagcaggggatggaactaccacacccgagtcctccctgagcaggacatggagctaccacacccgagtcctccctgagcaggggatggagctaccacgcctgagtccttcctgagctcttagactccatgcgagttcagtgatgctttcttttctaatttgccaatctcttaaaccagcagtccccaatctttctggcaccggggaccagtttcatggaagataacttttccacagatcaggggtagggatggtttcagggtgaaacggttcacctcagatcatcaggcattagattctcataaggagctcacagcctagatccctcgcatgcacagttcaccataggttcgctcctaggagaatcaaacgccactgctgatctgacaggaggcggagctcaggcagtcctcactcacccgccactcacctcctgcttaccccctgttcactcacctgccgctcacttcctgctgtgcagcccgaccagtaccggtctgtggctcggggcttgcagacccctgtgttaaaccattcagatctgtgggaaccttgtctatcctgaaagtgcaggaactaccacacccttcgtcactttcttatgtttaaagacccctggaacttacagaatgtggtggctacaccaggtccagccctgtcgtgggatatttgttccaaaccctgcagtgtcaggtaagttcggggacaggagaccactttgtcttcaccccagagaagcctgtttttcaaggacaaagtaaagagtgtgctaagcaaacccagtgcaagtgcttatcccacatacggtgccttgagaagtgtgacataataaaccacccggtggccgaggcggggagcagtggctggcagagaccctcgcacagtttccttcagaatcacatggaggggtctgctcttgcaaggagacctttgctttccatgattgccaagagcagttcagaggactttccacgacttctatgtacaggcacgaattttcagaaaaccaaactgctttctgtgtggagctaagaacaaatgaattagcagaagatgacaaaggtcccaggggtgcttttcttcatcccgtccttcttcacttacttgggaagtgtgtgcccagcgtctgctctgtgccaggccaggccaggcccaatgctgcagggaaagcaaagaatcagtccctgttccctaaacaacgggcagggatgacctggggtaaggagaactggcgtgcttatcagctttgaggagagcgcagctggctgaatgcgctcctgaaaacccgctgcctcctcccctgagccaccaccctgcagccatgtgacagtaaactaggtgtttgctggtacattgttgccacagagacaaaaacaaagaaagcctgctcggcctccgccacctggctctgcacctggggctctgtacctgggtccagctgctctgtggggcctgcaggaggggacgggacaggagctctccttccaggaagcagtctcagctgaacttgagtgtggccacagcactgccctcactgaggctttctgcgaaatccggccgcctgccacctgcttctgttaactttgtacacgttgtgtgggacctgattcgctgtgttttggggggcatctcccgggacctgatttgctgtgttttggggggcgtctcccaggacctgatttgctgtgttttggggggcatctcccaggacctgattcgctgtgttttggggggcatctcccaggacctgattcgctgtgttttggggggtgtctctgaggacctgattcactgtgttttggggggtgtctctcaggatacgaacacctttcagacacattatccagttacagtactcattccacaaggaaataatagcagatttttaaagtgtgacttcattagaacattggaaattttattagaagttgctaagtatttcaaaaatctatcagaagtttgcaaatgattttataaagacagaccctcaagatgacagctcaggatgcaactgaaatttgcttttttgagtgtatttggcgtttgctgtttgtgaccctgattttcatgctctgcagcagtctgtgctccctggccgggaaagggggtcatttgctcagagccaggagcccttccctgcgggttaagttaccggaagtcatgtctggcagggcaggatttggctggttctggtctcaaccacagccgactccacagggcttggcctatgtgggattcagcccacgaaaacaatttcttgttaaaagcacctgtcttaccctccctagtgatctcactgtatttaaaatatttatttaaacaaggcaagtattccctttttattacaggttgagtgccccaattagaaaatccaaaatgctccaaaacctgaaacttttgagctctgacatgacatcacaggtggaaaatccacacctgacccgacagtcacagtcaaaacttatttcatgcacaaaattaaaacagtgtataaaattaccttcaagctacgtgtatgaggtgtgcgtgaaacataaatgaattttgtgtttagactcgggtcacgtcccaaatgtctcattatgtatatgcacatagtccaaactctgaaaaaaatccaaaatccgaaacatttctggccttaagcattttggatatgggatacccagcctgtaggagatacttggccatgtttagtgggagccaatggatgtatacctaagaatctgcctaaacctcgaccgtgcttcctgatgtcatgaggcccagtcggaatgtgcccgacttccccatctcagtgagggcagtggaaggggaagccgtgctcctgtggggagagccaccacccacccaggtgctccagacgttcccgccgtgcgtctgtggtggccacgtctcatcctcagtggctgcacgtctgttccttgggagtggattagggaaataagcgtggcctgtaggaagctgagtttgaagcagtgagctgggcccactgaataatgatgtggaagcttctcagcccagtctcgtttttgtgaaatggacactgaatattctagctggggaaaggtggaacttggcacttacgtaacttacccttctccccttggtgtttcgtagccaatcatttttattgcattaggtctcctatactgtaaatctacagaacatcgggaacactgaaaagttcacctcagttctggctttaaaagcactgactttcacattatatttgagctaggacaaaagaaaacatttctctgcaatgtgtgttcatctcgtaagggtgtctacactgaggtcagaccctggtgcaaaccccaaaatacttacagtggcagccccggctcagtctctgccaaacgtgcgcgggcatcaggcaggagtccatgggccatgggggtgaggagagagcggctcgctgccttgagaagctcccgcttctgcagtaaggtggcttttaagccagagattaccacgcgctgccgcggagggagaggtagcgcggggcatggggaggccacagagaggctgtactgacagaggctgggggaggatctggtgatggagacacgatggcacagccccggtgaagccacgtgatgtcttcgtgtgaacatggtggcgggggagcgccgggcacacaacatggtgggtgttcctgggcagaggcttggtgggcagtaggggccgacctgagggctctggggtcaacaccggtccaggaatttgactgttagccacagagaccgccaggagggcttttaggagatatgtgaaatgagactcagctttcagcaaggaaatcagggagcaggtggcagtcgggagggactgcatggaaacaagtggcttaggaccaccctagtcgttcaggcgtgggatgaggctccaggatcgcagccacagaagtggcagtgggaggggagggggagggtgcctggagagaggtttcagggcaggagggacggggcttagggatgtttcttggagagagggagcgagaagtcatcgtcaatggccccacgatgtcaggcttggaatttggggtggacggtggtgccatcagtcaagagagacttcagagggagaggttaggtgatcccatcccattttagcaccagaagtggctgtgtgagctgggaatggggtcctgggtgaagatgacaccacagataccttggagatctgcctccagttaagagacgtgtttgcctcctgggtgggtaggattttcccctcccttagatcggaaggcgaagaaggtgagatccacagctcgatttcccttcagataaaaggcacaatcacaacagcagcaaacacaccttcattttaaagacagcagaggaggggtggggtgggagggcagtacccaggacagggtcccagccgaccctccgccttcgtctttttcctgattaaaaaaaagcaccttcatgcggggtgcggcgcttgggaccccccaagctgacgtcactgtctgtgccggtgtctcgggcaggggcaggtgtggatgccaagctgacgtcactgtgccagtgtctcgggcaggggcgtggctgccaacggggcacggtgcgtgggatgccaagctgacatcactatgcaggtgtctcgggcaggggctggcgtggctgtcggcgtgacggggcgcggcgcgtgggacgccaagctgacgtcactgtctgtgccggtgtctcgggcgggggccagtgtggctgccaatggggcaaggtgcgtgggacgtcaagctgacgtcactgtctgtgccagtgtctcgggcaggggctggcagggctgcccaggaggctgtcggtggggcagttcctcatgaatctctgagctgagtttgtaaaagtgtgtgagagtggggaaaatatgggtgaaaatattttcagacatttggattcccctttggtgagctgtctcgtttcttcccgctggtcagggatgtggctgcttgaacagctgggcgcggtgaccaatgtgtggagagccgggaagcctgcggtgaggccgcgcgatgtccttcatcccgggcagtaaatccagccccgagggtggggcatcctcccgggcacaggctctcctgcctggggtcgccgctgcgggcaggacatatgggcctcccaagcggtcccatctacacaggtcgggtagagtgagtcggaaaggccaccgaggttgggggctgcgcagccagtgggctgggctcaaacccaggcctgcgcttcccctgtgagcccaggcagccctcgacctgtgtgtggctcggttttatcgcccaaaaaggggaacaacgcctgcgtccgtgtgcaccgggctgcggagacttccccaggtttggctccaggacggtccccaggggcgcctccctccatcccctcctgtcctgtcacctttctgcacacggtgtcgcatcctctgacctgcgtggcactcacgtgtgtctgcccctcccgtgttctcctctccaggatgcggctgtttggtggcactccgctgtgtcgaggcactgtgcccgtgccccgggctcccctcgttttacagactcgctcacggaggctcagggcgtctctgagggcacgaagctcatgtcagccagcagaatggggatgtagaccggggctcgctctcgagcctgtccgcctcctgaacatgcctgtttgctgagcatatgattaagagaaagaaggaaagagggtccatttgagagcttagggcagcgcccagtataccgtcagcactaagctgtatgagagcttagggcagcatccagtatacagttgtgcttagtacgtgttggcactgcaactgctgtccttgccgctgtgtgagctgctgctgggtggcagtgtctcagggctgccacttctgccccaggagagcagaggggagctggcggccgaggtggggtcggtggtggggtgagcctgcggcgttgtggctccaaggcctgctggcctgaagtcacccccgggatgtgccccgtgtgggaccgtgcgggatgcagggaggagcgtggctctgggtgtggaggtggcgggctgctggcatcctgtcaccgaaccctccttccacaggaacgggggaatgagtgggagagcagtgggagagtgtgccctctcccccagactcctctctccctgtggcatgagaagggtgggatctggcttaccaggtgagtgagcaggcgtggcccggaagtccgttcagtcctgggcgcacccacaggaactgacatccgcatgccaagcagcacctggcggccaccggggagtgatgccgggtgcagcctttacattcatcccaagcacagtacagccctgccctcaccccatgccaggctgactttcaccagatccaagcctgacgtcttctctccacatagtcccgagttcccctcccagggccccatttagagacctccccttttcccgaagccaccagactcatgcagtctccaaggctgggctagccctcgtcatcttctaaggttatcctacatcacaaaggtaaatggcatttaaaataaaatgtaggccaggcttggaggcgtgcacctgtaaccccaggagactaaggcgggaggaccacttgagctccggagatcaaggctgcagtgagccgagatcgcattattccactccagcctgggtgacagagcgaggccttggctagaaaaaataaataaaaggcgttgactttagagagtttctgacaaaagaatggaaatgtttctggtccctgcatctagccagctgtagtgaccccgacacgccaggatgggccgtgctaccctgggctatgtgtgcagcggggctgggacgggccaggctcgacctgtgctgtgattttccacccagaacgtcgcaaatgtttcccaccatgtggaacgtctgttggggaaatggtgttccagagtgtgcagtgcccttcagaggccctgcgtctccatcttttctccacggcatcctgcgaccgtgctcctcaggtgtgccccacgggcccgggaatgtccttcttggatgcgcccgatggtcccgagactgtcgtcctcagatgggttcatggcccaggatggcatccaggctcctggtgagccctgtgggtggagacctggtgccgcccctcctctctcctgagtcctgatggctggcagtgccgcccacggcacctggacgggggctgtgttgtgttgtctgcatctgtgcacagctgagcccctgcctaggatcctcagctgctttctctggcttcaccacccccatgaaactcctgcacagatctggacgcaccctggcagctgctgggccagtcccgccctcgctatctcaggtgtggccgggcagctgtgggagctgggcctaggcgggtgctgctgccagccccgggccgccctcgcctgcactgctttcccagctgagcggctgcttcccgtgaacggagggactctgagatcatctcgtcctcacgtctccatctggggagagcaacttcccagctcagtggcagacccagagccccaaattcccatcgagagcctcgggtgagtcttgagaccaagaccactgtgggtctggcccaggaaaacacactgccctctctctgctgcactgaacccaggcagcagatgccatctgcgcttccaggtttgcgatggggttgctgctgacgcccctgtgcagggtgggagccgaggagctggcagacagactctcagagcagtgttacacaggcagctcctgcagacacctgtgtagacatccacgtcacccatagctgggaccccgtacgtggacagcagagtggggggcatgggtgtcactgacctttgccccgtgtccactgtcccttcagccccagccacctggtgagccgcgccctctgcatctgctgctacagaggtgttttatttgacttaaggtttagctgtttgctttggcagcaggtcccaccccacagcctgatggctccagacagggctgaccaggtttgtaaaatgaaattgtccatccgggaggaggagaaagcaaccccccatccaggtcggtcaccccaccctcgtccgtcacacctggtgccatcactcccacagctccttggggtgggaagcgatgggtcgagttcctgctggacacgggcctcaggccccccgggtgtccccaaggtgcagggaccagcgtggtgacgctcattgttcagagctgctgatctggggctggcgtgtgtggtttcctctccaggcagggagcaccttcctgtttaactgattgggacagggcaggagtgggctcttggctgaggtgctgggcctgcccgcagcagcagctgtatgaagccggtgcgtcggctctgtgccctgcgtgagcccatgtgtgcggggcctttgtgttgcacttcactgagggccccggggtccactgggcacctgctgggctcaaactgcagtgcctgggccactttccatcctgtgttccgaaccccgtgcacagcgcagctcctagacacggtcattcatgtaatttctaggcacatttgtaaagcacaacacacaaataaaaggtaagggccaaataaagcacgaagtctcctcactgctgttcttgggaaggcagaacttaaacgtgtgaaaaagctggaaaacagcataccaaatacaacaactagaaacccagggccctggcatgtcagggaagggggagctcagagccaggccaagcgtgaggaggccgtgagccacaggcctggccggggctgttggggaaatgggctggggacatttctggagggttccggagggtcctggaggcctcaccaaggaggctggagtgattggttacattattcatggagctgactgggctcccaggacgggtctgaaatcacaccaaagggaagcctgcaagaaatcacaagaaatgtgctttcctgggggatgggatggtcgtgtgttcaaaatgtgtgtccctggggaacggctgtgtgtctggcatcgacttggcctggacttggcttctctactgcgctcccgatcccaggtgtggggtcgattctgtcttgcgccgattggaggcctctgctgtgggtgtggtttcacgtgcactgtctctggctaaaggtctaggtgcttggaacagcttttatgaatcggaaactggacagaaaccagcctgaggccgtgcgagctcccacggcccttggaggaaagctgtttcccatctccagccagagaagctgcagggatgcctttggccttgacttggtcagcagggagctggaagggtcaagagctgtgggtggggagccctcagtctcctggactgagtgagaaacggtgggtgagcagccatggccacagcgatgagcccgggatggtttcccgtgtgtggttcgggccacgtgttccggcctctgatgggcattactgtggccccccagggacacagagcagggccagccctccctggcacagggccattgtgagccagtccctcctgaagatggccaggtcctccccggcttggggccagaccgcctgggtctgccctatggtgactgttgcgtggcccccttgcttgttgagcaaatccatgagactccactgtgtaccctgaaggagcacagcctttgcccaccagaaacttcagtgtgacaagacatcgggggccaggagagacgcacagaagaggggagcagctgatttctcggggtccttgcatctgtaccaggggcccctccttccccacacgacgccctctccttagaggacagcctctggcaccgctcactcactgtccctctgtttaaaaactgaggcccttctgtgagagcctcctgctcagaacacagtcctctttttcggctgatctttgctcactccatctgcatcagccgctgtacggctggctgcctgagacgtcccagccctccgtgtcctccagtgctgggagcaccgagggaggaggtgggccttgggcctcgggggtctctgcaggccttgagcacattgtgggagagggggtgtttggtacatgtgtcccaagcctgaggcctctgggcgtgctttgctgttgggggttggaagctggaggtgaggacacgttggactgtgctcagctgtgaggggacccaccgtgtggcaccgtgatctgctcctgtgcccctgccgcctgataatgtaggagttgtgcctgcaaaacatgcttcggacattagagtcggctgggaatgaagatgcctgcaggccccagagcacaggcagggctgaagtgcgggcggcgagtgggctgggaatgaagacaccggagggccccagagtggaggcagggctgaggcacaggtggcgagtgggccgggaatgaagacgccggcaggccccagagtggaggcagggctgaggtgcaggtggcaggtgcatcggctggtgccgtggtgacggcgtgaggggccatgatgccgtggcctcccccggggctcgtgttccagggatagctcatctgggatgcgttctgacggtagaagataggaacacagagatcccagacacaggaggtctgggtcaatgtgcacagcccaaacctgctgtggctcagggggcagctcacaccgtgggtaccagccagccctaggtccaaacttacagggaaggatggctgggctggggaggacaaataattatggatggacatcacagcccctcggtggtcgtgagtgggtgcagaggggcttgcagaagcgacattcctgccccagggatgaggctgcctctcagaggacccaggcgtggaggaagcagtggcccctcttaggcatccctcccctaagtgtgtgcagcgtggagatgagagtcttggcccaggaggaagagtgagcttccagacttagctttggtgcttgtcagcgcaatcatggctgcaagaaaagcctccatggctgatgttcccagaggcagggcctggcgaggccacgctttcctctccagcaagcgtttggacctgagggagccgaggtttccagaggcaggagccaggtgtctggcatttggggtcagccacccccagaagccggtgttcccagcgggagaagctgaagcctggagggctggctgtgctgtgctgggcacacgcagggcaggagtcagtgcacatgtaaggctctgcggagaaaggcgccggaagaggccggggccagcagggacatagcaggccggggtcccacccaaacccagcacccctcccaggccttctcggctggggctgactccagcagtgggtgtgatattctcaggagatgtgcgttgactccagcactgggtgtgatattctcaggagatgtgcgttggtccccttagctccttgggattttcggctcaaactctgggcctggacaaatggtctcaggtaacttgggagctcgtcagggacagaacctgagtttgaacgagctctctgtgggactcccacccagggcagcggttaggagccccctcctggactgccagttttcaagtgacgtatttaagtatccccctcccggtcctggaaaagtagagaggcagccgggagcctgccttctgtgttctcggtgcaggggtattctgagaacggcccctgctcacacgggtttaaaaggaactcagtgaccacagacggatgagaacagcggacgcagctgcctcccaggcactcaaaggctcaactccccacaggcgtgtgttgccaggggcagaaggcttggcccctgggtcagcatactctccggacagctcatccctgccagcccaggtccctgcagccctggggctagcacaggggatgcggacctcggcctaggtccccacagctgtggggctggctcgggggacggatctctgctaagcatggcccctgccagctcaggtccctgccactcagtggatgggactttggcggagtgtggggcccctgcagggagggtctagacaagcaacaccaggaacctgaagcctccctggccggggctcagctgtcgccaggatcgcaacagttaagctgcctgcagcaggataagtgagccgatgctgctccttaatcagggacatcgaatcggaggccctgggaggagcagccggctggctgccctgcagaggccaggtctgcccagcaaacccaggaaggtgtggcgtccccgcttcgcggccaagatggtgctggtgctgcgccatcctttgtgtgcccgggaagggcgttccgggagccgggtcgggggctcctgactcgcactgggcagcatgacggtgcgccggctgtcactgctgtgccgggacctctgggcgctgtggctgctgctgaaggccggcgcaggtgcgtggggcgcgggcgggtcctcgcctccccggaaggtgttgtggggcgacagtgcggggacgccgggcgggggtggacgttctgggcccagccctgtcctcagaggctgctggggcagaagcccggggctgggggatgccggggatggatgttggggtgggtgcctccgagaccagaggagccctgttccttggcagggaaggtgtgcacgggccttgcccgatggatggtttagggccatggccctggggtccctggtgagcagtggggccgcctctgcccttggcctgtgagggactgtctgtgctggtcccagaaggctgggatcacctttccactggctcctttgttcgaggtttttcatagacaggctatgtggacaaatgagggcagcgcccacgtctggctggtggaggggctgcggctcctccttggaggggacgcctggccactgctgtccccacaatggggccacccgtggtgcaaggcgtgacaagctgccctctctaggtaagcaggacttgggaggcccctggccaagcctgtggacccggctgggcggcctctgtggtctcaggtttgggtgtgtttggtctggtcagggctcaggggctgctggtccacactggccccatcctgacaattggagctttggggcaaggtccctggagaaggggtcacgtggggaggaaacagcctgggttttgttgatgcttttctaagaatggagtactcgttttcaagagatttgtcctaattatattttccagcgggtacttatgccaagtattgatgaataattcataaaataagcatctttgtgaattttagtgaatcagaccttaactatcaacggcaatgaatgaacatctaaagtttccaattttaaagtaaagaactggctgggtacagcagttcacgcctgtaatcccagcactttgggaggccaaggctagaggatcgcttgagcccaggagtttgagatcagcctgggcaacataccaagacctcatctgttaaaaaaaaaaaaaaaaaattaataggctgggtgtggtggcgtgtgcctgtagtcccagccacctggggggctgagaggggagaatcatttgagcccaggaggtcaaggctacaataaggtatgattgcacaactgtactctagcctgggtgagggcgtgagcaggtgcaggtggccaccccaggttatggggttggctgtggagcactggggaaggctccagggtaagcaggggtaggtggcccccgtgggttttggggttggctttggggcaccatggaaggcttcggggtgagtaggggcaggtggccccctgggttatggggttggctgtggagtaccgtggaaggctttggggtgagtaggggcaggtgaccccctgggttatggggttggctgtggagcaccgtggaaggctctgggttgagtaggggcaggtggccccctgggttttggggttggctgtggggcaccgtggaaggctccggtgtgagcaggggtaggtggctgctttaagagaggttgtgtcccctgggtgccccctggttttgcacccctgaagccctggccaccccatcctgcagttccctcctgaaggaccaggcaaagccaggaccaccctggacaagaggaggaattgtccttctgagccctgacggttccgtgatcagacccgggacctgctccaggctctgttttagtgtctcacgtcctcttagggtacattgaagaagcattgtcggtgccagggtcagccagggtcagccaggcctgtgttcctcactgtgcccctcctcactcctgcagaggcctagggacctggaaggaacttgccacctgtgggtgacctttctcagaaggtaaaatgcagggtggggcgagccccactggccttggagagtctgtcctcgggcccagagggtgccagttgggggaggcgcagaaggactgagacacttggattccacagagaggtcaccgtggtacagtccagactgttgtttttaattttaaaggaaagaatttgttatgacgactgttctcattctcctttaggcatttttaacatgtgttccaggcagaccaggctgtggcccttccctcgtggctggtgcaggccacgcctccccccggcccagcgagtagggaggtttggctctggcatgaccctccggggcacaagtgtcctcggggagctggtccctactacatagaggccacctggcgtcacttggcagaggaggacggggcaccaccctgcagagaagcgtccatctgcccgtcagtgtgcggccacacttggtggtcctcttcaccttggcctcttgttgagcgcacctcccacctgcacagcatcctgcgtcgtagccaacaccacctcctccatggacctcagtctgcagccgtcactccatgtctgcagctggggccctggccagcccccatggcgcagtgctggggggttcctctgggtccctgtagcctccataacataacctgggagcaggaagatccccctgggtctgctcacctggtggggggcagccatcaccaaagccgtctgcctgcatcaccggctgaattgcagccatgatcccacaaggaagccttgtctcagctttacagaggaggaggaggcccagagagagaaagcaactgcccagagtcacacagctcagggaggttgtgttcagggtgaggtctgtgctcccgcagggccagtgagtgtctttcctgtggcagccgctggcccacgtgtgtggtgatgacaccaagcacacggaccacgcgtgtgttcagatgctgcctgggcttcacgttggtgcccatttctctctggaccttacgaagacaagtttgcggaggcatggcagcccgtgcatgctgttggtgggcacgtaagttggtgcaggtatcacggaaaacagtgtggggtatggaggttcctcaagtaattgaaaagagcactgtcgttggagccaggagtccccactgtgggtgggtatcggggaaaggagtgagcgtgttaaagagccacccgccctccagagctcaccagcccacacgtggaatcgaccccagtggccgttagtggatgggcgcgtgaagatgatgtggggcacacacaatagagtgctgctgggtctttgttagaaaggaaagcctgtcattcgagacagcacggatgagcctggaggacagtgctgagcaaaatcagccacaggcaaagccacggcctgctgagtaaaaccagctgcaggcacagaaaggcaaagccacggccccactcgtgtggggtgtcagagacgccgacaagcacggtggctactgggggctggggtggggaagcctggggagatgctggccggaggacacagagtttccgttgtgccaaatgaatgaagtctgggggtctgttcgtggtgggccatggactattcgtggtgactgactgtggtctgtttgtggtggccgtggcgtgtttgttgtggccatggttggtttgtggtggccgtggtctgtttgtggtggccgtggttggttctgggtggctgtggtctgtttgtggtggccgtggtctgtttgtggtgaccatggttggttctgggtggctgtggtcagttcatggtggctgtgacctgttcaaggtggccgtggcctgtttgtggtgactgtggttaacgctgtatttgtacctgaggtttgctgggagtggatgttgggtattctaactgtaaaaggaaatggcagctgtgggaggtgacagtcagtcaccagtgagtttggtggtggctatggtttcacaacgtgaactatatcaaaacagcacgtgtgcgccttaaatacatacaattatttttctcaatatagctggaaaaaatagccagaagctgtaagctcaggaagtgatgagccagccaagggctccgttcacaacaccctgcacagtgaacagagctgagtaaatggggctgcttagcgaaaatcatcggactcgaagctccctgatggctccaacatcttccgtgactctgggcaactcctgtgcaatgggaggccgtgccctgccatgtccccgccttcctgcccacaagcctgccctgtcccagccactggggtctcactcacccatcagcctggaaacagacgcatgtcggcaccctcccagcccctctgcgagagcctctccatagcctcgctgttgagcccgtggcagtgaaggtcccaggcgctggagcagacggcgtgggctcagtcctggcactgcctgccctgcagtcctgggctgcttacagctgagcctgaccttgaattccccgtctttaaaacaaggatgatgaggcttcatgctccctaggtcctcgcgaggactcactcaatgcactggagccaggtgtgagtaggaaacctgcctttctggcctgatcctccccccgggagcacagggtggtcctcatctgaaccccgagggggtctccctggcatgccctttctccctggacccctagccattccaggtgcagctgccagtgcgacccctcctgcggacaggaggtccatgtgagggctcagctgcctctgaaccggaaaggcgctggcaggcagtggctgggagagcaggcgcaccctgggcggcctccaggagagaaagggagacgtgtgcatctcagtgggggctggcgggagacactaaggtgttgaagaccctcgggtctgggccctgtggaaatgctccctgcgggtgccaccagccctgcccactcagcagtcacttgagaacgccccgagcatctggcccaggaggctcggcctggagcctcacatgtgcggaggtttggctcagcccccaagggcaggcccaggtctgtggcggggtgtggggaggcagcggagccatgggtactgtgtagcgggtagggctgtgaccggaggtggcaaagccggcagccagcccggcccttgggggagagggtggcagggtcagggtctctgaactctggaaggaacctgcgtccctcatcctgaaacccggcctcctgtgtctctcagacagtggctctcagtcactttggtctctggtccctctgccccttgattttttaagttgttctagctcagaagccattgtgtgtatggtgtgactacaccccagccagggcatgagtgcacacagatccagggtccgtgcagagcccgccaggtgtagggtggatgctgaggcccacctggctgaaactgcactcaggccattttactgatgtcaggaaacgttcatgaaaatgcaagctggtgagcaggcaagtgcccccctgcatgacagaccctcctggtgcccctggctcagacagtgtgaccttgagaacagcgggggtctaacccctgaccccagcgtccgtgtcacctgggagcctcaccttgagacccctgcgttgtggttctgaaatcacttgagtgggccgtggccaccgtgaggcggagaaagaggaaatacctgccagaagatcaaattgcaatccgtgtaatttaaagatctcactgggctttgttggcgattctagagtggggcagcactgcattccatgaactagaattaagagctccagtgaaacacgcagtgcggggccggctgtacagacagggctgaggaaagcagaaactgtgcaaacgcggttcggcggcctcagtcactgtcctttgtaagcttggggagtcggcgggagagacgtgacccactggccacttcaggcggctctgtgtcgtaaggatcagtttcacattaggtgattgccggacttacatcaagcttgaagaagcagaagatccctgcacacacgtgtggcccagaccaagagccgtcacgtgacaaactttgtgcttaaatgggtttttagtatgtgtatcttttctttttcttttttttttttttttttgagatggagtctcgctctgtcacccaggctggagtgcagtggcacaatctcagctcacagcaacatccacctcccaggttcaaaagattctccagcctcagcttcctgagtacctgggactacaggcacctgccaccatgcccagctaatttttgtatctttagtagggagggggtttcgccatgttgaccaggctggtcttgaactcctgacctcaagtgatttgtccaccttggcctcccaaagtgttggcatttataggcgtgagccactgtgcccggccaagtacgggtatctttttggcagtgtgaagaatttatttaggcttgactgttttaaagcaccataatgaatgtataattaagttatgataaagtcttaaccctttgttacaggggaacggtaatgttgtgagtggctgtgtctcagcccctggactccagcagtcaccctcataggagtcccacctctgcgggcagctcagagcctccatgtttttatatttaattctcatggttaaattcagtgccgtaactcatggaattaagtctttttaaaatctaagcaaactgtctttaagacagaaaaagttgggtaattcttcatctatttgaagtgatgctctctggatgggctgcatcctaagaatgtatcaaaagtggaaattctgaccactgttttgattgtccttttacatattaaacaagttgagagcaagaacaacaaaaagagggacctccgtgaccacgccgaggaagacagagcctggcctggttggaagattggcctctcctctgtctcctgttttctccaaggtccgataacaactcagtttcccttggagtgtggggacttcattttgattttcagtctgatctgttggggtctaggcaggagcttggtcccaaacaacacacccatgtgtgctgaggacacgctccaggggattcttacgcccgcctgcatcagagaacccaggtcttgtgggcgaggcagcgtggagagggagcgcagctctggagacggcccccagggcttgcgggcgggcgggcgaggcagcgtggagagcggagagcgaagctctggagacgacccccagaggagattggccaagtgcggatgtgcgagtcctccctgcccgaggcgcaaactgtctcactccaaagggcgtccggagggttctgcggggcggctgtgcactgacacctgccccccacgtgggagtccgccggctcctggcccttgccggttggtgttgcgcgtctgagatgacgcccctgcggtaggagcggggtttccctgatcaccgcttcttttgaccatcttttctggcagggccttgtatttttaaaatgtgtaaaggttaagctttctgagatcagaaaaataatatttagtgaaccatgtgatttaagtcactgtgtatgtgacatgaaatatttatacctaacccactagcaaatggctcgttaaacatatttgagatttaatgtaagtgagaattctgccaaccaagtcaggataaaccttaaacatcgggaatgcaaaatcaaacagatcctttaacacacatcacaaacagaggtgtggacgccccttttgtcccaatggcagggacggggcgctggcccccagggtgtcctgtttatcccctgacccacacagtgtcaggagcttgtctggaggggacggggatgctggcctcctggggtgtccttatctgaaggctgtggtttcaagcatcctccttactgaatttagattttgttccgattttgtggcctgcgtttcttcttactgccctgctctgtggccctgttcttcctgggtttggagatcctcaaggatgggcttcgggaaggcctctggccggatgatctggtgacgtaatcccatctgacgctcagccttggactttgaaaaggcacgactgtcctgtctgatggacaggatgcagaagcctttgggaatgggcattttgccagaataaataaaagaagacaattggcaaaagatggactgtaccccatggccccaggctgctgtgtggagagacttgtcctctcctctgcccacggtcaccagtgagcaccagggacggggtttcctgctgcacctgggcctcttcctgctgccaggagctgccttgctgcctccacctgtgacagtccaccccccataccccccccacccgcaccatgagaggatttccagggcccacccgcctccagtccccgttctctctgctgctttcgaggtcaccctgggctggaaggggtgcctgggatactgctcagacgtcttggccgccctcccaccccgcaacaccccgctcctggttttcaggatgaaattgtcctcaaataaagcaagcttttgagtcaacttgcaagaggaaggaagtttgcttcagtcgtctggttttgttggaacaaagagatctaaagatagacacatggtccccctccctggactgccattgccaggaccctgtttctgtgaggaaaagtcagtggtggggcctcacctgtgtatcaggtgagccaagggcacctctgcccttcccacgcttgggaaatctcaccacgtcgtccccgtagtggccagaagagattggccctcccaggtggggctgctgtggtcggtgctggggatgggcaggggcaggcctggccaccccctcgtcggccccacctgctgcctctgcccgcgtggcaggggaatggacggggcagcctctgccgggcctcagatgtgaggccctaaccctcccctctcagacctgcctctgagcagtggggtcatcactggggagttggttggagcagggctcagtgagggagctgggcctggcctggccttgggtggcacatacgggtcaggggcccaccacctcccagacgtctgacagcacagagccccacagaggccatgctcgcctgcctgcatctcctctggggacctgtctcctgaactgagtggccactattgttcctccgtgcgcttcttagtcttatggctgcaaaattaagtagactggaacttttaaagaaactatgatcataagggcagattttcccatcattcttgagtgggttcaaaaaatcaagaagaatgaaaacttacacacataaatggaagaaacgcccagcgccctgaaaatcccagggccccgcctgcagaaggcctccatgaagaacggaagaaggccaacactctggtgtgggtcagagagcatccacaggcctcttcaggttcacagagtggccagtgaccacttcagatgtagcgatattttagagtttatttgtatgagggcttagctgtgtgcagtttctgatcacacacagggggatccctgcttttcatacccaaaatgaggcatttgatctgagggacaatatttagagtttgtcctggcccagagagtccagaggcactgcgggctgccagcaggtagacagtgcagtgcagatgatggacaggtggtgtggacggtggacaggtggtgtggatggtggacactgcagtgcagatggtggacaggcggtgtggatggtggacaggtggtgtggacggtggacaggctgggtggatggtggacactgcgatgaggacggtggacactgcgatgaggacagtggacaggtggtgtggacggtggacactgcagtgtggatggtggacaggtggtgtggacggtggacaggcagtgtggacggtggacactgtgatgcagacggtggacaggcggtgtggacggtggacaccgtgatgcggacggtggacaggcggtgtggacggtggacaccgtgatgaggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggacggtggacactgtgatgcggacggtggacaggcggtgtggatggtggacaggcggtgtggacggtggacaggctgggtggatggtggacactgcgatgaggacggtggacactgcgatgaggacagtggacaggtggtgtggacggtggacactgcagtgtgaatggtggacaggtggtgtggacagtggacactgcagtgtggatggtggacaggtggtgtggacggtggacaggcagtgtggacggtggacactgtgatgcggacggtggacaggcagtgtggatggtggacaggcggtgtggacggtggacaggctgggtggatggtggacactgcgatgaggacggtggacactgcgatgaggacagtggacaggtggtgtagacagtggacactgcagtgtggatggtggacaggtggtgtggacggtggacaggcagtgtggacggtggacactgtgatgcggacggtggacaggcagtgtggacggtggacactgtgatgcggacggtggacaggcagtgtggacggtggacactgcagtgcggatggtggacaggtggtgtggatggtggacaggcggtgtggacggtggacaggctgggtggatggtggacactgcaatgaggacggtggacactgcgatgaggacagtggacaggtggtgtggacggtggacactgcagtgtggactgtggacactgtgatgcggacggtggacaggcggtgtggacggtggacactgtgatgcggacggtggacaggcggtgtggacggtggacactgcagtgtggatggtggacaggtggtgtggacggtggacaggcagtgtggacggtggacactgtgatgcggacggtggacaggcggtgtggacggtggacactgtgatgcggacggtggacaggcggtgtggacggtggacactgtgatgcggacggtggacaggcggtgtggacggtggacactgagatgcggacggtggacaggcggtgtggacggtggacactgtgatgcggacggtggacaggcggtgtggacggtggacactgtgatgcggacggtggacaggcggtgtggacggtggacactgtgatgcggacggtgcccccacggtctgtgaggcaggcaggggattgaggacagtgcctcctggtttcctctcaggtcacagtcgctcctggtgagagagaaaaacttaccgtaaaatctgaacatccaactgcgcagtctaggctgccgtcggctgcaccagacacacattccagagaggtgtgcaccagtggaagtcaccttgccaggagcatgagatagtatttcatgctttactgattgactgtttctgtctttctcccacaaaagaagccatcgccgagacgtggttgcgtactgggaatgggtctgtgccctgagctcgccctgcaaggctctggggaagggccttgacatctgcttggctctggcaggtcccatgacaccgtggccctgctgcttcccccccaacaccagggttgtgtctggctcggaggcaaagcagtcccatagctggcagggccgcagccagcacggcccaggaggggcccctttgtgttccactgtgtcccgtgtttacacttgtttgtctgcaagactggaagagcaagatttaagtctgatgccaggtagatattatctggcagcctccgctgggaatttccaggtacaaacacctctgtcccatatcttcaggctgttagtgacctgggtcctcaggtgtggaaaaattgagcgtttaagccattctcaggtcatcagcgtgagtcctgcatcttttagagagaaattgtgtggatgttcaagactgcaaatgtggctatatgatgagagcgttggccagaaatcgtgtctgctccgtggtcagtggtcagtgtcccccaggcacagtggcctggcagccgctctgtagcagagaccaccagcctgtcagtccgtacagctttccctggagggtcttgctggccccatgctcccggctggtgctggctccatgctcctagctggtgctgaccccatgctccgagctgatgctggcctagtgctcccagctggtgctggccccgtgctcctggctggtgctggccccatgctcctagctggtgctgaccccatgctccgagctgacgctggcctagtgctcccagctggtactggccccatgctccccccgtgctcccagccagtgctggcctggtggctgcaggtgctgcagtgcgtccagagccatctggaacctgctgggtggggggatgggtgtgggggtcgaccctgctgttgccatcctgcctcatttgtgtccgtctaatggcgaggccagggttgtggcacagacccccgagggtcctgtgtgtgcggaggcagaggcccattccatggccaggttttcctcctgggccacaagttactgcacctgcaacaggtgcggggcaggggtcgcctgaacattttccctaatgtgggtgggactcagaccaaagtgtatttatccgaggagccaggaccaagccctttcccactgctcccctgcctcccctctgcccaggtctctctctttgtccctccctctctctgtctctcagtccctctctctgaacctcttatatcacactttcaaaattgatggtgaatcactcaacacacagcttttatgcgctgagaaacaaaggcctccacgtattggaaactgaaaagcctttttccagccacgtgacgccactcccgtaggtgcctgtggatgtgccagctccgtgtgggatcgggtgggcgcttgcagggtgaggcagcttcctgggactgacacgtgccgtctgctctttccgtgcagatgaaatcatgcaccaggacatcgtcccgctctgtgctgccgacatccaggaccagctaaagaagcgctttgcttacctgtccggtgagttccagaagctgggatggggtggagagggaggggtctggggccgggtgtgggccgagcagcccccgtggcctggcccaggctggagctgggaagggtcatgcgaggggctgtgtattcactgccttgggtctgacctgtgacctggctctccccatctctgtgaagtgggcagctccatgccagttggcacatggccactgggaggaggtgggtggaggagggtcagggtccccagggggatgtggcctgggcacccctgacagcagcctccagggacagatggagtggtgtgtgggtggccgagcccatgggcctcagtgaaccccagttcctgctgcatctgggcacctcccaggccacgcctctgtccactgtggcctccagccctgcgtctggcacacctgtggaggtggtgcctgcagccatggggacataatgaggctcccagcacccctgtgtgggtacagcaagggcacctgcagtggccccgagctatgtagatgccgttcttatgtgaacaaatctgcccaacaggacccgtcagaaaaaacaccatgcacatgcatgcccaccctgggccatcagggtgccccgatgctgaggagggtgccccgatgccgaggagggtgccccgatgctgaggagggtgccccgatgccgaggacgcggtgctcttgggagctcagcctctgcccctctgcattcccgtcagcatcccggcccccaatccatggctggcacggtggggcctccatcccgcacctgcacctacagagccagcctgcaccccaggccgggccttggggtctgagggaggctgactgcgaggtgcagctggtgagttttatgagaccaaaatcgaagagacagccagcaacatgatggccagaggagaagtgctgtgcagtgacttggtccctgcttcccatggccaagtggcccaggaggaggaaggagagaaagcagggggtctctggagaactgaaaactcccagaggacaagggctccaatccccctgtgtcggggaccaggcgtggtgatggctcaagagaggcgccgtggtttctgccggttcctcctgcgtccccagcctctccccgcccctttcacaaccccaaagaggctcacagctttgccaccaggagggccccgacctgggcctccagccttgaccttcctccagttgccaggcagtgcccccaccccagcggtgcctgggagggcagagtcccaggacggccccagccacccaccttttctcgatcgttcctcagacgccagcccaggagctctgggggggattttgcagatgaatttaaggccccaaatcagctaactttaagatcttccttggtgggcttgacccactcagctaagcccttagaagagatggggctcttcctggcatgagggatcccaggtgcaagaaggatttgacacaagggggttctctgtgtggccccgaaggaggcagaggccgcctgaccaggacaagagccgccccacgggcagccgccaggaacccggggcctcaacactgcagctgggggcacagctctgccaagcccctgggggagctggagagactgggctcaggatcacagcccggcaacccctccacgtgggcccagagaccctgagcagagacccgcaagctgataagtgcctgagcgtcaatggtcttgggaaccacaccaaagcctccgtcggctcctctccctcctggaatataagatggagtcccctgtggtactgctgcccccgcgtcatatgctgcccccgcgtcgtatcctgcccaccccctggaggcaggctgcctccccatccccctgcctcccgccaacctcggggcctttgcacagccggccctctccatgcagcgaatttcttccgcggggcttgtggctggcccggcccctcaggccttgctcagaggcacgccctcgtacatgccctctccctcctcgcctgcgctctgctccgcccccttcgttacaccacctcacgtcctcccgtgtgtggcgtgggtccctcctgagggctgggtttgttcacagctgcctcccggcttctagaggtgcacccagcctcagagccatgtactgagggctcagccatgggcccatctggggtgggaccctggcacaccacgctgttctcaggatccaggtcgtagcagcagtaccacgtctgagaaggatcagtgtcggctggcgcttctcctgcagatgtgcgcggatttggaggaagcctgtggcagcctcgggtgtgtgcgttgccaatcgccccgtcccctcctcaccacgtccagcactgctgtgtcctgaggctgcgcctgcactccgggttcctgccatgaagcccccttttgtgtcctcatgacaaaggccatgcactgggggaccgaaacaactggggctcgtctctcaggttccgtggggctgtgccccttccggaggctcctcctgctttggggacgcaggtgttccttggtgtcccttggcatcttcatgcagccgcctcacctgtacgtcggtgtctcctcttctgcctcaaagcccctctgcctttctcccgggacacccgtcacgagatttagggcccaccgtataatccattatggtctcaccctgaaaactttgttacctctgctgcaaagacttctccaaacaaagtcatgtttacaggctcctgggacagggagtggacgtgcctttcaggggccgccttggactcagggtaaatctggctcagaggtttgctgtcttgacagctgccctcaagggggctcccctcccgccccagcatcacccatgggactcgctctccctgtctcgctccactcgaaggaaacacagactcccccgcccgccactcctgcacactgaccaccatggggctggggtccagctgggtgaggcccctcattgtgactggagcccacaggtcgacaccccagcctgttccgtggacttttgcttaattccctggtctttggatgcctggaatggcttccgtgaagtgccagagcaaaaaactaaagatgtcaggaaggaatggctccgaattttccttttcaagaggagactgcgtttctttccacttgccctgctgatttcccctccctgcgacgttcgtgccagccctgtgctgtctgccgcggagccatggctgccactgtgacatgtgcggtcccgtcttctccctccattgtctgtagacgcacaggtgccacgcagaaccctacagctctgtccagatcctggatccagatgaggcagcttttgaaaggcggccaagtgagggatgcgtaaacctcgggggctccggactcctgtacgttgccgcccaaagtcaggacgagctgcggaagtcacacctggactctgtgtctgtcatccgcagacagcagctccccattcagcctgtgtccctcgtaatccacaccctctactcacagtgacatctgccccaaaagcgcttcgcttaaccctgaagctacgagacctgccaccctactgtcccctctagttttctgacatttgaggaacaaggaattgggtgtaaaatcaggaaatatcctacatgtaaattcttgattattcttgtccttccgggcagagctgcctcctgagtcatccgtttgactctttcttactgaaggctgagggttggggggtgcatgggtgctccaaacccagaggcaatggcgcgtcccctggcatggcagtcggagcaggccccgaggaggtcgtggtctcagaactcagtccttgtgtcatcctagaaaagatacttcaacttgctgaccgtcagcaagagctaaaaacagggcgggagaatttaccactgaggaacttatgatctgaagtgaaaaacgcagagaacagacttgccaccggtgaaaaccacaaagctgaaatggaggccctgcccggaacgcagaggccaccgccactgtgcgtctcactccctgcaatggacggcggcccccctcccactgcccaggcggctcttgggaatttcgttttgcttttacgggaatgtggcatggtcagcggtggccatcagccatccaggaacctggatttgacaggattgctccatcccatgtccaggcagcctcaggtgtgtggagacagggcagacttaggagttcctcccctggcctgtgctctcctcccgggaagaacgctggagaccttcgtctcttctcctttcctcaccttccccaagcgctcgctgcacaagccccctcctgccttgccccttctcccaccccatttcggttttggtcccagcttacatctcgtcctaaggattaagtgtttgtgcagctgagccgcagttctcaggtgagctgcagggctccagcatggcacctgcctgggcagtcctgagagagggattcgaagtggggaaggaccccggagtctccctggcacgtggtctgaggctccagccaccagacccgaagctcagtctacactcaccaaggcccgacggctgctccaacctgggaggaccgatccgatcctgcgctccctgaggccgatggctttttgacacccaggcttcagccacagacagacagacgttccctgcccgtgggggtttgcccttgctggagagaaacagaaatggacagaaggtcactggggtggccctgggtgttctgcggagaatcaaagtcatgagacggagacaggaatcccgttaggtttgggcagagtcgcacgtgctcctttctggacctgcttcaaggaatccgatggtttcacgacatccaaccagttgctataggataaatgtttgtgtccctccaaactcagatgttgaaaccctaaccccagaggtgatgtttggggaggtgaggcctttgggaggagattaggtcatgaaggtggagctcccaggtgggatcagagcctttataaggggctgaagagaccagatctccttccgcagcatggccatgcctcaaggagacctctgaatggggaagccgccgtcaccagacaccaagtctatgggcaccttcatcttggacttacctggccagagctgtgagataaatttctgttgtttgggcctcccggcctatggtggtttgttacggccgcccagacagaccaacaaacagcctgtgtgaaaatgcgagccataaacgagtggtgttgacaaaggcatcctgtccaggtaggagttccgtgtggctaagtagtgtctagtttcagaatgtgatgccttcttgatgtcatctccacactggcaggaggaggtttttatttagttcttattttaagatttttctacccgacagttaacttaggatacagatgtcatagtaaattaaccactggaatgctttcattcctaagcagctcatgtgggtgagtttctaaagccgtgtttgggccgaggcatcacacaagagggtgtccctaagatgcatcacgtccgtggagaaaacaaagcaggacacacgtgtgagtcgtcacacccttggtcacccggcttggccgtcacacatgcctcctgcccaggacgcgtgtgcgtgtgtgtatctacctgtgtgtctcaactcaggctgcttgctgtgacaaagtcccctagactgagtggtttaagccacagtttatttctcttggttctggggcaggaagtcccggatgaaggcaccggcagatgtgctgcctggtgagggctcacttcctgatttacagactgcagccttctcgctgtcctcatgtggccaggcgagcagagcaagcccacagaatcccattcacgggagccccactcccacggcctcctcccctcccacaagccccacctcccagcactgtccccgtgggggtcagcatttcaacacatgaattcaggggaagacagacatccagtccataacagtgtatatgtgtagctgtgtgtatgtgtagatgtgtgtatgtatagtgtgtgcgcgtgtgaatgtgtagctatgtatgtttgcatgtatgtgtagtgtgtatatgtgtgtatgtgtagatgtgtgtatgtgtagatgtgtgtatgtgtgtgtatgtgtagtgtgtatgcatgtgcatgtgtagctgtgtatgtgtatatgtgtgtacttgtagatgtgtatgtgtgtgtatgtgtagctgtgtatctgtatggtagctgtgtatgtgcgtgtagctgtgtgtgtatatccatgtgtgtatatataggtgtgtatgtttgtacatatatgtacatatacatacctacacatccacatgcatatgtgtgcagctgtgtatacatgtgtgtgtaggtgtgtgtctagctgtatgtgcagctatgtatctgtgtatagctgtgtacatatgtgtgtgtttataagtagctgtgtgtgtaactgtatgtgtgtatatgtacatgtatgtgtgtataggtagctgtgtgtagctgtgtgtgtattaaactgagtgtgtatctcacactaaagcagatcccgtaggaaccacacttctttctggtgatggggatgagagggagttgcatctgccttctgcccctagcgagtggatgtaggcccagttgcttgggtgcgagagttcacatgcaggtgtgacaggtctcagccaggacagtggtttttggacgtgggtggggaccggaggctgcccctggtgctgtgtggacagggtgctgttctgaaccacagaggagcttcggagccctctgtcctctgcggcgttcagtccgcctccagttactaggccgggtgtagacacagaagtagagcctgttcttggtgccattggccccgggtcctggcactgcccaccttggtggggagggtttctccagagaggggctgtgcccccagctccgcgtccagcggtgttttgctgcctcataacctgcaggtactgggagctttggcgcctgcttttcagtctcagtggacagactgggatttccactcctgacttgggaagaaagaacagggtctttgctttgcattgaggctgtggtggagcacagagagttcagagatacccagggtagcagcagcctgagaccagcaccagctaccaactgaacgaggctgtgcggcccaggccaggcccccgtgcgatttcagctccgggtcacctggcccccatcctctcccctgggcagctggaggctccaggccttcctgtggctagctcctgccccaaggctgccctgctgactgcaccctcgaccctgtggctcaggctggcctctgggggtccccggtctctgtggttccagtgaggcagcagctcccagatgccacctccacactgtgggtgggccagccagtgctgagagggagccactctccacctctgtgtccaccatccactccaagctcccaggctgcctccacgttgtgtccaccgtccactccaagctcccaggctgcctccacgtttgggcatgaggggatcttgttgcatccgctcctcttcctagctgggccctccacagccagtgtaccccaaggagcagcttctccctcccacccacccccgccggccaggggtcctcatgccgtggcccatgcccatttgcacagggacgcagggggtctcacacacaggcagggtccgcccccagctgccgtcggcgtcactccacacacataggcttctgggcggtgctggaagcttctggcccctgaacgttccccccaggccccgtttcagggaaaggaaaggcaggcgcaggctgcggccgtttccacaatccacctcgtagctggggcgtgccgcttgcctcggcttgtcccggcagaacactcttacctttaatggcgactgaaaagttgccacgagttcctgatcattgtggtaggtgctgcgtgaagctgagacgtgcgtgagccacatcccagggggctttgagcccccaccgcggcggcggctgaggggaggcttgtcgtactcgcacaggaggacacagggctgcagtgttcactccagggcctcttatcattgggatctgaggaattttccgagaggaagtgcgaattaacaatgatgaaaggtttgtgagtgagtgacaggcacgttctattgagcactgcatggggcattatgtgccaccagagacgggggcagaggtcaagagccctcgagggctgggagagttcggaggatagaagtcatcagagcacaatgaagccagaccctgcagccgccttccccttcgggggcttccttagaatgcagcattgcggggactgagctgtcccaggtgaaggggggccgtcacggtgtgtggacgcccctcggctcagccctctaagagactcggcagccaggatgggctcaaggcatgagccctcaaaggaggttaggaaggagcgagggagaaaagatatgcttgtgtgacgtcctggccgaagtgagaacaattgtatcagataatgagtcatgtcccattgaggggtgccgacaaggactcgggaggaggccacggagccctgtactgaggagacgcccacagggagcctcgggggcccagcgtcccgggatcactggatggtaaagccgccctgcctggcgtggctgggcttggccaagacccagaagcagaagttccggaagctggagacagtggctgtggggggcgcaaggcggcgggggactgtcgctgttacgagacaaagctgcagttgtcggaggctgtgtgcaccctgggtcttctcagtgaggacgtggatgaggggcggcgaacccaccattatctgttctccataaaaagctaccctaaacttagttagcttgaaaagccctattttacagatttattcttcatttagtggctcagaagttccaaaagggctcagccaggtggttcttcactccacgcacggggcactgactgtgtcctctgctcagctgtgtcctcatgggggctgggctggaaggtcctgggggctgcagtcccgcacctccacctccctgccctttcacaaagtccaccctcaaccctgggtactggcctcctcagagcaggtggatgcagggtcgtgggaccacctgcccaatgactacagggcatgagagggcagctgcagtgttctgagtcccaagctcacttccgctgagtcctgtgggcaaaacagatcgcaaggccagacccaggctcgggggagggaaatggactccgtccggccaaggcagtgtggcagggtcagtggccggctccagcaggcagacctggagcccagcctgtgtgactccaaagtcagtgttcgaatggagctctttggaattgaattgcttaaaaggcgccaatgtcggagaagctagacgatacccacaaacagtacagttaggcaggttattagtgcacatgcatatatggaatattatgcaatatttaaaataatggttacattgtttaaaagcatggaagcggtttgttctcagtgtcaggaaggaggcaggagacaagcttctctatgcagtatcacctcaacaaggttaaaaaagcccatagaaaaaggcttggaaagaagcatgttgaattgtcacggtagctgtcccatggtggccaaaataacgagtgattgtctaaattcacatcacttttgtgtactttccaaatattttcttcaagcagcacacatttctttcaaataaaaattatgcaacgatgaagaacatgcctcagttttaactgaaatactgggtgctgatgaaaacgggccgacatctgtggaacccccgggggcatggagccctcggctaagggtctgcctctggtctctccccaggtgggcgggggcaggacggaagcccggttatcaccttccctgactacccggccttcagcgagattccggacaaggagttccagaatgtcatgacctacctcaccagcatccccaggtacgtgcacccagagcccggcagacattgtggtttggggcagagtccctgtgagatttcaccagggtggggtccctgcaactatgggatgaggcagagtccctgtgagatttccctgtcatggggtccccgtgactgtgggtcggggcagagtccctgtgagatttccccatcatgcggtccccgtgactgtgggtcagggcagagtctctgtgaggtttcatcatggtggggtccccgtgactgtgggttggggcagaatctctgtgaggtttcatcatggtggggtccccgtgactgtgggtcggggcagagtccctgtgagatttcaccagggtggggtccctgcaactatgggatgaggcagagtccctgtgagatttccccatcatgcggtccccgtgactgtgggtcagggcagagtccctgtgaggtttccccattgtggggtccccgtgactgtgggtcggggcagagtccctgtgagatttccccgtcatggggtccccgtgactgtgggtcagggcagagtctccgtgaggtttcatcatggtggggtccccgtgactgtgggtcggggcagagtctctgtgaggtttcgtcatggtggggtccccgtgactgtgggtcggggcagagtctctgtgaggtttcatcatggtggggtccccgtgactgtgggtcggggcagagtctctgtgaggtttcatcatggtggggtccccgtgactgtgggtcggggcagagtctctgtgaggtttcatcatcgtggggtccccgtgactgtgggttggggcagagtctctgggaggtttcatcatggtggggtccccgtgactgtgggtcggggcagagtccctgtgaggtttccccattgtggggtccctgcaactatgggatgaggcagagtccctgtgagatttccctgtcatggggtccccgtgactgtgggtcggggcagagtccctgtgagatttcaccagggtggggtccctgcaactatgggatgaggcagagtccctgtgagatttccctgtcatggggtccccgtgactgtgggtcggggcagagtctctgtgaggtttcatcatggtggggtccccgtgactgtgggtcggggcagagtccctgtgaggtttccccattgtggggtccccgtgactgtgggtcggggcagagtccctgtgagatttccccgtcatggggtccccgtgactgtgggtcggggcagagtctccgtgaggtttcatcatggtggggtccccgtgactgtgggtcggggcagagtccctgtgagatttccccatcatgcggtccccgtgactgtgggtcggggcagagtctctgtgaggtttcatcatggtggggtccccgtgactgtgggtcggggcagagtctctgtgaggttccaccatggtggggtccccgtgactgtgggtcggggcagagtctctgtgaggttccaccaggctggggtccccgtgactgtgggtcggggcagagtctctgtgaggttccaccatggtggggtccccgtgactgcaggatgaattagggtctctgggagccatcattgagttccccgtggctttgctgaggggttagagctttgtcagcatcatggttccgaggagctcaggagtctgcctcagatctgatctggggtccgaatccagctttttcgctcctgagctgccgttttttcctggagctcggaggcccacctggaggcccagttgctcagcagtcgggatctgacttagcctgagcgctgctgtgctccctcgtataccatcactgcgcatgcctgttcgatcagcagagttctgcggtgcgagggcttctgtgttcttaatgccgaggagcccatctgcacgggacctgatgctcatgggagcagagcccgtccacgtggcctctctgtgtcgtggtcaggccctgggggcgtggccgcctcctgccctttccaggaaagaactgaccccagaggtaccagaaaatccagttaacaaaaatggttccctcaggctgcagttttttgttttgttccagacagagctgggtccctgtcctctgaaaaggtagggagcccagttctgtgtctccccagcggcgggcaggagagcagcatcaggccggtgagctgcaggctgacttgggaggggtgccgcgggggtctctcatctgatgtgctcgtcccagcctccaggaagatgctgagaatgtcagcctcacaccagacagtgtagttgctgcttccatttggggtatagtgaacacacaccaagtaaaaacagaaatatccttaaatatggcatctgtatcccgcacattacataaggtggcaaaacacagaggagatgtttaaccatcagcgtgaaagtgcagccgtggccattaccgtgaaggttcttcattcttcagtctttaaagacaacagcgcactgggcctggtaactgagagctcagcccgtcggcctgacctggaaagcagcacattgatcccctgataaatatcacataaccaccagctggcagcagccagcctctgcagtcatgcctcaaggagagggagagcggtgggcacctctgtccacttggcgggttgaggtgggagctggaggagcagggagcctcaccggtgggcctttcgggggcaggacgtcttggtgggcagaaagaagggggctcgtgactgactatggtcaaagccctggacatggcggtgtcctggtagccccaaatcactgtgtgttgggtttgtggttttgacctcagtctcttgtctgttgtgagaatcttgcaccccctatgcgccaggctctgctggctgagctgagtgcacggaggaggggctgggtctcgggccgagcggccgagctccctgaggggctgatgggaccggcttggtggggcaaggctgcgatgctgcagacggtttccacacattcctccctggttctcagccacactgtggcaggaaggcagttattaagcccatgttatagatgaggcttaataacacggtgatggctggagaaaggggatggctgggcaggggagcgcccgaaggctcagaccacatggccgtaccccgaggacgtaggctccaggtgtgctgtggccagaggggtgtcctggggagggcggtcatctccaagcctccaggcctttgtctgtcacctgcacaggaggaagggcctgtgtcccaggggacggccggcctgacaggtacatccgccccctgatggcacctcctggcatggggctaaatgagattctgtggtgtccacactgaatgctgactggtcagactcatgctcagaaatcagggctgttgtcagtgcttgctacttggagccatgagctggggcgcctcctgtttgttgaaccttcctgtctcttttgtcttagaaacttcatggagtcccttagctacccacatccctttctcaagatttttctagaatctgcggagttccttagctacccacatcccttttcttgagatttgtctagaatctgcagcactcaaaggccacccatcaaggccataagagtgtggtaggcggcacgtgttcatgtgtgcacgcctctgtttatccgatgttctggaaccttccatggcctccttgctgctgccccacttgtctgtctgcttctcctgagatccaggaatctcagatgggtccagactcctgcaggacaagacccactcagccacctctgtagattgcgcatctgtgagtcgcacagcctggtctggctgaaggtggccggagcgcaggcccagtccccgctgtggacacgcgggccccaggttgctcagaggcagctccatggatccccactgttcacctgtgtatggaaactcaggttttctggtcacacttagataataaaaagtggaagaggcctttctatcaccaaacgctctaaatcagatcctggaaatgccagcttcattcagccatgagcagtgctgctgaccgtggagctgtttcccccaccagactcagtgtgggtgtctgagtgtgtggtgtgagtgtgtgtaatgtgagcctgtggtgtgtgtggggtgagtgtgtggtgtgtgtggcgtgtgcggggtgtgtgtggggtatgtgtggtgtgtgtgtaatgtgagcatgtggcatgtgtggggtaagtggtgtgtgtggtatgtgtggactatgtgaggcatgtgtggggtgagtgtggggtgtggtgtgtggggggtgtgtgtgagcgtgagtgtatgcgtgcattctacccacgtttcctttcttcccaggtaggtctcatcagtgtcagacccaatgctccctttctatctggaaataaaactctttgataacaaaacccaacctgtgtgaatttgggaggacgcccatgtgccctgatcagaaggacccacagaagggaagctgcgggcctgtaagagccacctgtcccctggctgtcccggcatcctagggcgcagcagccgcggcagctcccctggatttctgtgagcacggggctgcaggcgtgctgtggggaccccgtgcctccagggtgttgccattgagcatgtccttccagagagagtgaacaattcttgacacatttctaagggaaatcttcttcctaagggcatctacgggatgccttcttgagaagtgcagagtgtgttaaaaatgtgggggtcaatcatggcctctgcagataaaaccagggtccctgcaagccttgcaggtgcagcttggcagaggggaccgtcccagaggaagtctctgcatccctggcgagcaaaattgccaggctagtgacaaggaggagacctgcccactgcgccctgagggtgctgtgtccccgggaagtaccctctgcgggggaccctcttcccaaggtgggggcggggctgccctctgctggagacgcggagcattgcggctcggtcccgggacatccctgggagaccaagagagggaggggagcttggaccttttcttccaggagatggtggacgagaccctggcacaggcggttccccagcacgcagtttccagacagctgcacagccagcacattctttaagtgggaaaaaagtgaaattgaccaggcctgttctttcacatgtcaatgcaaattaaatggacaaatctctcgtgaaggctgcttttaaggggtttcaactgttacattctaaaccaagcatcacttttatcaatttagaaagaatgttgtattctaattttaactttccttctgttttcatatgcaaatgccaggtgtcccaatttaagcactacatctgactatactcatcatttttggaatattagactgaaataggtttgccccaaatggtttggggcacctgttaatataaaccaagtttttggtccttggaaagacgactcatcagggcgaagggggtgagctcgtgctttgctgactcaggtgtctgccgacgcccggtgtggactctcaggtgtccgctgacgcaggtgtggaccctcgggtgtccactgatgcaggtgtgggccctcgggtgtccgccgacgcccggtgtggaccctcaggtgtctgccgacgcccggtgtggactctcaggtgtccgctgacgcaggtgtgggccctcgggtgtccgccgacgcagatgtgggccctcgggtgtccgccgacgcccggtgtggactctcaggtgtccgctgacgcaggtgtgggccctcgggtgtccgccgacgcccggtgtggactctcaggtgtccgctgatgcaggtgtgggccctcgggtgtccaccgacgcagatgtgggccctcgggtgtccgccgacgcaggtgtggactctcaggtgtccgctgatgcaggtgtgggccctcgggtgtctgccgacacaggtgtgggccctcgttcgtcagagggcaggttcggatctctgaaaaccctatagcccttcctactcctaatggagctccatttaaccaacatcggccaggccttgataggagccaaggtctcagagaggcgatagagaccagcgacaagcagattccagaccctgtatggcccccttagaaccacatggccggggaggagatgcacaggtagacggtcagacctgtgtgtccaggcactgcttgctgagaagtctcagtggtcagcacacactgggaacacaacagcaaataaacagagaaaattgtggcgctgagacaatatgtcagctatggagggcgtacagggcagcagggctgtgggaaaacaatgtgagaaagaaagagagacagagagacagagacagacagatacagacagagagacagagacagacagatacagacagagacagagacagagagagacagagacagagagtgacagagagacagacagagacagagagagacagagagaagagacagagagtgacagacagagacagagagacagagacagacagagacagagacagagagagacagagagaagagacagagagtgacagagatagagacagacagacagagacacggagacacagagataaagagagcacgagggaggcagagggcaggggtggcagcatcactgcagacaaggaacttaatgtaaactgggaagcattcgtcacagagatcccaggagggcgccagcggcatctttgggggcagcgaacgcaccagggggcaggacagagtgccggggagtcgggggctgtagggacagagtctgggaggtgagacagggtctgtggagccttttctgaggagctgtgttttctgtgaagtgggtgccaaagagttcatgagctgccagaatgcagggtggagggagaatgcggggtggagggaggagctgggagatggggaggagggcggcggccctcagagaagggacgaggtgggaagcctggagcttgctggaggagcagtgtggaaggaattcactgaagctgatgatgacgcttactttccatgggcctggctcaaagctcccagctccttgggaggtagggactccatctaccagccagcttgccgggacaggggtcacattcagcccataagaggcatgtacacatacagatgcacacacgcacctacacaggcttgcacatgccacacacacacacacacacacacagatgcacgcagacacgcaggcactcatgcacttacatacacagatgtgcatgtgtataaccacacacgtgcgcacacacacacatgcaagtgcatgcatacccccccacagacctgcacatgtacacaccacatgcatgcacagtttgtgtggtgtatggggagggtgcatgtgggacgcaacagaaacacgaatgtaatcattaggcttccagtcaagaggagagtcctcctatctcactgattctaagataagcacctggagccaactcggtttgtcgtccccctgcggtgacctgagcaccctgtcctgctgtctgagctggagggcagctggaccccagcccttggaagagccccacttctcgctgtgggtttgatttcctattgaactttgaattggcttttgaatataaggacaggaagtgtctgtgagcgtgtgtgagcgtgctaaacaatttaatacgtgtgcattaaaaagtgaagcttccacttcacctcctgcttccctcccccacagctaactgtggagctgcactggggtgacacccaggctgttcatccacgtgtggtgggacagcacaggacatgccgcctcgcagcttgctgcttctgttcagcggtgtgtcgtggcgcccttctaccttggcgccatttgctgctgcctttcattttatatatttttttttcatgttttgagacagggtcttgctctgtcacccagactggagtgcagtggcaggatctcagctcactgccacctcaacctcctgggcccaaggtgatcctcctgcctcagtctcctgagtagctgggactgcaggcatgagccaccacacccggctaatttgggtattttctgtagaaatggagtctcaccatgttacccaggctgatctagaattcttgggttcgagtgatccacccaccttggcctccaaagtgctgggattacagatgtgagccatcgtgcccgcctgtgccttccttttaaaggcttcctggcccctgtgatgtaagcggacctggtgtgctcacttgggctggcccccgtgacgtgagtggaccccgtgatgtgagtggaccctgtgatgtgagtggcccccgtgatgtgagtggcccccgtgacattagtggaccccgtggcgtgagtggcccccatgacgtgagtggcccctgtgacattagtggaccccgtggcatgagtggctgccatgacgtgagtggcccccgtgatgtgagtggcccccgtgacattagtggaccccgtggcgtgagtggcccccatgacgtgagtggaccccgtgacgtgagtggcccccgtgacatgagtggcccccgtgacgtgagtggcccccgtgacattagtggaccccgtggcgtgagtggcccctgtgacattagtggaccccgtggcgtgagtggcccctgtggcgtgagtggcccccgtgacattagtggaccccgtggcgtgagtggcccccgtgacgtgagtggcccccgtgatgtgagtggaccccgtggcgtgagtggcccccatgatgtgagtggcccccgtgatgtgagtggcccccgtggcgtgagtgaccccgtgtgctcacttgggcctgttcgcgggcatttcgtggtccccactgtttccctgttggggtcactgctgtaaagggtcgccccgccatggtgttctgtctgtgagattgtgccctgtttctggcagttctcaaatgctccagctgggtgatttcccccccccaccccaacggagttggcagtttcagggctacccttgtctgccatctctggctggcctgaggctgtgctggccccggtcgccctccatggtctgaagccctgagtggaagctctgccacccacagccagcctcgttaggaggaaccaggagacatcacgcggcccaggtgtctgtgcgctgtgctgggtgggaagccacctctcaggtgtgtttcccgtctccacatcagcattttgttcatggagtctgctgcttctgagcactggggacaagtcgcggaggccctgccattccttcctccgggttctgcacgcaccgcggtgaccacctccccccgaggtcctctccccgcaccttcccaaaacgtgttccccaggtccttttctgttactgctgttgaattcaacagctactgaccacctgtggccatttaaatgtaaaatgaaagcaaaataaaattaaaaatccagcccatggcaggcagggctgcctctttttttttttttttttttggagatgcgtctggctctgtcgcccaggctggagtgcggtggcacgatcttggctcactgcagcctcaaccttcccagctcaggtgatcctcccacctcagcctcccgagtagctgggatgacaggcgcatgccaccacgcccggctaatttttgtattttttgtagagatggggtttcaccatgttgcccaggttggtcttgaactcctgggctcaaatgatccacctgcctcagcttcccaaagtgctgggattactggcgtgagccaccatgcccggccaggcagcctcattttcattcacacatgaccaatggctgcttattgggctgcacgatggttatgctggctccgtcctggaggagtgagtgccctcaccctcaccctcaccctcgccctggtctcaccctcgccctcaccttctccctcgccctggtctcaccctcgccctcaccctggtctcaccctcgccctggtctcacccacgccctcgcccttgccctggtctcaccctcaccctggtctcaccctcaccctggtctcacccgcgcccttgcccttgccctggtctcaccggcatgagcagaaagacaaggcccggggttgcagtgtctgtgctcagggtccagacacagctcagaaccgaccttccttggggagtgacagtccccggaggttaggggctgctgtggccaaagagccacagatcggaggtgaggaaggtctgcccgaggtgaggaaggtctgcccgaggtgaggaaggtctgcccgaggcaaggcaggcccgcagtcccgggcggtggcatcagggtgagcgccctgatagcaagggacctatggcgcccacaccggagggcgggaaaaggaggaagagcatggcccccgtgaagcccctcgggaggaagggttcctgtccacgttcagcacccccgtgcagacctcaccattcccgacgggaacacttgtgatattcacttccaaccacacgagggtgcagctgggcaaccgcagcttttggaaaaatgttgaaactggggcggcttctctgggtgactctgacgctctcattgcttcacgtttaatttttgtgtcctgctgtaactaccatgtagtgcacttatgaatcgtgcatattttactctaaggcctgtctgtaaaccctaataaatgaccctactcaggtaagacgtcctgacagtgaggtttttaatatttacaagccacagaattatttcctgcagccacagagacttccttggcgggaaaccaggtcctctgacctcacccggctctgcagtctgttttgccgttttccgcctcaaaccccctctgcgatgtgcagctctgggtgtctgatccctcaggggtcctgtctcccctcctctggccccctccctggctccttcgcctgctgcctttttcttccatgaggatgcggttcccgtgtcccccaggacagcttcgtggccggccgcctccatggattcgggtgggcacaggtcctgcagggagctcctgtgttatctgccctccccgcgaagctccttggaggatggagattttaaggtcttactgtggtgtgagcgatcagagaccccagtgtttaccaggtaggctctgggctcagaccccagcgccccacttgttagctgtttgaccctggatatgtcattcacttctgcgttcctcagtttctgcacgtttaaaatggcagaggcccctttggtagtgagtctgtgtgacaggcgatggggccttcctctctggtacagcaggggcctaagggatgtttgacctcagcaggtagagtatcatctccgtggtacagcaggggcctgagggatgtttggcctcagcaggtggaggatggctgcaggtcaggattttgcatcacaaacaacactgctgcagtcacattagtggattttgttattatagacaacactcgtgtctataattccaaggacccattctccatgcccagaggcacctcagtcccacagaccgcagcctgattctgagttcgcagttggccagtgttgcagaagctcacagaggagtctttggaaatgagaatgacgccaccattctcttttaattgtgtcataggtcttccttccttttatacataagttaactgaggctggtttgctttccacagccagagttctaagacaattttaagtaacacttttctttcgctatttctttatgaatgtgttgggttttagggatcacagatgtgcttgggcaaccaaggctgcctgtgtctctgtgctctggggggcttttcctacgagctttgcgtgagatgccagctgcccacaggcaactgggcacagagagcaggagaataaagcaggccagggcatcaggtggggctgattccatggagggcaacggcagtggtgggggcaagtgcggggtgggtgagtggcagcagccacccacagaaggacgcgctgtcccggccccgcatccccaggagtgcgtgtgtcgcaggcgaccctgtcctctcacccaggagccctctgagctcgcgcctttcttcaggtgtctgcgatatcatgctccccttgtgttcctcctgcctcctggctgctgccagtgggtggccccccaactcctccaccagaccctgactctcagaggactccaagcctctatttgtgttattcctatccagtccatggggttcagataccaagtggaacttttaacaaccatgaattcctaggcctcactctcaaatcatcacatcagaatatccaggagtggcccgagaagacctgcgttgtagcaagctcccggatgtttctcttgcatccatctggcactggtctgcacactggtgtttggaacccccagacttgaacttagtgccgtgcggtccagcggccctcctgtccatctcagtgcagagaggggctgggggaggtgcaagcgtgtcatcctagaagaattcctctcgactaacagcctgccgtgttcttggcatctgtgcacagtggagccccacaagctggctgaacccttggcttgcgtcctaagctctgtgtgctgttaggatgatgataacgaccacgatagaaagcaccttgctgagcccctaggagtagaaggtggagggcaggccagggcagagttgagctagacagagtgaagaacacaagttctggggaagcagggaattgtaaccaaagatgaaaccacccctgcccagcggcaccatttgtagggaccttggagagttggttgaacatctgcagagcatggggtcggagactcaggtcagactaaactggttcagagccaggatacccctttcgacctgggttacatttgtcatcattcatgtaaatgtttctgttagatggaaacaggttcaaaacccactacctacttccattctggctctaatagagtatcttgtagccaactgatatttccacaaagagcaactgtaaaacctgggtaaaattttgtttaaaaatatgtttgagggattgagaggctgcagaggcagccaggacttggggagccaggttctggaattttacagaggtgagccccactttctgcatttcatggtgaggtattgaacgctttgccgctgaggtcaggaacactgttctcatttctattcaggattgtgcttggaggtaccaggcagacaacaagacaagaaaagaaaagtcttaaggattgaaacagtaagaaacacaggtatcattcattatttgtagacaatgtggttgtgtatgaagaaaatccaaattaagtaacagtcagactcttaagctgagtaagtaatttagcaagatcaatgggcaggggtcaatatactaaacttaattgtattttagtatttttatatatatcaatgatgtacaattggaaaatgaaatttatagatatcacttataatcacatcaaaattgagtacataggaataaaatcatatctaataaaagacgtgcaagacttctaagcagaaaactgcaaaatgttattgaaagaaattaaaggggccaggcacagtggctcatgcctataatcccagcactttgggaggccgaggtgggtggatcacgaggtcaggagatcgagatcatcctggctaacatggtgaaaccctgtctctactaaaaatacaaaaaattagcagggtgtggtggtgggcacctgtagtcccagctactcgggaggctgaggcaggagaatggcctgaacccggaaggcggagcttgcagtgagctgatatcgcgccactgcactccagcctgggtgacagagcgagcctccatctcaaaaaaaaaaaaaaaaagaaagaaattaaagtagcatgaataaatggaagaatattttagttcacagattagaagacaattagtattataacaatgttaattctctctaaataaacatatagatcgaatgcagttcccaaataaaattccagcaggtttttctttatttaggtgtgaacattggcaggctgcctttacattttatatgaaaatgcaaggggtgaggaatagtcacccaactttgaagaaaaaagttgaaagctgatactgccaaatattaagacattattaaagtgacagtgattaacacagatggtgtaaacagaagagcagcagcacagaatattgaatccagacagaccacacatctgcagtctcttgatttatttattgatttatttatttatttttgaggcggagtctcgctgtgtcacccaggctggagtgcaatggtgctatctcggctcactgcaagcgccgcctcccgggttcacgccattctcctgccttagcctcccgcatagctgggactacaggcgcccgccaccacgccctgctgattttttttgtatttttagtagagacggggtttcaccgtgttagcctggatggtctcgatctcctgacctcatgatccgccctcctcagcctcccaaagtgctaggattataggcgtgagccaccgcgcccggccattgcagtctcttgatttatttcttaagtgatactgtagcacagagggggatggacgtcctcagtaagaggagtggatgtgattggctgtctgtgtgggaaattatgaatgctgatacctgcctcacaccatatacaaaagttaattccaaatagatcacaggtgtaaatgtgaactctaaagtaatatagtctctattctcgacaaacataggaaaatgcctatttcagagtaagaaaagatttcttacgcaaggtttaaaaagcagttatcaaaaaagcaattatcagaaaggaaaaggtcagtaaattgggctacattaaagttaagttactcttttcatcaaaatgaaccatgaagagatcgacacggaaagccacagtgtggaagcagatgtttgcaatatgcacatccaataagaaacttgtttctagcctatacagagaactacacaccaacaagttaaaggagaatctagtagaaaaacaaccaaaagatgtgaacaggcatatcataaaagaggatagccactagacacagaaggcttcctgcctctgggaaatgccaattaaagccatatcaggacgccactctgtatccacaagagtggctaaaattctactgacagacagtatccagtgctgacaaaaccatggagcaaccagaagtcacgtgcatttctggcaggtgtacatttgtccacatctacataattacagcaattcctaagaatatgtccaacaggagtgtgtattgtgtgcactagaagacatgtataagaagctcattgtcttatgttcagtttagccccaaactggaaacaacccaaatgtccattaagagtagaatttattaataaatcatatttcatcatatatgtataccataacccagcaacaagaatgaacagacaccctactgcaacaacatgggtgaatcccacaatgttgaaagaagccagacagcaaaaaagcacatattgtatatttttatttggacaaaattcaacggcaggcaaaactaatgtatggtgacaagagtcgggatggggcaccctggacggtgggaacggcctctcagtctgggcactcgctgccgtcactcacactctgtgcttctgcatgatgtgcattataattggacaaagtattcacataaagaatggtgtcctccaaggaaaagaacttaggtgccacctactctatcccagatgggccaaggtaaccgagtcgcactgtgcagggagggccttcctgtgtgtgtgtgtgtgtgtgtgtgtttcttttcctgaggacacagccaccctgctgtgcagggacccttctcccagactcctcttctcatcttgggtgcaggttgacgtttgagaagcaaagacaccaagggtccccttcctcccacccaggcctcacgtcccctcagcgcctcctggccacgcactgttgattcctaaggtctgctgccctctgcaagcactgctcctcccgtgtcctggcctccacctgcccctgccctgggacaaagcatcctcctcgcccccaccatgtccacgcagcagaggcagatgtccaggcactgggggaacgtggtgctggggcctccccgccccactggtagagaggagccagcctctgcttgcagaccatccctcacgctctgctcctgtccagtgagctgtggttgcacccgcaggccagtgggctgtctgcccacatgggtgggggaccatggggctcccaaggtcacgagccctgagtggtttgggtctctgtcacagaagacgcagccagttggaacattcctgaaactttatgagaccgctgggccttttttacttatttgggccaaaagtgagctcattggcctcaaactcagctgctgggaaactggccagggcagcccctccaaggccaactgttgcggagttggcagctgatggggcatctatgggctgtgtttgtgccctgggtgcgagggacatttctggggtggctgccagcttgagttattctaccccaactcctccggcaccatcaccttcatccctctggtgactctggggactgcttcctgctgaaactgggcagaagccacaccaccctctccctcagacacaggccacagatgtgggcatagatccgagctccgtgagccctgggtcctcactcctgtgagcagatccaggtcctgcctcacggttttgggcagtgcagcctcgggaatgccatgggccgtgggggggcggggaatcacgtggccctgccctcatgaccacagtcagtatgggggatcatgtggccctgcccccgtgaccacagtcagtatgggggatcacgtggccctgcccccatgaccacagtcagtatgggggatcacgtggccctgcccccatgaccacagtcagtatgggggatcatgtggccctgcccccatgaccacagtcagtatgggtagaggaggtgctaggggctctttacatcctcacgtcagaggcttttttagtccaggctttgcaccttctgagtcagtgttcccgaaatgtggtaggagaggagacatggggctgagggggtgtggacgagtgtccacctgggccctgcatagggggcaaggtcgtggtgggggctgcgcagggcaggaggctgagtgctggtgtgtgggcatctggggtcaggtccctgcttggtgggaacattaggaggccgccagggtggacgtggccttaggggcagcacacgtggtgtctgagccaggttcccctgtccgtgctcacagctatgtgactttgggcaagtgactaaagctctctgtgcctggagaggatcatagcaccagcctcacgggatggtcgctggagcttgatgaatagctgtagggctgttggcacagtgcctggtccatagcacagctgaggatagtctctaaccctgaagaagcatgcctcctgcctgcaccccgttcccacacatgccctgtgcccgcaccccgttcccacgcgcaccctgggcccgcaccccattcccacgcgtgccccatgcccgcacccacgatggtgagcatggctggggcaggaggaaccagcgctgccttcctgcccaggacccacaccttctgcagctgagcgacagtgactgccccattaacaccacctggaaaccagtccgtccttctcgttgagaaactgatttcctagtatgcattttttgaatcgaataaatttatgacaccttagatttcacttgcaattttgacttctaaaaaatgttttagtcgttggtaactggtttctcattgaaaacggatgcctatttgtgatactggtgttcccattacaatgtaacacaaagatttaaacgtagagtgagtggaagccccacacaggcaggccgggcggcatccagtggcatcgggcgcctttttcgtggctgcagcgtcagcctgcactgccgggtgtgaggcagacgcgcacttaacggcgtgagaagccagatgtgggaggcaccgggcactgtgggcagtgaggcaggagcttggccgcgtgtggggcagaagctccatggctagaatgggatgtgtttgggtcacgggtctgggggagggtgcgttctggctataactggatgtgtttgggccacagaggtctggggggtgcattctgcatccagcagctctcacatggcagtcgtggtccccgttgctggtctgggctgttgtggagtagcgggggcatttgtgggcgaacccagaggctgaaattccaccccaatcagagctctattccagggaaaaggggagaaattgagtcaggctttgttgttctgcaaaacagtgacgccgctcaggcagcgctgcgggttacagcatactcagtggcttcatttcactctcacggtaaccgctgggggtggattctacgattgtcctcatttttacagaaaaggaagcagagatggttcacagccaagtcacctgtccagggtgatgcctttgcggggcccaccagagcccgccagtgtcgcagaggcggtgagcccctcccgcccaacacacagccccttggcaggggctcttgagcaaacctgcaggtgggcagcttggggcgtttctcagctagcatcacccctgcttcaggacttgaaagcatttgactgggttcgctggcctgaggattacgtgctcggtggaaattagtcattctgggctcttctctccttcactctaggaggactgggacccagagagctccgggatcagctccctggcttggagtccaaaggcagctctgaccacgccgcctggggcaagagggagggcagctgggttccatctccgtggcctggcacatccaaggtccctttgtggaaaaggcacgtgtagcacctgttactggaggataacctgtaactttgtgcctctcccaagggagcacacaggtctacacgggaagtaagattccctgtacccactgtgtctcacagttcagaaaaagtcgtcaaagtgctcagactcaagaagtaaataaggaaatatgaaaacatgactttatttctttctttttttgagacagtctcgctctgttgcccaggctggagtgcagtggcaccatcacagctcactgcaacctcaaactcctgggccaagcaatcttcccacctcagactccccagtagctgggaccacaggcatgcgccaccacactcagctaatctttgtatttttcatagagacagggtctcatcatgttacccaggctgatctcgaactcctgggctccagtaatccacccaccttagcctcccaaagtgctgggattgcaggcgtgaaccaccacgcccagctgaaaatataactttaaaaaaaatcttagctccgtaagaactaagccagatcagaaaacgaattctgtctgtggcccccacagctgtgaaatggagtcgctgactcgccatgctcgtgcacgtgcttagtgcccactgcagaaggctgctttgaatgaaagctagtgtttattcgtgtactcacccagaaggtttctgctgttattgaatcaaattaccctacatgtgaggcatttttcacggccagatgcagacagggacacagacgcagcagcacccaccacacatgaacgttcgggggtcactgcctcgtcttcatgtcttgggagttgctgtttctgtctttaaatccgagcgtcagaaggatctgagacacccgatataaatccctggcttgttaatgatgctcacagagagcggccacgcccatagactgcataatttatctccatcctgcagaattctgattttcatgtaaacctaggacatgttcagagacttggaagttagcgattctagcccctgccttaggcatgcccgtgtggttgtttctgctttggattggctggtggtagcagctgctggcatcacgcaattggcttggctgcagagtgagcccacggaagagggctctccgcaccgactctgtgactcaggcttctactaccaggctcatccgaggacggaggctgtcgttatacaacgcgcaagtgtggtctctgtcacagatgtggctgtcgcagagagtgctgcctcctctcccgtttccagcagatgcttgggaaccttcagaagtcttggggattttctcccagcaccgtagccatgccaccacgagtgaatccttaacgtggaccagcacgggcacctcagatgccaggaccggcgtgatgtatgcgccataagactgttttggagggtttagtcagctggtcacccaggaaaggaaaatgactcggctcttactgtggaatagcaaatgactgagctcgggagagatggttctgcctcaatctgtgactcgaggtggttggtgttaggctgagaaataagaacacaccaaaagtgcctgcccttccgtagatgagagcaggttctgggactgcggggatggggctgccggggcccccgtgtgccatgcctctcacctggtattgcagaaatggcatcatgaatatgggggatcgctctcccaagaggttttctgagggatttcgtgggcagccggcttcccacctgcacacattaacggcggcgtctcttcctcactgcagcctgcaggacgctggcatcggattcatcctggtgatagaccggcgacgggacaaatggacctccgtgaaggcgtccgtcctgcgcatcgcagtaagtgccacccggggctctgccctgcgcccggcccctccctgggctgcatgaccgcatggtgcccttcctctgtgtctgccgcagttcctgctttgtgctgagtgggacagagcccagtcccggcgggtggaggccggcgccaaggccccccctgcttgggctcccaaggcactggtgcctgggtgtgagttttcccagatgaaggaactcttagggagcccaatgtgacttgcaaacaatttccccaggcagagcagcccatatgtttccgaacaccaagtctgagatgctcgggactgaatatgcctcttacatatttatacattagtgattttctcctttccaaatcgggccatctatctttagctgtgacactgaacgagccaccaccgcctcccttccccagtgggattgaacatgcacttcctcttacacaaagcacaacagtcctgaccaggcaggacgggggctgtgtgcagagacgctccaggctggaagttggaagtggtactgcacagctttcctatgtgattttctcctttccaaatcaggccatctagctgcgacactgaactagccaccaccgcctcccttccccagtaacccagcctcgcatgtagccaccctcctttccaaggactttcccttggcatccgagagtctgtttgcagattctgcacgctgccttccatagcagaaggggagctgggtttgctgttggttttaacccagagtaatcatttaagagggaagagattaagtcagcagaagcccccaaatcttatttttgtcggtagctcccacccgtatgcatgaccccggcatggagcatttttcacccacgctcgctctccccgcctgtccgtccaaatttcattgctgccaaaggaccaaaaaaggctgcctgtctgccaagaggtgacccagagcctgggtccaggcacctgcatgttctcacgcccgccacagcccgtccctcccaggctctgggaccctgggtcctcagctgtgatggcacaattgctccaagcattccccagcaccaaaccccagtgaagtcagattctcccagtgaagtcagattctcctggcctttcctgggtcccgcgttcagactacctttgggttccccagcctctcggtggctgctggctggtgcgccaaggtttgaggtatactgaaaaaagtcattcctttccccgcacattgcctcattccttcatcttttacaagaattagaggccccatatctgctccgatgcccacaaccttcatcgttttggtgcaagcctgtccctgagccgctggttctcatcgaagtctttaggatgaggcatctccttgcacccccacggcacctctctgcccctcgccgcggcggatccccgttcctgaccctgactcaacctggcacacaccacctatggcatcgttatctgaaataattcaaaacgcttcaggatgcttccaaaaaagtagacgtgtatagaatcggtcttcctttgttttaacagtgcgttcgtttgcttttgcgtcactataaagacgtacttgagctgggtaattgataaagaaagaggcgtaattggctcacagttctgcaggctgcacaggcttagcacctgcatcttctcagcttctgagggggcctcagggagctgccagtcgtggtggaaggcagcggggagccggcatcacatggtgagagagggagcgagagagaagggggaggtcccagacttttgaacagccagatctccagtgaacttactgagcgagaactcacccgtcaccaaggggatggcgctgagccattcataaggggtcacgcccagacttaatcacctcccaccaggccccacctcagcactgggaatcgcatttcaacatgagacttggaggggacaaaaatcccatccatatcaagcatccccagaaatgcagaaagttctttagataaaagccatcaccagctaacagccatgtgtgcctttcattattgtacgtcttaaatgagtttgcacatgaagtcataggcaactctaaaaattaaatcataagaacccacggggtcagacacacatggacggacaacagatactcttgggaagcacccatccgtcctgggcgggtcccacaatgctcccagcaggcacgtcgtcgtttaaacaacagacaacaccgttacagccgcatcttttatgcttacctgccgctgatataaaccagccatcaggacgactcttagcaacacgtgggtgtaggagtcggcctccctgccagggcacttgcggtgtcaggacgcacctgggtgcctttcatgcccgtggggtccaggcacctgcatcttcacacacctgccacagcccgtccctcacacggctcatgcctcactacatgtgccccgtcccctctgctcacgcctcgctacgtgtgccccgtcccctctgctcacacctcgctacgcgtgccctgtcccctctgctcacgcctcactacgcgtgccccagagcctccgctgatgcctcgctacgcgtgccccggcccctccgctgacgcctcgctacgcgtgccccagtgccctcgcacacacatcaccacgtgtgtgtctcagattaatcagtcactcccgggttagatgacaagagcttccccagatacgaggttactttttaagaaatacaaaaatcattttctaaaagcaaagtatttctgcgaggtcaccctacaggatagcgaagcagcccacagcagacccgtgatttaggtgtcgatcttcagctgccgagtgtcctgttccgttcaccgagtgtgtgatcggatgaatttcttaagcaggttggctcatcttgaaagctctgtcttgtgagcatcataactgaacagttagtgttttagtttttatttttgcattgattcttacaccataaaaatatggctttttctgtccttcctttaattctcagaattgaccaacattggtttggaagtaacagaagccagcattttccagcaaaatcacccagaattctctctgaacaccagtgctttcttgctataataatttacggtctttttttttttttttttttttgagacggagtctcattctttcgcccaggccggactgcagtggcgcgatctcagctcactgcaagctctgcctccccgggttcacgccattctcctgcctcagcctcccaagtagctgggactacaggcacctgccaccacgcccggctaattttttatatttttagtagagacggggtttcacccacgttagccaggatggtctcaatctcctgacctcgtgatccgcctgcctcggcctcccaaagtgctgggattacaggtgtgagccaccgcgcccggcttatggtcatattaatacacagactctgtgtagttagcacgtcctgaggcttttctctgtcccaggcactgcctgggcatcacggatgtgagggaggaagtgagcaaggctcaccgccagctgggtgaggacagttgaggggcatcacaatggggtcacaggcaggggcagcagggagcagccaggagggtggctgagccatggggagggggcagagttaggccccacatgccaggccccatccacctgggctgtgaccctggagagggcgtcttcctgtccccaggcccctgctacccaggagcccgccgcctccagaagggtttggtgcaggaggggcatgagaaaccggcaggagatgatgatggtggacattggatgggccaggagacatggagctcacagccctggtttcatgaaggagaagtgggccacaaggccaaggaggcaggaggcgggcagtggtggcactgtcataggagctggttgtgcatgtgctgaggcttagagggtcactggtcaagggagtgagggcagctgtggacccagccaagcctaggtcctgggcagaccaggaggggtgagggtctctgcagtggggaaggggtgggtggtggggctggcggggaggccccaggctctgtccatgagccacgcactccttggagagggcagaccagggatgaccccttgggcatcttgattcagttttttggaaatggtgcagttgacctgacgtggggacaccaagtagtggctgcagcggggcacctggacgccaacccctgggctccaggccttgacagcgagctttggctggcctaggcttccacctaaagtggctttgggaaaactagcacttagcaacagtccaggccagccgagccctcaagcaggtttccaaacaggcacaggctccagctgcccgaccccaccagggtgcccagctcatggtgctgcgggcgccacaaagcaagcccgtggcagagacttgcctccaagcgctcggccaccgaggaggacgcagcgcttacataatgtgccgggatccggggctatttttagccaccatatgtgctgtcttaagagctgagctctccctaatttggggtgttcttttttcttttctggatgccttcagcatggcttggaatagaaaaattagacattggaagagccaaaatccagtgttcctaaaaccaggctcccaatcgagagcaagacccatgtgatgctgagggcgtgtgggagaaggataggttcacagctacccacccagggggcagaaagatgagatcctctgagaactcacgtctcttctcccttaggcagttgtgcggtcctcagatagaagcatcttttataaaatgctgttgcaacatctaaccctcttccactgtactgcatgtgtgagtgtgtgagtgtgagtgtgtgactgtgtgtgtgtgcgagcgagtgggagtgtaagtgaatgtgagactgtgtgagtgtgtgagtgtgtgcgcgagtgggagtgtaagtgaatgtgtgtgagactgtgagtgtgagagtgtgtgtgtgtgagagtgagtgtgtgtgtgcgtgttcacattttgggaatttgtaatagagtatatatattcatgtttagagctagcctaaatcaaactaaatctagatcctcaagtaggtggctggagaaagtgaatctgatttttagactgcatggggccacaactctctttcctgtaacgccggtgcagtctgtgtgtgcaggaaaggtagaaaacaaggtgtctgagggaccccggacttctaggtcgtccagcaaatctttcacatttgcaaagtacgattgtatgcggcccccctgtgccagctactggggctctggggaggagctcaccgtgggggcggtgggggcggtgggagccgtgggggccggggcggtggaggggggggtggctgggggagcggggaggcgggaggagcagggggggcgggggcggggggggcggggggagcgggggggtgcggggggcggtggcggggggaggggggcggcagggggcggtgggagcggtgctaactccaggaggacttcccggcggaggtgatgcttggtgagagcctgacgggaggaggagttgtccagatggaggggggcgaggagcttcccctgggaacacaaagcagctggctgccgagggagagagggccaggtccgtgtgcccctctcggaagaggcgagaccgtcccccagggcagggaactgaaatgcgcgctgcataactgcggcgacacgggggtgggggacccagctcttcccggtgtggctgagctttctcagaacaccgctgctgtgtgcagcaagcacctgcccaggtgagcacagtccccccgtggtggacagaaggggaccaggatctgcaggctgtctcctccgcaccagctgctgtggcaaatgcgtttcagcgcaccctgcgcgttcaccaaccgccgattacaggggaggagctgggcttcggggcgacgagggaagctgccgatggggtggggcggctctgggggcggcctgggcctttctgtctctgaagcccgagctctctccctactccggtggtcccagggccacggcggtgggcggtgccggtcatgcagaatattgcagggggaggcagcccgtgaggcttccacgacgctgagagcgtctatttaaacgactgtccttcatccgagggttcgctcctcccacctaagggtggatttgacagccttggggtatccagcaggggtgggagatccagaggccccaagcccttcttcactgtgtatttcctggaacatggaatccaagggtccaataacgggcggcacgagccactttgctctctctaaagacctcggaggcgacacagtgaataacaaggttgtcttagtccgggtctgctgcttatatgtcaagagtatctgaaactgggcactttacaacgaaaaagaattcatgccttacagttgaggagcctcacctggtgagatccctcttgctggtgggtcctgaggcgacgcgggacctcacctggcgaggggagagtgagccagcccagggctgcccccgctgcttacaaagccaccaggcccccacccacccccacgacagcccgttaatccgagaatccgtgaatggatgaatccattcatgagggtggggccgtcctgacccagtcacctctgaaaggtactgcctctcaatgctgccatgagtttcgaagtttggtagggacgaacattccaaccacaccaaatgtatatttcagaattgctaaaagaatccattttaaatgttctcagcacagaaaactggtgagtgggtgaggtgacagatcggttaattggcttgatttaatcattccactgaggatacctatagcaaaacatcactgggtgccccgtaagtagatacaatcatgatttgtcagttaaatgtagaaacatttttttaaaaagataaacagagaaaaagaaagagctctgagacccgggctcgctcagcggttttttctcgcagagaagaggaaggagcccgggggtccctgggaccaggtgcctcatgaggctccgtgtgggccgtggaccctgcaggccacgccggcttccctgactgataaacccagagccaggccttgccggtgagaggccagggactgctggctgagcttctccagcgctgctcttcactcccctggatgcctggagcgagactatttgcctggtttatttttttcagcttagagctcgttgcacggagtcagaacccctgcatcccggtggctcaggcatttgagtgaaggtcggatcaggagggaggggagatgcagctgccccacgcatggaggagaagagctgtgagctgcagcagcctcgtgtctttttcctctcaactttcagttcagaaaaatttcagacctacagaaaacttgggagagtctcacagtgaacaaacctcagctgtggccataaacaaagtgcccattcgtgtgtgtgtgtgtgcgtgtgtacaaaaacacacagacatagacacagacatgtacacacatcacacagacacatcacacagacacaaaacacatcacatagacacatacacagacacacacatatatatacacatatacccacacatacatcacataaacacacacacatatcacacagacatgcatacactcagagacatacatcacacaggcacagagacacacatcacacacaaacacacacatatatgcacatatacacacatcacataaacacagacacacacacacattttgctggtgagagccggctctgccatcgtgtcagttcatcccggattgctgacatggtgtctcctgagtggagctgccctctgcataaccacaggcgagtctgcatcgcggccacactgccctctggatgcccacacatggggctttctccacgtgccccgtcatgtccttcctgtatttgttaaaatccaggtccagtgaaggacggcgcccccgtcagctgtccacccttctcagtcgtctctaatccacccagttgttggtttttgttttgctttctgtcttttgtgagattgagatttgcgaagggttgaagccagttgctttatggaatatcctttcatctggtttccttgtaattaggttccacgtggtcctttggggcgggaatcctggtgggtgagcttctggggcagcccgtggaggcccaggatgtccatgtgtcccgtgattggggcggtgttgtgtgctcagacggccaaggaggcgtccggatttccccaggagaaggtgcctctcctcttggtaatcagtgggtcatgtgtggtgatgctcaggacggggcgaaggtcccgtggctgaggtgtccactgaccgtttctgcctgaatgggtggttcggtggtggttgccacagggctgtgttttcaaggggagcagcaggtgcctggcgtctgcatccacacctgcctggagcctccttccatttgttactctgtctcctcctgtgtccctgcagctgtgtctccagtgatcttgcctgtactctccgcctctgcagagtgaggttttcactgattgcaaagtaaacatgcacgccccttcagggtcctggtccttagggagctggttaacaagttgaccagaaaaacaacccgaatactcctcaactcttgatgggagctcagttcacacggctccgaatcggcgaaacgcaaccaacgctgggcagaaccttggcacaactttgctggtgtctgctgagaagccgaggggaggttctggggcttggcttgagctgcggggtgagtgtgggagagacggcgagctccctcccatcaatcaatcaacagactgtcctattttcatagtagtccccacccaaatgtcattcgagtccaatctcaggatcctggatgcacgcctgttctccaggtctgcttcccgtgaaattcgtggagattattgtacattcgggagtgggagtgcgattggatgtgtgtctgcagattctccctgtattttctcccaggctttctagaggaccatttgctagaggaccagtccccaaacggccgcgcttttaggattggttttaggagtgatggcctcacgcacacggcagcggccattctgagcactcgtgtctgaacatctgcaggaacagggtccacgcccattgttttcctcacccggtccagcgtctctgattccggctctaacgtcttcttcatctgttaacacagagacacaaacaaactttcaaatgcatattttttatataaacttgtgtttactgtttggctactgtcagacaaatgtagttggtgaggtttcagttgctctgaaattaaatatataatgtcaagctggataggtgtggcttggagcagaccttaaggaaggtgatttgaacttggggagggtttttcaaacagggttccccaaagtacccagttctacaaagttcccagcatgtcctgttgctttagctgcattggtaaatacatgcagcgattgttttctgagtctctaagaatattaactcagaaaccagtgaactctttttctatctccagactacagtgctgtggtcatcacacatatctgttcctaagttcatccaggtcagcccagaaaatgagcaatattgttttcatgttagatagaaacctataggattactttactgttgagtaatttacaaaaagacttgacagcctccatcccaaattcttcatccagttaccatttatacttacccccatcttttaaaataaagtttttattttagaactttccccagcttttaatacaaacggtcaactccaattcagagaaaattttatttgctgttatatttattcaaagtatgtgtttgtgtacatcgttagcaccttctcactcagctaggatcttccaatttattctatttaatataatgatccaataacttaaaatacgaaaccctaaaactgagccaaggaagagggggtcatgtttgatgctggcagagcctcagggaccagccttgctgcaggggtatgcttcactcccagaggctttaggggcaaatagttgcacctgctggagacgtggacccccccccccgccacacacacacacacacacacacacacacacacacacacacacacacacacacacacacacacctggcttcatctctgagcttcaggctctcagcttgtccttaaagatccaggtgataaaaacgacagtgaaacgtagaagagcgtgattcatcgcaccatcagaaaaagactggttttccgtaaatagtggtgtccaatttcacagcagtgtgagggattttcagtccgccccttgctgagacacagaatctgccctggggcgtcccactctttggggcttgcttctcgaaggaggactgcccaggcgcctcgtccaccaggatcacactcctggcagatgctcagctcacgattccctgcttgtaattcagcctgtccgtcacagcatcttacccacacgtgctccctgcagaaggtgaatggctgtggccttagtctatgtccaggcgtcgtgtgagatggtggggcagagagggcgcagatgcagggcccctccagagcacttccctgggggccgaggctggagagaatgggtgtggagagcagcggagacaggagagtcccccggaagccatcagcctcccctccctcatccactccgcagcagacacccgcagaggacctgccaagtgtgccggccactgagggccgtggtccctgccctccccacgcaatgcagatgaagcagaggtctccatgggaggggtcctgtgggaaaggtgtgcagtgtccacccagtgacaggacattgtccacctgccctggacggggagggcagccgcccagtgaccgagcccttagtttatgcacaaggggcaggggcacatctctggttttaattcctacaaggcaggtgacctggtccatgtttgggtgctgagtgtttgggtgctgtgtgtttgggtgctgagtgtttgggtgctgtgtgtttgggtgctgagtgtttcggtgctgtgtgggtgtggagtgtttgggtgctgagtgtttaggtgctgtgtgtttgggtgctgagtgttttggcactgagtgggtgctgtgtgtttgggtgctgagtgtttcggcgctgagtgggtgctgtgtgtttgggtgctgagtgtttgggtgctgagtgtttcggcgctgagtgggtgctgagtgggtgctgtgtgtttgggtgctgagtgggcactgagtgggcgctgagtgtttgcgtgctgtgtgtttgggtgctgagtgttttggcgctgagtgagtgctgagtgtttgggtgctgtgtgtttgggtgctgagtggttgggtgctgtgtgggtgcggagtgtttgggtgctgagtgtttaggtgctgtgtgtttgggtgctgagtgggtgctgagtgtttcggcgctgagtgggtgctgtgtgtttgggtgctgagtgttttggcactgagtgtttgggtgctgtgtgtttgggtgctgagtgtttaggtgctgtgtgtttgggtgctgagtgtttcggcgctgagtgggtgctgagtgggtgctgtgtgtttgggtgctgagtgggtgctgagtgtttcggcgctgagtgggtgctgagtgggtgctgtgtgtttgggtgctgagtgtttgggtgctgagtgtttcggcgctgagtgggtgctgtgtgtttgggtgctgagtgggcactgagtgggcgctgagtgtttgggtgctgtgtgtttgggtgctgagtgttttggtgctgagtgtttgggtgctgtgtgtttgggtgctgagtgcttgggtgctgtgtgtttgggtgctgagtgggtgctgaatgtttgggtgctgagtaggtgctgtgtgttttggtgctgagtgtttaggtgctgtgtgtttgggtactgagtgggtgctgtgtttaggtgctgtgtgtttgggtgctgagtgggtgctgtgtttgggtgctgtgggtgctgaatgggtgctgttttggcactgagtgggtgctgagtgggtgctgtgtgggcgctgagtgtttgggggctgtttgggcactgagtgtttgggtgctgagtgtttaggtgctgtgtgtttgggtgctgagtgttgggcactgagtgggtgctgagtgttttggcactgggtgctgagtgttgggtgctgagtgggcgctgagtgtttgggtgctgagtgtttgggtgctgagtgtttagtagctgcgtgtttgctgtgtgtttgggtgctgtgtgtttgagtggtgtgtgtttgggtgctgtgtgtttgagtgctgtgtgtttgggtgctgagtgtttgggtgctgagtgtttaggtgctgtgtgtttgggtgctgagtgttgggtgctgagtgtttgggtgctgagtgttttggcactgtttgggtgctgagtgttgggtgctgagtgggcactgagtgtttgggtgctgagtgtttagtagctgcgtgtttgctgtgtgtttgggtgctgagtgtttgggcactgtgtgggcgctgagtgtttgggcgctgtgtgtttgggcactgagtgtttggatgctgagtgtttgggtgctgagtgggtgctgtgtgtttgggtgctgagtgttgggtgctgagtgtttgggtgctgagtgttttggcactgtttgggtgctgagtgttgggtgctgagtgtttgggctctgagtgtttggacactgaatgggtgctgagtgtttaggtgctgagtgtttgggtgctgagtgtttcggtgctgtttgggtgctgagtgtttgggcgctgagtgtttgggtgctgagtgtttaggtgctgagtgggcgctgtgtgtttgggcgctgagtgtttaggcactgagtgggcactatgtgggcattgagtttttgggcgctgtgtgtttgggcgctgagtgtttgggtgctgagtgtgtgggcgctgagtgggcattgagtgggtgctgagtgtttgggcactgagtgggcgttgagtgttcgggcactttgtgtttgggtgctgagtgggtgctgtgtgtttggtcactgagtgggcgctaagtgggtgctgagtgttttggtgctgagtatttgggtgctgagtgggtgctgtgtgtttgagtgctgtgtgtttgggtgctgagtgggtgctgagtgcttaggtgctgtgtgtttgggtgctgagtggtgggagctgagtgtttggatgctgagtgttttggcgctgtgtgggtgctgagtgtttagtagctgtgtgtttgctgtgtggttgctgagtgtttgggtgctgagtgtttagttgctgtgtgtttgctgtgtgtttgggtgctgagtgtttgggcactgagtgggcgctgtgtgtttgggcgctgagtgggcactgaatgggcgctgtttgggcactgagtgggtgctgtgtgggcgctgagtgggcgctgtgtgtttgggggctgagtatttgggggctgagtggacactgtgtatttgggcactgagtgggcgctgtgtgtttgggcgctgagtgtttgggtgctgagtgtttgggtgatgtgtgggcgctgtgtatttgggcgctgagtgggcgctgagtgtttaggtgctgagtgtttgggtgctgagtgtttcggcactgtttgggtgctgagtgtttcagcgctgtttgggtgctgagtgtttcagtgccatttgggtgctgagtgggtgctgagtgtttgggtgctgaggacagacttgtcaaggtcttgctactaggattccacaactgtggaaaaggcattgtataatcctaagtgaggtcccagccacttatgttgcaatcccagagctgggttggaacttggggtgcgcgatctagaattcccgcctgagatcatgttgtcagcagtagagatgagcccaggtgtccctgcagccagcgtggctggagggcccagacttggcccacgccccacgcgtcccctgacttcagaccctaccccagcttcctaacctcagggccctcttcttatggtcctcgctaggccagcctgaacattggagtgtggctggggcagtgcccaggcaggacatcctggtgagtcggtcactcctcctctagtccttgctgctatattcctttcgggctttagggcaatgccattcttttctatatgtcatattttaggtgcatttaacttagttatccagaaatcaaactcagttgcttcagtttctttttttggtgatggggtctccctggatttcagcatctggacataacttggtgtcgagagcaaccatcactgcacgtctgtcatcgcggcttttgagcgcttccttggtgcaggtgtccactgaacgccacgcacgccttggtccatttcatcttcgaaagggtgtcatgagtaggcactgccggtctccccactttcccaatggagaagctgagacacagagaaggggagtgacctacccaagttcccacgccttgtaagaggcagagccagtttccaaataaattcatgtaactgtgtccaaggccgtgtgtgcacaccagggcacaagattatttttatttttgtaggtaacacacacatgtgtctatgttgcttttataaaatttgacaagtgtcttggtttcctggggccatggtaacaaagtaactacagactgaccactgggcgcacagaagctgttccctcccagccccggaggcggagtctgaactcaggtgtggccggagggggctccttccaaggctatggggagcgtctctctgctcgaggcctctcctcagcttctggtctggctgcctcctgggtctccctgggtgtggaagcaccgccccggcctccaccagcaaattctctgggagctctccacgcggtgctgggatcagggcctgccctaatgacctcactttagcttggttacctctgtaaagaccgcgtcaccagccaaggtcacgttcggaggcactgggagttaggcttcgacatcataatttggggggacacagctcagcccctaacaactgtcgtaagctttggacttttacatttgtaagcagcataacgttctgccaagacatgaggcttttcctcttttcttttagaaaagagatgcctttcacagaggccagcatctctaccatgtttatctcagcataaacctgctgcgttgaggatgcctggccgctagctgcgcgcccccggtcagcccagcgtgcaggcaccgcactaggggggctgctgtctgcagagcacgctgcaggcccttgtctctcgccctctctcacaggcatctttcccggcaaacctgcagctcgtcctcgtgcttcgcccgacgggttttttccaaaggactctctccgacatcgctttcaaattcaatagagatgactttaagatgaaggtgccggtaagtgcgccccgcctccatcctgcggtagcagaacggaactcattgccgtcctggcccatctgtgatcatcgaaatcctcgaggagctgacttcagggccacacggtcaacaaaaccccgcaggacctggcgggaagttgcacctcctcaatgctgccagaagcagtacaatcctttcttcccccacccccgcccccagcccccaccccgccagaggtgcacagagcatcaacctcagagaggccaccgtgtgggcatcccatcaggacgcgggtcacgcgacattcatacccccaggagaactacagaacttgagaccctaagggctgagagtccgcctggcccacccgcgaggaactcagcccaggccctgcctgcaccccagggatgagagaagggctggggagggggctgtaagcatctctggacctgggagggagcacccactgctgacagggatgggccggacctgtcctggagcagccaacagggtgacccctgccccatcgccaccacactatcccggcacagggcagcatctcccaacactgcccactgagaaagcaccttcagtcctgatctgctgtcctttaaagaacaaaggcttcacaaagtcccttagagcctgtggagcccggtcaccagcccgagctgtgtagctcccccggagagccctggtcagctgccttggcgagctcacatcttctctgccacaaagagaacagagacatatgggccagcaccaggcaccgcagagcaccccatggcaccagccagatgctactggaaaccaggcaatctggggtgcaggtcgctcactgtgaagctactccctgtgcgctgggaatcaggtggcaccagccctccctccccaccctcgttgcgctacagcctcaatgccaaaggtgcaagagcccttctctgacagggaagaaaacggcctggggcctttccccatgtactgcccccttcccctcccctcccctcccccttgccctcccctcccccttgccctcccctccctcttccctttcccctcccttccctctcccccttcccctcccctccctctcccccttcccctcccttccctctcccccttcccctcttttctctcccctccccctccctcctcctcccctcccctcttttccccctccccctcctcctccccttcctcctcctctccccctacccaagacagccctgggggtcacaaggccccatccactctgcccacccccacgcagtccactctgggtgtcacccgtgaccctggtgcctggcctggggcagtaactgcaggtgcagggtgttctgcatggcacccatggggctctgtgccatcgtgctttggtggccccagaaccaccagcttccaagccattgggaaactctgtgcatgtaccgttttttgtagccttggagaagccttagtgtctgaacagtccattccctagagacgaccagcgacaaaaccgtgcagagcagggactcgtgggcagtgggaggctcatgtcctgacaccaggatgagctaggcattgcgtgtgcagctcagagctcctctgacagctcctctcgtgatggcgtgtgcagctcagcaccctgcagacagcacctctcgtggtggcttgtgcagctcagcgccccgcagacagctactctcttggtggcttgtgtgtgttatggcccttatgatggagataactccgtgcgccctccttccctgctatttggcaggcactgcacactagccataggctttgtgaccacagacgtgtcacggggagcaagaccgacctcacgggtcatccatgccacaggctcccctgcacaacggctccacagcaagccgtcaaaatgggtttcacagaaatcaccggcatcttcaaactcacagccccacttagataattcttgaaattagagtggatgatgtgaaggatgcagttgttgacacgtgtgtgtccgtgtttcagtgccgtgtgctggactcagccatagaaaggagacatgagggagaacagtggccccggcacctctgctgccgtgactgactgtccaaacccatggatggagtgacctcaaaaagggcaagagaaatgcagaaaaatgaagacaaggcgtgtgtagaggagcttatgcggccgtcgcaaccacaggttttccacataaccataaccgtgtgggaactgccagccactctccccgtccggcctcagtggtggtgtgttgatttcaactggtgtctacaatgaccgcggggtattttcggcaggaacagggacaaaaatgatcatctctcccatcagagcactgtttgatgatgttgctggaggaggtgtaaacgcctgttgcatgtccttggccatcacaggccgcactcgtgtggagttttgtgcacctccaacagcaccatttgctgctcaccgtggcatgatgagctcaggcacaacgtgcccatttacgaaggaggcagctgagacacagagtgggcggctggcctgcgggcgagtgggacccacatctgggtccacacaggtccgaagccaggcgcccctgtccacacagccacccacaatgtccaggcgcccccatccgctcagctgcctacagtgtccagacacccctgcctgcacagccgcccacagcgttcaggcgtccctgtccacacagctgcccacggtgtccagacacccctgtccacacagccgcccacagcgttcaggcgtccctgtccacacagccgcccacagcgttcaggcgtccctgtccacacagctgcccacagcgttcaggcgcccctgtccacacagccacccacggtgtccagggtttggataaaatctaggcttggctttgcaagcagtcagacgggaccacaaaatgggtctcctgaggtttagctcaggggttatttgacaccacatcatgttttattaaataccgtatcagtctagagtggggactccactgggggtgattttgccagatagtcacggcagcagaggtgccggggccactgttctccctcatgtctcctttctacggctgagttcagcacacggcactgaaacacggacacacacgtgtcaacaactgcatccttcacatcatccactctaatttcaagaattatctaagtggggctgtgagtttgaagatgccggtgatttctgtgaaacccattttgacggcttgctgtggagccgttgtgcaggggagcctgtggcatggatgacccgtgaggtcggtcttgctccccgtgacacgtctgtggtcacaaagcctatggctagtgtgcagtgcctgccaaatagcagggaaggagggcgcacggagttatctccatcataagggccataacacacacacgccaccacgagaggaggtgtcggcggggcgctgagctgcatcccatccgcacatccatccgcagtgtccaggtgcccccacccacacagccgcccgcagcatccaggcagacgtggtcctctctgtgctgctgggtgttctgctgatggggcagctcttttgggagccaacaataatcccaaacactaccacgcattccctttctcctccaggtcataatgctgagctccgtaccagacttacacggttacatcgataagtcgcagctgaccgaggacctgggtgggaccctggactactgccactcccggtggctgtgccagcgcacggtgagccgcgtcggggccagcggggctggctgataccagctcgagtacttccacagaatcgctcttgcattacaacacggccctttccaaaaacacattcacattaacagtcgttttctttcccaagaatgaggagatggtctcagtggaccttagtcattgtaaagaagtaacgtgagtcataagtttgggagtggctttctctgggcttggagaccaaaaaaaaaaaaaaaacccttgcgttgtggtttgcaacactcactgctctcaacggggagaggcagcgcaggcacaggcgactctaggtgacgggcacacgtgtagagtgtgcctggtatgtttctgaagaggtcaaggagggcaggacgctatgggagggcgttcaccgtctttgcgtcagccggtctcacctgatgggtctgtgtgggaacggtttccgccggtgtctgctttcagggcagcaggaggtgggtgcagtgcacaaggcatgcaattgtgttttctctgtccccaaggccatcgaaagtttcgccctcatggtgaagcagacggctcagatgctgcagtccttcgggaccgagctggctgaaacagagctgcccaatgacgtccagtcgacaagctcagtgctgtgtgcgcacacagagaagaaggacaaggcgaaggtacatggggggtgctccggctggaagctgtggggggctccggtcagtcagaagctgcgcggggctccggtcggaagctgcggggggtctttcgtcccagcgggagtttgtgtcagcagcacgtaagaccaagaagtcagcaggcttgagatgccttttgatggcaattagctcggcaacctctccgacgagaacggaataaaaggagtgtaaatgaaccctgtagattgctggctgcgcctgccattctggcgttgggtcaaccattggccctgggtggccgtggcttcaggagtgggaccaggggtggctcctctcaggagcacttttggctgtctgtgcggggagctcccgaatagacatctcttgcttctgagtgtgaccgagacaggatgtctgtgccggtttctcatgccgagcaggcgatgaagtggcggttggaattcctgtttgcagaacactcccagtgctcacgtgtccacagcgcttgctggaacaaacgtattctgaggagcacgtgctccctgctctgtgctgcccctggcccaccggcacgctgctggctttgcagcaatggtagcccagggccatgacctgctggtgtgtccccgaggactgtgcctctgtgctcaccgggccgctccaccgtgaggacactgaggaccaggagcaggcaccatgagaaagcctggtctccagtgactctttcaccttaacccgttgccctgagtgccctgtaatggcagctctgccccggggcacacaggagtgagggaggcccccacatcaccccgcctgcccgcacgaccccacagaagagactgggaagactcgggggtcggggattgaccccttcctcagtccccgccccctcaagagcaaggccccacgaggcctcaccaccagcctgcgctgtgtgcctggacggggccgggacatgaggctgcattctctccacaggaggatttgaggctggcactgaaagaggggcacagtgtcctggagagcctcagggagctgcaggctgagggctcagagcccagtgtgaaccaggaccagcttgacaaccaggccaccgtgcagaggtgaggcccggctgccttcctgccctcatcctgtcccagtccatggcaggatcctctcaggcacacagcttctgcaaaagaaacaggccacggaaatagcaagcagcgtggcaggcaaccccactcctggccagggccagcacagcagccggcctccgagcctctgtgtgggcctggctcctcctgctgaaatgcttttctctcgaaccccacagaaagccactgttttggggacaatttcctagagcaaacgcccttttgccggcatgaaggaggcgttaggggaagcagaggcgatgggagtgccttagacctggggcttctgcattccaagcggggcttccacagacagggagaaagcctggggttctccttgctgcagatagtgtttcttactttcattgtgaaaggtgtgattctcatatttctcccttgggcttccagctttatagcagcacagggtagggcactcgtgtggttggcatggtgctctaggatgtccagaactccctgagcatccccctcaccccccgagaactccccgagcctccccccgtcccatcctccccaagactccccaagcctcccatgtcccatctcgctggtgggtgctatcagccctgcctccgagctgaggagcagggcccgcacagctggacagcggcttgtccggcagggccgtgcggggcgcacccaggcctggaccaagctggtccttttgactctcagctgcctttgactcccacgcagcgtggcccacaccctgagctgccttctctgccagggacatgccaagggccccggggactcgacggcgcatccttgaggggctcctcgtagatggggtgccgtgacccacgaggcagaggctgcagcacagcccatgagggtgggccctgccctggcctgtgtcaggcaccttgtcagcttcccaaagactcagtttcctcatctgtaaagtgacgctgatccgtgcacacgcctggcagggtgggcgtggggctgactgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggcgcacagctggagtgccagctactcggaggcagaggtcgcagtgagccgagattgcacctgggtggcgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtgccagctacttggaggcagaggtcgcagtgagccgagattgcacctgggtggtgcacagctggagtcccagctacgcggaggcagaggtcgcagtgagccgagattgcacctgggtggtgcaacgctggagtgccagctactcggaggcagaggtcgcagtgagccgagattgcacctgggtggtgcacagctggagtgccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtgccagctacgcggaggcagaggtcgcagtgagccgagattgcacctgggtggtgcacagctggagtcccagctacgcggaggcagaggtcgcagtgagccgagattgcacctgggtggtgcacagctggagtgccagctactcggaggcagaggtcgcagtgagccgagattgcacctgggtggtgcacagctggagtcccagctacgcagaggcagaggtcgcagtgagccgagattgcacctgggtggtgcacagctggagtgccagctacgcggaggcagaggtcgcagtgagccgagattgcacctgggtggtgcacagctggagtcccagctactcggaggcagaggtcgcagtgagccgagattgcacctgggtggtgcacagctggagtcccagctacgcggaggcagaggtcgcagtgagccgagattgcacctgggtggtgcacagctggagtcccagctacgtggaggcagaggtcgcagtgagccgagattgcacctgggtggtgcacagctggagtcccagctacgcggaggcagaggttgcagtgagccgagactgcaccactgcacccagcccaggtgatggaaccagaccctatctcaaaaaataaattttaaaaaaagtttttaaacttttaaaaaataaaaatgaacaaactcggcggctcagcctagtcgcagtgacctagagggagagaagcaggaaggaaaggacacagcccctgatgctttctccagggcctccctcccatgctgacggccctgagtgcccgcgcccgcagatcccaggtttaggtgcagggagtgagcggaggccaggatctcaggaaggcccggggtggagatgagccttggggtcgcttgaacacccaccgcgctccacgttgcatggggcgccgtgggccacacagacggtcaactcctcctctttcccaggctcctggcccagctgaacgaaaccgaggctgccttcgatgagttctgggcaaagcatcagcagaaactggagcagtgtctgcagctccggcactttgagcagggcttccgggaggtgagtggccctgggtggagccggcagccgccctgatgctcacggggcctcctgtgcctgcgccctggtcccagtgccgggagctgagccgtgccacccagttgactttggcttaatgcagaaaagtctccgcttgccaggtggagcctgtgagattaagtcaggctgagccttgaaatgcacgattgatgactgcgtcattgtatagaaaggtgattgaaaatcagctcactgggatgcacttacactgcattattcgtaaagtagcaggaagcctttgctctcccttcatagtcatttgcatgcccttttattcaacatgcatgtaggatgtgcctgctgtgtgccagactgtaggacggcgtcacagtcatgaggtgcacagcgacacggccagtgcagccagacccagacgtctccctcctgcggcccttcgtggactcacccatgtccctcctcagcccccggcaaccactcatctgtttccgtggctgtgcttttgccatttcaagaatgtgacattaatgaatcccacagaatgtcactctcgggatttgtttgtttgctcagcacagctctctgcagacccccaggtgccggtggctcactcattgtgttccccggtgtggacggaccacagttctttcaatcattcacctgttgaagggtatctgggttgtttccggatttgagtattacagataaagctgttacaaacattgatatactgatgttggtgtaaatgtaagttttcatttcttgggcttaagtgcccagaatgtaattgcagggttatatagtagttgcatgtttcgtttaagaaaatgccaaacggttctcagtgtatgagagactagttgcttcccctttccccagcacgtggtggggtagtgattcttcatattatgctcacatcctgatgtgtgtgccatctcacggtggttttctgttgcgtttccccagtgttgatggtgctaaacacctttccacgtgcttatttgccattcgcatatcctctttggtaaaatgtcttatttctgttgcccattttctaactggattgtttggttttgtgcttttgttttacggttttgttacattttgagaattccttatatactgcagatactagttctttgccacatatgtggtttgcgaatattttctcctggtctgtaacttgtcttttcatcctctttaacagggtttttcacgtagccaaagcatttaattttgacgaactccaatttgtcaatttctccttttaaggtttatacttttggtcctagattccaagtatattcccctaagcctttttcccctcaaatttcatagttttacattgaagtctatgacctaatttgagctaatttttgtataaggtatgagaattagatcatgatttgttttacctctggatgtccaattgctgtagcactgtttgttgaaaaggccctttcttccactggatttcttctccaccgttgtcaaagctctgggcacatttgtgtgggtctgttctggagactctctattcaattatgtttatctacatacctcttcctctgtctgtaccacaaggtcttaattgctgcaactatataatgtcttgaaatcaagtacactcattcttccctctttgttttctttttcaaaattgtgttagcttctagttcttttgccttttcatggcaattttaaaattatcttgtctacatatatgaaaacaaatttcctggggttttcataggagttgtgttaaacctatattttaaggagaagaaatgtctttactgtgttgactcttctagtcaacaaacatggtattcccaacatttgatttctttcatcagtgtcgagtagttctcagcacacaagttcagtacgtattttgtttgacttacctttaatattccactttaagaagtcatcacagtattatatttttaattttggcatttatgtattcattgctgcacatagaaacacaattgatttttgtatatttatcttgtctcctgcgaccttgctgagcacacgtatttgagatggttttttgtgaagtccttgacattttccatatagaccatcatgtcatgtgcaaataaggacagtttggtttcttcctttttgaagatatgccttttattctaccccccacccacaacaccctgccccactgcgtactgccccaactagagcttccaccatatgataagagtggcgagactggacatctctgctttgtccccaaccttaggaggaaagtgtttagtttttcactgtcaggtgtaatgttagttgtaggattcttgtagatgctcaataaaactatctgggcctagagatttctttgggagacttttaaaattatgaattcagtgtccttaatagttacgcaactattgaaactatctgtttcacaatgagatatagtagtgtgcttttcaaggcaatgtgtagggttgtttatagtattctttcttatctttttgacgtctgcagggtctgtagtgatattccctgtttcatttctgatatttgtaatttgcatcttttccttttttctttgtcaatctagattgagatgtatcactcctcatctttccaaagaactcgttctttgtttcattagttttctctgttgttttctgttctcagtttcattgatttctgatcctacctttattatttctacaaattgctttggtgggaacttacattctttatttgagactgttcctcttttctaacatacatatttaataagaacactataaatttccctctcatcactgatttagctgtgttccacaaattttgatgtattgtattttctttttcatttactccagctttttttttttttttttccaatttcccttggaacttcctctttgacccatccattctttaaatgtatgttgtttggcttccagtgttcagagattttcccgttgtctttccattcttgatttcaagtttgattcattgtaatcagagaacatactctgtatgatttctgttcttataaatgtgttgagatttgttttgcagcccaagaatatggtctttcttggtatatgttcctcacttgaaaagaatgtgtattctgctattgttaggtgaagttttatacatatcagttagatcctgttggttgatggtattgagttcttctatatccgagctagtttctgagaggtggtgcattatccataactcagtggctgtgcgtaacatggagagaagtctcactcatcagctgtgccagatgcagggggttcaaggatggacaagaatcctgccttcctggccttcaaccccaggccatctgaactacaacccccttggcactgggatgtctgcgtacacacccattctcaggatcatttccaataacaaaaattaaaagcttttgtatttaaaggaataagtggtcatatgttttaaaaatcaggccaggcatggtggctcacacctgtaatcccagcactgtgggaggccaagacgggtggatcacctgtggtcaggagttcaagaccaacctggccaacatggtgaaaccccatctctactaaaaatgcaaaaattagctgggcgtgatggctggtgcctgtaatcccagctacttgggaggctgaggcaggaaaatcacttgaaccagagaggcagaggttacagtgagccaagatcacgccactgcactccagcctgggcaacaagaacaaaactccgtctcaaaaaaaaaaaattaaaaattaaaataaaaatcatttctatgacacccattgtcttcctgccaacagcagaaatcgtagacattagaagttagtagcaagctagaagggactgagttacataactctccacacctaggatccagtaggaatgctgacaattccagtgtccatattgctgctggctttcggctcccagggcctttgtccttgcgtgatctcatcttctcctcatgctgttttcaggcgtgtggttgataaacggaggcacacacaagccacagagaaacaattgttctgccagtgaggtcactggtgggtagcgtcgacccagaggccccacggtccccgcttgattggtgaccactcggggccgactttgcacctgtctgactgtggtccctgcttgattgatgaccacttggcccgactttgaattctgtcatttccctgatctggagcactggagtgggttctctctgttcaggtgagggagacacccccctgagatgggccctcctctgttccaggtcaaagccatcttggacgcagcgtcccagaagatagcaaccttcacagacatcggcaacagcctggcgcatgtggagcacctgctgagggacctggccagcttcgaggagaaatcaggcgtaaggcggggtcccggcgggggcggcgggagagtgtgggcagcatcatcaagtgctgctcaggaaggcgcaggaatgggcctcccgcctacggagaacggaccccacagccccccggggatgtccatggggtggggggtgctgctgcctgtacccctcccctcccacaccccacccacagcacatggccctgcccggcctcctctgggtcaggtccctgcagacggtcaatgcctttgctgggaccaccacagcccccagaagcacttgccacagaacagcttcggggattaagcagcatctcaggcatccgcagcagtaaacaaagaaatcaagacacacgtgtgccccgggacacacatcccgtacagcaaggcactgtgtgcctcgaacagaaagaggcctgagctggtcctctgggtggccgtccacaggtggccgtggagagggcccgggccctgtctctggacggcgagcagctcattgggaacaagcactacgcggtagactccatccgcccaaagtgccaggagctccggcacctctgtgaccagttctctgcggagatcgcaaggaggagggggctgctcagcaagtccctggagctgcaccgccgcctggagacggtaggccgagccggaccccaccccactcccccccagctgcggaaccagcctcttcctcccacatccaccaccggctgacccttgtcgtggggagggcagctctttggctggaaaatgtccttgcacccttcgtttctggtcttgttggcctagagggtctttttctagaattcatttgccacagttttatttctttttttttttttttctcactgcaacctctggttcctgggctcaagggatcctcccacctcagcccccaagtagctgggactgtaggtgcatgccaccgtacccagctaattcttgtattttgtgtgtgtgtgatagagatggggtctcactatgttgcccaggctggtctcgaactcctgggctcaggtgatcctctcaccttcacctctcagagtgctgggattacaggcgtgagccaccctgcccagccaataatgatttctttaaaagatccagaagcttaaggcctggttgatcctactgcacttaccctgcctctccaggccccgccctgggtaattcactggtgttgtccagcactgtgtccccttgggattggccttgtccagcactgtgtccccttgggattggccttgtccagcactgtgtccccttggggtgctttggacagggtggcgggagcacgaggagtcggtggcccgggatctgtcgggaggacaccccggcagtgtgtgcctggacagggtgacgctctcaccctctcacggcgtcctgccctcggcaatgctctgtgtttccagtccatgaagtggtgtgatgaagggatttacctgctggcctcacaacctgtggacaagtgccagtcccaggacggcgcggaggctgccctccaggaaatcgagaagtttttggagaccggtgcggaaaataagatccaggagctcaacgcgatttacaaggaatacgaatccatcctcaaccaagatctcatggtaacgctgactcgggctctccatttgcagcttgctgtcccgagcagtgaggcattcctctgtgggaagtttgaaagaatcatttaatgaattatttgtatttatttattattattttttttttgagatggaatctcgctcttgtcgcccaggctggagtgcagtggcacgatcttagctcactgcaatctccgcctcccaggttcaagcaattctcctgcctcagcctcctgagtagctgggattacaggcgcccaccaccaagcctggctaatttttgtatttttattagagacaggttttcaccatgttggccaggctggtctcgaactcctgacctcaggtgatccacccagctcaacctcccaaagtgctggaatgacaggtgtgagccaccgcacctggcccatttaatgaattactaccaaataataggcatatgagagaaacacacagttgggaggtcaagctgaattttcctttcaacacagaaattatttccacgccaaccctgcgaggtggccatcccgcctccgctggcagactttgtggcatgggtgtgttcttcaggaagggcctggccctgggacctggtgatgcccttgagaccaggctcctcctgagccctccacatgcctggggaaggctgcaggcccctccctcgcatggagctgccctttcccgaggccggggccccgtcccgtgtgggggctgcatccccctctccgtccgtagtggccagggctggacacagctgcgctgcgctgacagaccccgcatggagaacatttaaagcgggggttgggcgtgccccggcacgttctgcgcctgactgtgtatttttagtgatgacaccaacatgtgcaaggcaccttactgagcatgcggtttcaggagcacgtgcgaaaggtcttccagaagcaggcaagcatggaggaggtgttccaccgcaggcaggccagcctgaagaagctggcggccaggcagacgcggcccgtgcagccggtggcccccagacccgaggcactggcaaagtcgccctgcccctccccaggtctgtgtggccgcccggtgccccgggtgctgtgggaccctcgggggagccccgggcgttgagagcttggtacatctgaggcagccacctgcgaaaactgtctccacacgcctcctccccttccacctccgggccccagttcagggcctgagggccggttcccgccacccctcacccatgtttataaatggagttttgtcaggacccggccacgcccatcctgtgccacgcacatcttgtaggcatcgttgtggctgcttttccatgaggctggcagggttcagtggtctcagtgaagcccacgtggcccaaaactggaaacacagagctcccacagaggaaccatctccggccttcccagctccagcctctccacggtctgtcctttcccggtgctattgccaaacaacattcctcacacacggcccagaccctgggctccaggagccctgaagagccacgtccgcgcacctcagtccggcgcgcattgctggtcccaaacccgccctctatgccgagccaggcacggcgccatttcccagagactttcccgccacctctgtgtctcaaaacgaaccctcttcccatccttgctggtttctcacacacgaacccaccaggcgagctgctgccccagctttggcgaaagtcagctgtcaatctcaggggccccgggggccaggctcttgccttcctgtgctgggtcccaggcgaccttattttctgcctgttgggagctctcccaggtcggagcccacaggcgctgtgtccccgtgggctgtgggaacgtggggtgactcagggcagtgaggccccaccgtcctcccccttcccgcaccaccacctgtggcctcaaaggccaagtcctgcccacgccaccacctgtggcctcagaggccaagtcctgcccacgccaccacctgtggcctcagaggccaagtcctgcccacgccaccacctgtggccccagaggccaagtcctgcccatgccaccccctgtggcctcagaggccaagtcctgcccacgccaccacctgtggcctcagaggccgagtcctaccctctcctcggggccttttcccgctgggtgcacttcccctctccagagggtcagaggggacttcatgccccgctccccttcttcccaacaggcattcggcgaggctctgagaactccagctccgagggcggtgcgctccggagagggccctaccggagggccaaggtgaggcttgcccaagacaaccccgccatccacacccccctccttggttcacgctgggcctggttctccgtgtggccccccctcccgggcactgcccagctacctggccagctccccatcgtgggaattcagccctgtccccatacgggaactggtgggctctggccttgagagttggcccttgaggttccgtcccgcctttcagacctgacgctgtttttctccccagagtgagatgagtgagagccggcagggccgcggctcagcgggggaggaggaggaaagcctggccatcctgcgcaggtgggtgcgctgcccttctgtcctcacaggggccctccgaccgcagcctgaaccaccagatgccgtcaggcactcgagcagatgcctcacagatagaaggctggtgcagaagtcattgtggttcttacttttgcaccaaccgatacccagagggcctgccgtggctcgagcgtgtgtcctggtccccaccgcgtgaagcacacacacgccgcacacacaccactcgggattcaggagggaagagagggcgatggctgaatgcaacagtgaaggggcatcttcgccccagcaagagcctccacccgccactgccattcacaggagacaccactcaaaggccccaaccagcaccagctgcagcagcagtcaccagctgctcagggctcagtgtggcaggcagtggtgccaggcagctggtgtgtgggagggcatcgtctccagccctccttttcccctgggattcctggaccctcaaactcagggagtgttgtgcaaacaaaagcagttctctttcctccttcacctttaagaaagaaagacctcactggtgcagggccagggaatgcaggtccccagagcaaaactgggaaggagccaaacacccatgaggcacacgcggctccctcccagaggccctcgaggaagaggaggaggccacacaccgaccaggcacccgccactggcttcacactttgcactgtctccgtttttagtatttgcactgaatatgtttgcaagagacgcttggaaccacgtctccccctttcaccatcaaaactccaaaatcaggaaagaagaaaaggctcttcctgatgtgttgacaagcaggtgtccgcaggcagcgccagtgtgaccctgcagggttgggagacggcgcaaaattgggaattacaggaaactgagcttggtgtgaaagctgagtctgtcacttccggcttctgatggaagctggtgaaacaggatgggaaggaagaggggcttgccaagaagcgtccaggcagaggattgtccacacggaggagggtccaagcagaggggcgtctgcacggaggagggtccaggcagaggaatgtctgaatggaggagggtccaggcagaggagagtccatacggaagagggtccaggcagaggggcatccgcacagaggagggtccaggcaggggagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagagtccaggcagaggagtgtccataccgaggagagtccaggcagaggaacgtctgaatggaggagggtccaggcagaggagagtccatacggaagagggtccaggcaggggggcatccgcacagaggagggtccaggcaggagagtgttcgtatggaggagggtccaggcagaggagtgtctgtacggaggagggtccaggcagaggagtgtccatacggaggagggtctaggcagaggggcgtccgcagggaggagcagcaagtgctcggccctgagacgcagaaggagtggccctcggctggcagttcctgggttgtgagagggagtccagagccctcttgctccccagtcctctcccctgtgccgagtccggggcctctgcgggccgacagctgtcttagaacaagcttgctgaacaacctcaacccaggaccagccccctggctccagtttctgtgcatcacataagcaggcagggccgtaggctgctgaaaggtgctcacacccacagcaagacctgcgcagccagcttgtgcaccctccccttctggatccagtgtggtgggtgcagggtcactccccggaccaccactgcccacctgctgtgtgtgagggcgtgggcagggggcagctccggcgatgccagacccccgccctggccacgaggggccacacagatacccaccacgaggaaggctcagggaggccgggcagcaggcgggcgtcttcttggcagaagagactcgggtggattctagggatgggtcctaggagtaggatgacttgcccatgagcgtgaggaactcagctcattttgcacaggtgggacccaaaagcccaggaggcgagtctgggaatccctcctaccaggcggtgtgtgccgggccaggggcaagacactgccggccagtctgggaaccagggaggcttcagccgccgtctgcagggtctgaggccgcgagctgggaggggaaccccgaggagcgtccagcctgtgggctttgggtcgccgccagtcccctcctgctgggcaggccatcattctaggtggcacctgtgagactgtggagcagaccattcctgctctcccagtgctaaccttttttgctctccacatgacctgccaccaggcacgtgatgagcgagctcctggacacagaacgggcctacgtggaggagctgctgtgcgtcctggaggtgaggctggactcggggagggccgactgccacggggactcccctgggccagctggtggggcttcctctgacaactgctgctcggagcagcctgctgtccaccaaatgcatgtgagagagcgcccacagcagcctggtcgggccccagacggggagcccctgggggcctatcaacaagacacagaccaggcagctcaggggggtccgtacaggggacaagtgtagtgataagaaagaggagctgacacacaacagatgcacaaaccacacacacatcgtcaccaacacaggccacagggtgcctgcgattcccggcacggggcactccagggcaagcaaaactcgtcggaggtgggaggcagattagaggtgaccttggcagtgggctgttgcctgggtgagcttgatgtgagtggtggtcacctgagtatagacaggcatctcattcacccagtgtgcacaggtagtgatcacctgagtgtagacagcgagtgtgcacaggtggtggtcacttgagtgtagacgggtgtccgaatcaccgagtgttcagaggtggtggtcacccaagtgtagacgggtgtctgattcaccgagtgtgcacaggtggtggtcaactgagtgttgacaggtgtctgattcactgagtgtgcacatgtggtcacctgagtgtagacagcgagtgtgcacatgtgatcacctgagtgtagacagcgagtgtgcacaggtggtgaccacctgagtgtagacagcgagtgtgcacaggtggtggtcacccaaatgtagacgggtgtctgagtcaccgagtgtgcacaggtggtggtcacctgagtgtagtcgagtgtctgatttactgagtgtgagcaggtcacccgagtgtagacataagatttgtgccctctgtttcagttacacctgaatcataaaaggttaaaagggagaagggtagaacctccaccccattcccccaaattggtgctgttcataatgcttttgctttgatggatgcctgtcccggtaacttagaaatcacccgagaataaagatgaagggctggcctggcccacagatgagccggcatccctggcccacctgcccccccacagcatcaggcccaggacccccgccgacctctgcgctctccctgcagggctacgccgcggagatggataacccactgatggctcacctcctgtcaacaggccttcacaacaagaaggatgttttgtttggaaacatggaggaaatctatcacttccacaacaggtgggcccttccccccgacacaggcacgcacccgtgatctcttgcagctaatggtgctggcttcagggggctggaatgggggtggaggccaggccatgcctggctagggaggggcgcccaaggggtggactcacagaggcacaggcttgagtgtgggtacatggggccatctctgagcgcccacgtggcaccgtacctggtggcctgtgtctaggcagccaagttgtaagtgagccgccagccgtgaggagagggctctgagcccgagtgcgccctgttttgtggtgcaggaaatgggacccgcctgcccctcatcccctcctcatcctgctgggcaggtggaagccggaaccccctcccaggtgtgtattcggccctttagggggtcaccgaaggccataccacatagcaaggcctgttttgttcccaagctcttgaaaaggacggcaaactaggcgttccttacccatcatgggggctgcttgtcccccgagcgacccgtggcctctccagtgcaggtggcctgtccggcctcttgtcctccactcctctgagctgtttggctgctttaacacagttttggggagctcatgggaaggtgtagggtgcacacgcagtgcagaatgccagggaggctgcagtggacagcccccgctgcgtgtcctggaaggaacccatgtgagtggctcccatgcggccatgtgcttggggaccagcgtgccccactggccatgggaatcgccagtgcttgggatgttgttctgacacctgtttcttgccctctcatcacctcacctgccacttacaaggaggcagcaggtctgcagttgaccaccaaggagccttccacgtccacggagcttgggcagaaccttagtgtcccttagtatctgtcctcatggcccccagggtctcagccagtcctgcacgcaggggtccccacagctttcagctgttgtgctcatgccccaaatccatcccccagacggttttcccctccagccggacttcctccaggggacagatgcaacagaaaacagcccaggagcctgggggcggcgctgcctagggccagggctcagggtgtgtctgcagagaacccacagacccacggccagttatgggggtggcgcctccagggccctgaaaggtcccatctctgtctttgcctgcggccctgtgagccgtgtgtgtgctgagggaaaagcagctccctccaacttctgtgtgcagccaaggccagaaatataaagagactcagcctggggctgcacctgctggcgcctgagagcttggtgctcaggacaggcgtggctgcggcgtctccaagtcatgcggggcagattgcccagagcaaggcgtaacaggcttctgaaaaatgacgtccatccacttgtcactggtccacgtgactcggcctgtctttcatactacttaaaaaccttctttgtctaggatattcctcagggagctggaaaactacactgactgcccagaactggttggaagatgctttctggagagggtaggtggtgttttgacgtgtattttgtcacaacttcttaaaagtactgaataatgacttcagattctactgcaagttcctattctaaccaactgaaatcacaaaatacgatgttttcaatttggctgagataccatgatgctcctgtacccctagaacctcctgaacccccagaacctcctgaaccccagaaaacctcctgaaccccagaaaacgtcctgaacccccagaacctcctgtaccccaggacctcctgtaccccagaacctcctgaaccccagaaccttctgtacccccagaacctcctttgcccccagaacttcctgtcccttagaaacttctgagccctgtgccttaaaaccttctgtgcccctagaaccatctgtgccctagaggcacccaggagcaattgcacttcacaatggggctagggtctgttttttgctaaataacaggtaatttgtaaaactgccagagaaaatgctagaagttctattatataaacaaatcaacaaaccacaccataaatggccttctaagaatggctgcggtggaaccccgtctccactccacgcctgtgctctgggaagtcaggggctctgggacagggagccccattaatggagggcaggccccccagcggagcctgggagccagtgccggccctcggaagctatggggccagcagcaatgcctcgcagggccgggaagacgctgcgtgatgcggtgcccgtccctcaccgcgtaatgcggtgcccgtccctcaccgcgtgatgcgctgcccatccctcactgcgtgatgcggtgcctgtccctcggtgcagatggaagatttccagatctatgagaagtactgtcagaacaagccccgctctgagagcctgtggagacagtgctccgactgcccgtttttccaggtttgtccccggaccttcctttagaacgttactccctttcctagccgactcctgaggaataatgaaaattgtgcaaaccaaaggctctgggttggttccaggaatgccagagaaagctggaccacaagctgagcctggactcctacctgctgaagccagtgcagaggatcaccaagtaccagctgctgctcaaggtgggctccgcggtgaccgtggcccggcctccccagcacctgctggccaggtgtctgtgccgccctggggccccgtccccatcgcgccctgcccctcccaggccaagggcacctcttccgagcctgtgctgaggctgggatgcctttcgaggtcctactgtgcgccactgttaggggtctgaggacgcaggtgagcagacgagtccccgtccccatgggttggcacacagcccagcccacatgggattctgtgtgatgtgctgacccgtccctccagggtggagccgtgcccggattatctggcacacagcagggacgtggggcggcctagactggggattccagctatgagtttgccatgtgggtccctctaaccttcaggcaggaaactgcaactccatgcctttggccagggttagggtggcgagaggaaactccccagggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatcagggtggcaggagggagctccccggggagcaggtgcgaggggtttgcacctggcatccgggtggcaggagggagctccccggggagcaggtgcgaggggtttgcacctggcatccgggtggcaggagggagctccccggggagcaggtgccaagggtctgcacctggcaggggtgctgccccatctgcagcaccactcagtctgtcccagctgcaggagggcaggcagggcagctccccacagaccaggggagggtgagcagcatccctacctcgtgccaagctcctgaggggtctgttccaggggagccagggctctccgtgtcccgacgcggttgcctcaccccatgcccctcaggaaatgctgaaatacagcaggaactgcgagggggctgaggacctgcaggaggcgctgagctccatcctgggcatcctgaaggccgtgaacgactccatgcacctcatcgctatcaccggctatgacgtaaggcgcccagatgcccggtcttccccgccgcctccgtggaatacaccagcccagcaacttggcggcctccctgcacacgcccctcgctttggtgtgaatgtgcaggttctgggcaggaggtctggggtggtccctagataagcccactcccaggccccacagccgggtccacagaccccacagccgggtccacagaccccactgggctctctgggacgtggagaaaatcaggaagcgtcccttgcttggagggcacgcatctccagcaggaacgcagctcagacctcctcactccttgtcttctcctggggaggaggcgtggctcggagcagacgtgacttctgttttctgggctgcgatttgcaggctggtgacttagagcaagtggccccagaaggcagatgtcactttccccgtagagccccacatcaggtcacagcttattcatcttttgtccgtctttatgtccacccagcactcattctcaggtgttttttttttaactaatagagttgatttattgcagcaatttttggtttgtgagataattgagtataaatcagaggccctgaggcttcccctagtgttgacatttagcatgggtgccacacctgccacacatggtgaactagcgctgatgctgattagtgactgagggccgttccccttggagctcactctgggtgctgtgcattctgcggtttggacaggcgtgtaacatcctacacccagcgctagagcatcacacagagcagcttcactgtcctagaagcccatgtgccccgccagtccatccctcctcccccagcccctggcacctgctgacctgtcagtctccacgagcttgcctttcctgggacgccctgcagctggaatcccaccgtgggtgggctttgcagagtggctgctttcactcagcgatgcgcgtccatggccccaggcccatcccgtcctgaacacagccctgctgtcgcacatttaggggaatctcggcgacctgggcaagctgctgatgcagggctcgttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacgtaagtgaggccgggtctgcagcagcacgctcctggccacagaccccgacgggggaagtctgtaactcggtctgaggtggccacgctgacacccagctctcagccttaggtgtaggggtggggtattctgccattcttagccctcacccccaaagtatttccatcatttcgtgcctgcaccaacaccttttaaaaacaaggcagtgggttcactgtgcacgcgaaccccatctccactctctgctcgcagatggctgccgttggcattacggagaacgtgaagggagatgctaagaagttcgagatctggtacaacgcgcgcgaggaggtctacatcgtccaggtgggccacccaccctacccctggcctcttacacattgccacgaatggtttctcatgggaaccagtgcaaggatctgccatgaagttgcatcgagcccaggagcagccgctgtacacttcaggatgctgccctgggctgtcttcaccctgagctggacccagaatgaaatgtggggaaaagtacacatcagacggggtgctgcgaggaaacgggctctccctccccaggggagctcatgtgtccctggacggtgcaagtgtgcatctggcacgcagggccgattctcacggtggggagggtgccgtgccctgggtgccaggcacagttcttcagtcagtcccgtgcatggggcacagagggtcccgcaatgcggggccacccacagtgctttcctcctctcccctcacacgcagccacctgacctttgactcctaagattatctttggatgttccgagagtgaaaccaaagcgtgtttcctcgggggcctgagtactcacctcctggcgtttcttttggggaaacaggcgccaactcctgagattaaagccgcgtgggtgaatgaaattcggaaagtgctgaccagccagctgcaggcttgtagaggtgaggctgtcttcaagcgatcgtttcccgtagcttccgctccaggtgcatttttacctatgttcagagcaaccgcacagtccccccatgcgcaaggtgcctcggcgttgaagtaaagacgctcgttcacgtggtttgtctgctccctcctcgcagaagccagccagcaccgggcgctggagcagtcacagagcctgcccctgccggccccgaccagcaccaggtgagaatggacacgctgccgcaggcctgcgtttctggagcagtcccgagcaggccatttgcacgccagggtcctcggcctctgtcagtgggaccctgtggttattggggttttccttgaggcccctggtgtttatgtgctgacgggtccgtcccagagggtgtacttcacagatgtgtgcctccgacaatgcccagtccctctccagctcttcccggggtgggctgttccacagcacggcagtgcgcacatggcctgtccagatcacagccacgccccagcactcctcagacagtcggggctcagctgggagccggcactgatggcccagcacacacgtgggcacgtttcagactccgaccctgaccgtggcttcgtcgtgtctcttctgcccttgttttttctttattttgttcatccacttatttttttcactttatcctgtttcttatataagctacctttaatcattcatggaacaggatatggcctaaataaataatccgtagaacagtagttttaaaaaagaaacactcccccgcccccccccccgccccccgaaaaaaaaagcctcatacttcagagcaagtagggtgggcgtctgttctcatccagcccgtccgggtttaacttagaagtgtgtggcccctcagaagcaggagggtgggcatctgctctcatccagcccgtctgggtttaacttagaagtgtgtggcccctcagaagcaggagggtgggcgtctgctctcatccagcccgtccgggtttaacttagaagtgtgtggcccctcagaagcaggagggtgggcgtctgctctcatccagtccgtccgggtttaacttagaaacacgtgcaggagatgctgctttaggatcaggccgggagctcagagatatctgaatgcctcaggtcctcagggcgttctgaaagactaaccaggcaacacactatttcctttttgatttgtctgatgtcatcagtccctcaagaggaaactcaaggaacatcaagaagctggaagaaaggaaaacagaccccctaagcctggagggatacgtcagctcagcgccactgacaaagccccccgaaaagggcaaaggtgggtatgtgcagggaccgggcctcacacggaggcctcacacggagctgctcacggagtgctcactgcatccgagaaacctgcgcttcctgcagtgtgaagaagctttgcagagcattcagggccccttgctcccctcttaacagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctcttccttcatagatgacacggtcactagctctgcctcagaaagctctgcgctttccagaaagcgctttaccctgcagggttttgctaacctcaaaggtcagaaaggtaaaagtagtgcctgccccaaacccaccctcaccgtggtggcgtctgtcatgcatcgtgtgtgaccattcgtgcctccttcgtcacaagggcggccacgcaaaagcgtttctttccacccaatcacgtgttccctgatgctgtgtctcgcgcacagacaccagagttatttagaggtggctttccttcgggaaaatgaaggcgagcttttcaaatggaggcttgctcagaaacggagctgtccttggctttccaggccccctccttcctctccctgccccccacccccgccttctcccgccttctcaggtgagttccctgcagggtgctgaccttgctggctgcgtgtctctgctccgcctggtggcagaggccgctcagccatcttctggggcatccactagtgaacagggctgatgggacccttgagacggagacgtctaatgccctgctcacctgcgagagctccatgatgggaaatacatggcggggaaatgggcccaggaggccctggaagccggccctggcgtgcaggcggctcttctgggaagccctgaaggccagcgtggacaagggctctttccagagaagtaggagtgttttccaatttataaaatgcttttaagttggcctgagacttgaaacaaacaaacaaacaacagattctggtgctgcaaactctgctagcgcagaactaagaaaacgtccctagagacgggccccgaaaggacgcctctgagtgccgcagcccccactcccatgccctcccggcccctccttcactgcgcggcccctcggctccctgtgttttgctcacagaagctcctttttcatcggtggaaaggggccacaacgtcggtgtccccttccagcacgagcgcgggtcagcctcctcgccgcctccctccgtccttcacactctctctccggttgtatttctgcctcctcctcctcttgcagcttctcctaccagtcctgacaaaaaagccaagcggcatgaagtaaagagcgacccgactccctttggtgtgcgaggtagagtggcaccctcgggcacggcacccactctgcgttggcaggaagcgcggcccagctggctgtcaggtggccgtcaaggccacctaagggggatgctctcgtgggtctttatgctgcggaggcagacacgcggttgtgttcaatgtgtgatgctctggtgacaggtcctcgaggacagcacgcctctcagccaactcctcacagcaggtctatctggagcctgcggaactgcccaccccgtcggtggctgctggccacggctgctgcgctggtcacctggccgtgctgggtggagctgggtggggtctcactgcccagtggctgctgtcggctatagggcaccctgttccctgcccttccctgtggcacagtttgccccgacacttcctgctgggaacacagagcatagcaactggcagggccgacccggaccctcctttcccggggccaatgaggccgagctccctgtccgacccggaccctcctttcccgggccgacgaggctgagctccctgtggaacctggcccttctcgtttcctgcctcccttatattctcagggtgaaaactgccctgtgaagcccagagacctcccctggcctgttgaggaccttcaagtgcagggacggggctcatgtttgcaatcttgagttttcaaaaatttgcaaaggttcccaggggtgtaagcagaaccagccttcccattccgcccgcctccacagcctcctcacatgacacagcgagcctcacagaaccaggcagaagctgtggccaccctgggcatgagttcagaggcagggagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctcagcctctgcttccgtctcgtcatccatgaatgaagacagtacagccttgcagggtctcgagaaagccagtgtggtgttgaagccgggccactgcccgtgggtcatttccaccgtggtcagtgtggtgtcagagccgggccactgcccgtgggtcatttccaccgtggccagtgtggtgtcgaagccgggccactgcctgtgggtcatttccaccgtggccagtgtggcgtcgaagccgggccactgcccgtgggtcatttctgctgtggttggtggtagtgagcccaggtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacagcgctcttgatggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccagctcctgtgcacacacagcagcccccctttttttgttcccactgtcctcaatcagacttttggttctgtctggccagaggccccacgtgcggtgcctcagagcgactgggggcctggacggggagggcacgctggcagccaggccccacaggccagtccctgctgctgtagaggaggcacctgggcccccacccttgctgtctctcagcctcccttgctgggggcagctgcaggtgcactcaggaggccaagctgcaggtctgcaaccggaaaatcacagtcctcaattctcacacagatgcaggcctggtgtggtgcctggaaggctcaactgcctccagctgtgaccccaagaaggcaaagcacccgggtggggtggaaggagcagccccgtgctctgctggctgacagtggtgcccaggcccagctcccttctctgcacagacagcagagttccgcttagcacaggcttttccttgccagcgcagacgctgtcagccattggaactggcctgcaagacagcttgctgtggcggctttgcaggcacagggcacacaggcatccgtgcacgcagctcctctgtcctccccatgccccacaccctccatcgcaaggaaacgcttgcttccagtggtaccaaataggatttggaaccagtttgtgcccaagctcaaatctcgttagcatctgcctgtttccctggtgtgcatgtgtcctgcctcgatgcatttggcagcaggtgggatgcgctgggcctgctgcctggttgctggctttgcgtgtttatttagccccaatggcgtctcccatctcccccgcatgggaaaggccggtgctgccctctgggagcctggcaggaggaacactgggttggggaggggggcatgtgtggtcccaagtctggaagaagctccttcctcttctcccgctgggagctgcgtggccgatgggagcccatctccaccgcggcacctgcatggtctcagccttccggttcggtgccgctgtgccgggggctactctcttgccagtggggaccacagccctcggtatcccataggtcaagggcgtcaggccctctcagtgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagggcgtggcttcccagggcctggggatcgaggtctcccacagggtggcccagcaattggaagcagatggtctcaaaccctgaaacgtgccaggcattctggaagtttgcaggggtgtcctgctcagctctttatgaacccgggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacgggggctggtcaagtgcagaggagcagattaactcgtccgacgcagaggaggacggcgggttgggccccaagaagctggtaaccacggcttccctgtgggcacttggggtgggggctgccctccggggattaggggtgcttctggcaggtccacccaggcttgggtcttaggacacagccccagctcctcctaaccctggaaggtccacatgggcctgggtcttacgggcagtgccagctcctcctaactctctctggaaggtccacccagacctgggtcttggggcacagccccagctcctcctaactctctctggaaggtccacctgggcctgggtcttaggatgcagccccagctcctcctagctcctctgtctcagcagcactttgtgtttctgggttaatttccaggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatgtcagaagcaagaaaaagctgccatgtgttaatcattccagtgagggttacaccaagaagtgtctgctgcaccttctgtgctgtgcgtggtccatgccccaaggctggaggtgcaaaggggacaggtcccggaggctctggaagggcagagaagccaggcgtggaagggtagggagagccctcggggcctctggcctctcccacagagacagcatgaaggaaggcctgggcgtgagaacagatgtgggggacacagaggcggaggccacgtggcaggaggggaaacaggctggtggaacagggtgcacggggcctggggagggatttggatctcattctttgtggggtgtggggagtgatcctggctactctgggcaccacagaggcaggagccagtacaggccatcacgtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaacgtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaaaggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccggggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgcccccacccagagcgcctggccgtgcgggctgcagaggacccctccggggcagaggcaggttccacggaagaccccggcccgctggggcttccccggagactccagagcccacagaggaggggccgcagggaacagccccgggcggcaggcgccgggcagcggcatctcgtcctggctccaccgtgctgcttctgcctctggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacatagaagcacgttgtttataccactaagtgactttgggggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagatgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccactgtcacttttttttaactgctgatgtaaatggaattttaaaagcagagttctttattgtatggatgacgtttgaataaatatcagcaactcctgc

SEQ ID NO: 1652 - DNA, 150902 bp, Homo sapiens
tcagaaagaataaaacatctgttttaattggccagtaaaatacattgcaaatcattagtattttataaacagaaacattaagttataaatccatgttaaaaattgcagctcagtgcagccccaacagctgtgtgtccaaaagtctatttttacaacattttcctccagtatttttgtgacaagaaagttcctatctgccatctagatcaagagcctgaactacagtattttcaaacaagaaccgggagaagtcggtacaaggatacgtcgtgctgtgtatttaaacggcgcttcccacacacctgccgtctgcatcccgggaggacgccctttgggaaaggcctcctcggcagtgtgaggtctggaggggtctgcctggaccccatttttaggatgctcccctccccaataaaacagcagcccccgcccctgccctgcacagcatctgggggttcataacacaggtgcaatactgaccatgggccctggagggacgtctgcaccccgaagcccctgtacctcaaactcagagtttcttcccttctttgattttctggaggacctgcagctggccttcctgagacaggctccattcctgttccatttgccttcccggcagccttccctttagtgggtataggttttgacgttctgagttactttgtatcaaagagctaattaaaaatggtccttcaaaaacataaagaaaaacagcttgaaaaatgtacatttctatttttaaaatcttcaaacttccacggggggtggcaaatgttaattctgattttaaaccccattcaacagcaaaacgatgtgggcttcaactgtgggctccgcagacgcctggagaagctggagcccacacctttccctccaagggactctgtggacagaacccgtatcccccaagcaccaaggacatcctcagactgggacttctgtgtaattctgcacctcccagccataaaactgacccctcagccaggaatcaaacgaacctcgaaagtggaacagggaggccgcctcccatggctgcctggatggcaggcacagtgggagagtaatgctctgaacctcccaatgtgatgaagccgaaagccgaggcggggccagcaggcctcccgggcacagagccacagagcccagcgtcacacgcaccgtgcacgcaagacagacgtgcacgagactgacgcacacacggccggaggtgcatgtcacagtcgactagacgggccgtggctccctgaggctggctgtggtgtggctagggcacagcccacacttcctgatccttcagctgatccccagatccccacaaacaaggagcaaaaagcacagaatcaaatgacgacacgttccacagggccaggtgggctttctgcggagggcgtggcggtggtggcagcggttctgggagagggaaaccccagcgccacttgtctatgggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtgcacatctgcactgcaaagagtgtgctcatgtgtggggagcatgagctccagggacacagatctgtcccagtgctgggacactcagcaggcgtgggcacctcctccccacatgcacacctccctcataccatgtgtgtgcacctcctgccatgtgtgtccactacctccatgtgtgtgcacctcctcctacgtgcctaccacctccatgtgtgcatctcctcccacgtgtgtgcacctccttccacgtgtacctcctcccatgtgtgtgcacccctccgtgtgtacacctcccacgtgtgcacctgtgtgtgcacctctgtgtgcctcctgtgtgcacctcctcccatgtgtgtgcaccacctcccacgtgtgtgcacccctctcgcatgtgtgcacctcctctgtgtgtacctcctgccacgtgtgtgcacacctcctcccacgtgtgtgcacctcctcccacgtgtgtgcaccacctcctcccatgtgtgtgcacctcctgctgtgtgcgcctcctccatgtgtgccttctcccacatgtgcgcacctcctcccacgtgtgcaccttctgccatgtatgtgcacctcctccgtctgtgccttctcccacatgtgtgcacctcctgccatgtgtgtgcgcctcctccgtgtgtgtgcctcctcccacgtgtgcaccacctcctcccacgtgttcacctcctccgtgtgtgcacctcctgccatgtgtgtgcacctccacccatgtgtgtgcacctcctgccatgtgtgtgcatcttgtaccatgtgtgcctcgtgtgcgccttctactacaacaaacagcatcatgcttcgcgcattttcaacctgctggcttttggccatgaggttgatggacctgctgatatcaacgaggcaacatatttggaaggcaaatggggctgtctccccagaagggtgtcgagagggatctgatatgatgatgtcagaggtgaagtcacagcactcaggaggtgttgcaggctcagtcccctgagcaactcggtccaagtccgggccacagggacctgtcactctcctggagcctcaccactgcccttcccagaccagacccgcatggtggaaggaaggaggggttaagaaggaaggaagggaaggagggagaagaagggtggaggaggagagagggaggatcgaagggagggaggaccaaagagaggagtgagcaggaggatggaagtgaggaggaggctgtacagctacacagggctctagggcttacccgcccctgaatgagcccgtgtgggggcttctgccatggtggacctgggtacccactggatggagagagtgacacagacacatctgctcactccaggctaagagccagcctagcactttacatagtttaagtcaatcttccagcaactcatgagggtcttacaaccctctgttccatggagtgagggggagtggagcttagctaagcgccacctagcctgcagctggtgactaagctgaacgtactcaacctcgccacacctgcctcatgagacaagagtgggtttcgtccagagctggccctgctcccgggcaccatgggtggcctggagagatgccagagggtgtgccactgaaccaaggcagaacaagacctgggcctagagactgccagagcacgtgacaccagtatagcagagaggctgggaggaagcaggtcagggaggcagcccggacgctggctgggggcctggagagcaaaggcagcacctgctctgaaggagggaccagcagcgccgggccacgtccactgactaccgccaggtgccagcccggtgcaagtgggactctcctcccaggcggacacctgagcacgggcggccccacccgggagctccctgcagccccacccccactgcaatctcccgcccactacactggccgtccagggcaggcacgggagtggcactcactggcttccatatttcgtcttcttgaacttgtccctcttatactgggcgtgctcctgctccaaagccccaaccccagcgatgacttgctttagcgtcttgtaggtctcctgggggtcgtcaatgacgaacgtcgaatactcctcctgctccgggccgtcatacacagatttgctcccacaggcctctgtggagggcggaggggtcagcgcagggcaggagcccaggccaccggccccgtctccacacagctgcgtcgctgcaggccccacccacagtacacatccttccaacgcaagctcctccagaaagggctgaccaccactcgtaaacgcagacggagatagaaaccattcccgcaggtaggcgagttgtgcccacactgagcccagggaaagcccattgggagctggatgctgagcaacctcattcacctctgagggctctgctgcccctagctcccagccttgtcaccaatcagccattctcacagggggatgtgcacatctctgcacgccccaccagcccgcccagccagaaccaggaggagagacacctgcagctggacgctgggctggctcatgggccctggggcagccctgaagagtcagctgagggagtgagcacgatggggttcagcacatttcacacccagctgccactgagcatgtccagccaggacaggcctagcccagggctggccgagcacagggcggacaccagtctgtgccgcagcttctaaagaccactgccccggaccccacctacgcaccggggccaccttcctaatcggaccacatcactcctgctgaaggccattctggtgcctcgcccctagcggacagccatggaacccttgagccagggcagggccctgtgccacctgagtccaaacacctgaaccaggtacacgtctctgcctcactgctcacagcgcctgggcacgcactcccggagccagcaccgatgccctgcagctgtgtccatctggatggaatgaatgtttgtgcccccaaatctgtgggttgaaatcctaactctcaagggatggcatcaggagatgaggcctttgggaggtgacaaggcgtgagggtggaacccttgtgcaggggatgggcgtccctatagaagacaccaaggaagctggcttgcctcttccacatgtgaggacacaatgagacactggcgggctgcagcccagaagaggacccgcagttaaaccagcactgctacgcccggatctcaagcttctcaggccttcaatctgggaagtgaattcctgctgtctgtaaccacccagcctatggtacaatttttacggcagcccaaactcaccaagaacttggtactgagaagtggctgctgctgtaccttcaaatgtggactggctttggaactgggtgctgggcgaaggctgaaggggtttgggggtgcagagcggaaaaggcatggctgccatgaatgtccttaaaggacaatgctgggggctcgggagaggagagctgcagagaagtcctgtcttaggggatatctaagtaaccctgaacagaatggtggcatgagcatgggtggcaaggctgttctaacaacatctcagacagaaaggacggccatgctactggaccgtggagaaaaagccatcctcgtgacaaagtggacctgtgttcatgccctcgtgttctgggagggtggaactcgcgagtgatgacatcagacacgtaattgaggagatttctaagcaaaatgctgtgggagcggcttggttcctcctgaccgctgacagcaaaatgtggggagagagatgatttgaaggtggaattgttgagcaaaaaggaaccagaactcaaaggctggttgagttaaaagatttgagaattaaaattccagcctacccatatctcaaaaaaaatgagacagcatgtttggaagagaccattaagcaggtggctgtgtggctatctgataaggagacaagtgtggggctgagccttggacttgaccaaccatctcagcaacagccgggagcagagaaggaaccgcaccagcagaggcactgccagaagaaaccaggaaacagagaaaacaggatgaaatgaaggcaggctgcggtgtcttaagccctacaagccaggccatagagctattcagctgtgaacatgtgccattcttcaagacgagggaagaaggaccctgaagcgggtagggccatcagaatgccactctcacccagaatgagtccatggaccatgtatcagatgcaaaattctcagctggaatattgattaaaaaataaaactggcaataactagaaaaaaaatcgcaataaggaatctgtccacccagccatcactcacccatccgtccatccacccatctgtccatctacccattactcacccatccatccctccacccatcactcacccatccatccatccacccatgactcacccatctgtcgatccacccatcatcactcactcctcggtccatccacccatcactcacccctcagtccatccatcactcacccatctgtccatccatcactcacccatctgtccatccatccattactcacccatctgtccatccacccatcactcatccctcggtccatccacccatcactcaccctatccatccacccatcactcacccatccgtccacctacccatcactcacccatccgtccacccattcatcactcacccatctgtcaatccacccatcactcacccctttgtccatgaactcaacactcatccatctgtccatccacccatcactcacccatccgtccatccacccatcactcacccatccgtccatccacccattactcacccatccatccatccacccatcactcacccacccatccatccatccacccatcactcaccctttggtccatgaacctaacactcacccatctgtccatccacctatcactcacccatccatccatccaccatcactcacccatccttccatccacccatcactcatccatctgtctatccacccatcactcaccctgtccatccatccatcactcacccatctgtccatccacccattactcacccatccatccatccacccatcactgacccacccatccatccatccacccatcactcaccctttggtccatgaacctaacactcacccatctgcccatccacccatcactcaaccatctgttaatccacccatcactcgtccattgctccatccacccatcagtcacccattggtccatctgcccatcactcacccatctgtccatccacccatcactcgcccatctgtccatccacccatcactcaccctgtccgtacacccatcactcaccctgtccgtacacccatcactcacccatcggcccatccacccatcactcacccatctgtcagtccacccatcactcacccatctgtccatcaccatcactcacccatctgtcagtccaccgatcactcacccatctgtccatcaccatcactcacccatctgtccatccacccatcactcaaccctcggtccatcctctcatcactcaccctgtcctccacccatcactcacccatctgttcatccacccatctacccatccatccatccacccatctctcacccatctgtccatccacccatcactcacccatccgtccatccacccattactcacccatctgttcatccacccatcactcacccatccttccatccacccatctctcaccatctgtccatccacccatcactcacccatccgtccatccatcactcacccatccttccatccacccatctctcacccatccgtccatccacccgtcactcacccatctgtccatccaccatcactcacccatgcttccatccacccatcactcacccatccgtccatccaccatcactcacccatccttccatccacccatcactcatccatctatccacccatcactcaccccagtccatcctctcatcactcaccctgtccatccatccatcactcacccatctgtccatccacccatctacccatccatccatccatccacccgtcactcacccatccttccatccacccatctctcacccaaccgtccatccacccatctacccacccactcagctgcctgccccgccatctgtccagcacacccatccaggtgctaggcacttcctctgtgccaggcccaggaaggtcactgcatatggaagctgaggagatgggagatggttgtgactttggtgacacaggtgagcccaggtgatgtggtttggatttgtgtccccacccaaatctcaggtcagactgtaatccctagtgttggaggaggggcctggaggaaggagaggggatcatggggacagacttccccattgctgttctcgtgatagtgagttctcacgaggtctggttgtttggacgtgtgtggcatctacccccatctctctctcttgctcctgcatgtaggaggtgcctccttccttcctctttgccctcccaccatgatcgaaagtttcctgaggcctccccaaccatgcttcctgtacagcctgcagaactgtgagtcaatcaatcttcttttctttatagcaacatgagaactaatacaccaggctatggggatggtgaggttgggaagcgcctggaggaagacacttccaaggtaaacagggtctgccagcctgatgcgcaagggtgttcccagcagaggaagagctggagctgtgatgcggggcgcacggcctaggaggagctgagcaaggttggacagtggtgcagggagcaagctgatcatggagggcctggtcagcatctttcagaacctgggtcttgtgtgtgatgacctcaccctctccgaggctccctgactctggcctctgctgtgtcggttcctgctatgagagggctgggaagaggctggctgatgccagacccactgtcttggccaccctgaggccttgtgccatcttcacagtatccagggacctcagacccagggacagcacctcgcacacttgctgggggagaagacgctgtggtgggtggtggcccatgagtgtgtacatgtgtggttgtctgcacatgtgtgtgcatgcctgcacatgggcctgcacatgtgagcgtgttgtgttcaactgcacatgtgtgcaggtattgttgccttgcctgtctgcacacacatgtacctgtatgttcatttcacacatgtattgctgggaacatgtgtgtacatggctatgcatacatgtgtatgtgcctgtgtgttagtgtaggcctggaacccacgtacacccagggcatgtggggctggagaacaggcgtggccaagctcacagatgggcagctgcacggacacccagggcatgtggggctggagatcaggcgtggccaagctcacagatgggcagctgtgcggacacccagggcatgtggggctggagaacaggcgtggccaagctcacagatgggcagctgcacggacacccagggcatgtggggctggagatcaggcgtggccaagctcacagatgggcagctgtgcggacacccagggcatgcggggctggagaacaggcgtggccaagctcacagatgggcagctgcgcggacacccagggcgtgtggggctggagaacaggcgtggccaagctcacagatgggcagctgcatggacactcaggcaggactcatgtgtttccaggccaaggcacacttgacacttctgggttaaatcaggggaatgaaaagaagaaaatctaacaggcataactccaggcacattccgctctatttccattctgagtgggactcaagggccctgtcatatgatctccaagagcagatccgagttctaccagacactggcatagaaacaaacgcagctgcttcacccccgtgggcttttcttgtctctgcctctcctgaatcacagacctcaaaccactgtccccatgtggtctaactgggcttatctggattgctatttcaattctgtaaagcaattcaatgtcacagataatgatacatactgcatatagatttgaaacacacggtgtgcctggcactgtttcaaatatatatgcagtatcgttatctgtgacattgaattgctttacagaattagatggcatgtgtgtacccacatatatgcatgctgacacatgtgcccaaagacatacatgcatactcacacgtgccctcatgtttccacacatgcacaaattcatgcatgctcacgtgtccccacacacacatgctcacacatgtacccacacattcactctcatacatgtcatgtccatacattcacacacactcacacacgtccattcatgcactcacacgtgtccacacattcacacatgctcacacatgtccacattcacacatccacactcatacatgtcatgtccacacattcacacacgctcacacatgtccacattcacacgctcacacatgcctacacatatgcacacatctcatacgtgtgtccgcacacatgcaagcacactcacatacgtgtccacacacatgcacttatccctctggaaaacaaaggaatgaaaaaataggtcctctaaagaaacttggcagtacagaggttacaagttaaattccatctaaaaattatctatagaacctattatacaggtaattgtcccccagatagctgcctaccctgcaaaaagcttttcgcatccatccgtgctacaaagacaactacatgtagcccacactacaccagaggctcagaccacaggttttcaccccacagcatgctcctgaggccggggcctcgccagccatcccctcgctgcacagatctgtgtgccgggcagactcaccctgcatcttctccagcttgctcatgtacaagttgaagagggagtagatacgctccgtctcacggtccccatcaatgtccagctggatgttggctgggaggccgctgtccagacacagcaagaacagaaagataaaaacacttatttaaacgatgcttttaataatgacattcatttttaaaatgtcactgaagaaagacaacgattgtgttggaagtgaaattcgacaggatcgatttgctgtccgtctgtgcacagccggtgtgttggcttgctgagcaaggctgacagcgtccacagcagcacggacagcagtgtcaccaggctgcaaaccggaactaactagcaacctctgcttcagttaccattggcctatttggacacgtggcaaaagatccttgctgtttagtatttaaaatgtgcttatcatttgtactaactgacctttcctgaaatcacgcagtactgagttatgtcttgtttaaatctattcctactccagaatcttatcaatacataagaaatttaggaagactaggtgctaaaatccccagtgtaatatgtaatacttgtacatttttagtatcatacagaactcaattcccaggaactatgaacactccagacctcatgtggtttattccttcagtcatttcaaacacagaaggaggctgtgtgcttgtttccctgctcattctatgtctgcttctcctatgttcacaccagcacacgtcaggctggagcgcggtggcacgatctcagctcactgaaacctacgctttctgggtttaagcgattctcttgcctcagcctcctgagtagctgggattataggcacacaccaccacgcctggctaatttttgtatttttagtagagatggggtttcaccatgttggccaggctggtcttgaactcctgagctcaggtgatccacccacctcgacctcccaaagtgctaggattacaggcgtgagccactgagcccggcctcatgtctttttataaatcttactttgtgttattatgaaaaacctccatagccgggtgtggtggctcacacctgtagtccccacacttttgggaggccgaggcaggtggatcatctgaagtcaggagttcaagaccatcctggccaacatggtgagaccctgtctctattaaaaatacaaaaattagccaggtgtggtggtgcacacctataatcccagctgcctgggaggctgaggcaggagaatcgcttgaacctggaaggtggaggttgcagtgagccgaaatcacaccactgcacttcagcctgggcaacagagcgagactctgcctaaaaaaaaaaaaaaaaaaaaaaaaagaaaagaaaagaaaatctacattgtacagaagcacgtctttgatggcttcagacaaagtggcctcacggttaatttcacatttgcacgcaggtgcaaccaacagggagggcctgataggaacgcgcggggctgttatttttagcaaaatgctgccttgtgcagaacgtgtgaaatatgctctttaatttagtaaatactttttaaaaggcagaaatgcttattatagctaaaacaattcttaaatcataaaatttctgaaacgtctgtaattttttccatactgattagaaattgtttccaacttatttttgtttgaagtatgacagtttttcccttttcttcccaacttctcttgtaaaaaaagaagtgggtttctgctaatgaactgatcagatgtcaatactgtatatgccttttgagctgagtagctcagtatttggatacttggtcatttgttttattaggtaattgataaaattgtgtcacttattcatgttcaaccatatatttatgctgtctggggatgggtggttatagttctgtgtgagaaataatttgtcagtcttcaacagcttgtaaaaactttgcagtgagagcttaaacatctaaataaataatgaaatgcatttatcataaaaaaaagaagaaagaagatgaagtgaccaacattaaaacacatccctggccagtcagggagttcatgtgggtaatcccagcactctgggaggccgaggcaagaaggatcgcttgagcccaggagtttgagcaacaccaccctgggcaacatggagagaccctcacagtgagacctggcaacatagtgagaccccgtctctacaaaaaaccaaaatttaatgagctgggctggtggcatcagcctgtaatcccagctacttgggagagtgaagtgggaggactgcttgagcccagaagtttgagaccagtctgggcaacgtggtgaaaccccgtttctacaaaaaaccttaaaacaattagcctggaatggtggagcacacctgtagtcccaggtacctgggaggctgaggtgggaggatggcttgagcctaggaggtcgaggctgcagtgagctgagattgcaccactgtactccagcccgggtgacagaacgagatcccatctcaaagacataaaactaaaaaagcatccccgagctgggagaactgaggctggctgtgggtgtgcgggataggggaggctcccgagctgtccggcctcagcggctggagcctcttgggacccacagatctgccaaggcagtgagcaaactcggcagacgtgttctcatggagataaatggcctggaaggaagcctcctgggactgtgttccctgcacggtcggctgcgggtggggacaggccaggttttctctcctcgtcaggctgcaatgcttcccgctgtcctgggatgcgaggacatgggagagcgctggcctctcctgggggattctggggcggtggccacgcatgcctgagcagcagccaggcccccttcctgagcttcagcctctgtgtccacgaagcaggatctaaggtcccacctctgaggctgtgggaggattaaacggtggcccagcatggagcacagctcatcccctgcagggcccttatgcgaaagcatcacgtggccacaacaacagcgaggtgcatctcacggagcataaccagggggaccgccaggcacccaggcctcctccttaggaccggcagatatgacccaagcctctgtgcaactgccagaggcccggctgatggggggccctgctgatggggggcctgacagggggcccagctgacggggggcccagctgacggaggacccagctgatgggggcccggctgatggggggctggctgacggaggacccagctgatggggggcccggctgacgggggcccggctgacgggggcccggctgacggggggcccggctgacggggggtccggctgatgggggtccggctgacggggggcccggctgacggggggcccggctgacggggggcccggctgatggggaggcccggctgatggggaggcccggctgatgggggacccggctgatggggggcccggctaatgggggggcccggctaatggggggcccggctgatgggggacccggctgatggggaggcccggctgatggggaggcccggctgatgggggacccggctgatgggggggcccggctgatgggggggcccggctgatggggggcccggctgatggggggcccggctgatggggacccggctgatggggggccgggaagacaacgggctgctgcgtcatgtggaatcaaggtgggtgtcctgggccagacgaagctttcagggaggggcttgctcccagcctcctcctagagaagcaggatggccacggcctggggagtcccccttcaccctgacctcccgctcccccggggcagggcctcaggaagaccctcgaaggcctgtggcaccctggagtctgcgcagagccttccagaggctgggccccagatgctccctcgagggaggacccctcgggtgggaggctcctgggaggaggcgagggcagccctgtttatgtgcagcttacaggcaggcatgcactgtctgctggtccctccctactcagccccttggccacatttcctgcacagtgcacgagctgggcaccgaggcacagacctacccagtgcagggcgagcagcccggagccgagtcggatggcgccctacagcacagccagtggccgctcaggtaggcggacgggtggtagacggtgaggcgcttctggttgcactggctcactttggtgagaatgtcgatccagtccttggcctccacgcagttgttggcctggatgtacagcgcacgctctggctggatgacctggaacatctgaggacacaggtgggctcaggacagcgcacatgaggtctcgtggctgagcacgtgcaagagtccaccaggcacctggccgtcctcgccggagtcgtaagaggggacgctgagggtgcacaggcccaaaagtcctggagctctaagccccagaagaggccaaggccagggggtgcatggagctctctgccaccctaaaacctgacagctggggccgtggggaatggaggtgagaactggtgcagctggagatgtggccaggtggccaggaacagcttggccaaggccctttatgtcctggagccttggaggtctccattcaagacaaaagaggggccctgtggcctccccacaaggccctcctgcagctgactgcaggcatcccatccacgtggtgctcgtgctgtgtcagcccaggtggcccggcctgctcagctccttccccaactgaccagcccaggattcttcctcctcctcccagctggggttagggggctgcttcctcttgaagcgtctcggggcagcaacaacctttaccatttattactcattcaacaaacatgactgagcaccagcactctcctatgtcccggagacaaagcctggcatagagtttctactgaacctgcagccaccaagaaagactaaacgagggcaggtgtcagcagaagctggaagtgagcagtcctggtgctgtagtcggcgttgactcaaagttagttaagcagggggtgggggcaaagggtgtcaaaggcagaagaaatgggaggcacaaaggtcctggggcaggtgggacaggggtcctgtgattggagggacaggtctcccggggcaggagtgacagaagccttaggattagagggacgggggtgctggggcaggggggacagatatcctaggattggaggtcagaagctcccagaaggagccggctctgttgcacacagaagacaggttttctgagtaggagactgactggaggttgggagggctctcatgtgggacttgcccttaagtcaggagtcagggggacagtggccttctctaggggacgggccttctgcactcatctggggaggatttgggctccaggtttctggtgaacagctgaggtcttatttacagaggccaggagcctcccgccttgcacccggcacatgtgtataggtctcggactggacgcccccgtgcatggctgtgatcccccatggagggcgtcctggccatcatcccaggctcggccctgccaccaggagcagccttcagaaaggtctccccagctggtgagagcctggcctggcagtggcctcaggggaatcgggctctgaggaagtcagtgggaatgaacagctgggaacaggcggctgaaactagggaattattgggaatctatgtgaagggctggaggtgcttccaggacatgtccacactgcttccttcgagggacggtctcagggccaggttccggccatccccctcagtcagcaggcattgagcccacaccctcctcttcccatctccccctcttcccaacccttctcttcccagccctcctcttcccagccctcctcttcccatgccctcctcttcaaattactctccaaacttatgccttttgcaggatctgtctggactgcctgtgaataacatgctagtaaaattctgccaatggtaaggaacatgcgtcaactttggcacgaggcccagggactgtgccttccctgcaactgttctatgaccctcatgctgcagtcggggcacagaaggcttgtcccagccagcatgtgtcagggtacggggtcagcctcaggatggcacggacggcggggtcactggctgaaggggcactgagtcaccagggagaacgtggccagcggccgactctgggaggccaccacacaatggtgacgccacggacacctctaggggattcccgccagaaatgcatcatcagaacctgccacgtcggcacatccgacaaacccacagggagggatgtccagaaaaccgaaggcctgcacgcctcaaagatgccaaggccaccacacacaaagaaaggctgggagtgtccagtgggccagacggagggggcagcagaatgcagcgcagactggatccagaggggaaggaaccacagccggaagaacgggactggacagcggcaaactcgaatgtggtcgcgccggcgacgtgcgatggtggctgctgtggttttggggactgcacggtgggaaacacacttggaagtgttgatacattcagaaaagcacgggcgggaccgtgaagggagaaggaacaagtgtgactggggaacgaggcgacatgtgggtccgggtcaagcgtgaccggggaacgaggccacacgtgggcccgggtcaagcgtgaccggggaacgaggccacacacgggtctgggtcaagggtgtgtggaaagtacttgttctactcgtgcaacttctataaattcaaaattatatcaaaataaaaaagcttccaaaaggaattccagacggtcccaagcctgcttctgggatgtctttgacagagggccccttgacattggggaccctgcgggggacgccacctgaagcagctcaggccccaccttccggcaggttccaccccaccccggtgaccccgggcacagagagtgtggctgctttgatgcgagattccgacacaaactcaccagcacctggtgaacaacccgagtaacacgaagactctgagaagcctggagtgcagtgggtggggaagggtgagcccagggccaggtacgggaagagagcagagaaaacctggccaggcctcaacccgaaagagaggcttgggggccccacactcacgtttttcattttgaaagactcctcctccagcttctccactgccaggatgttctcgatgggaatgctgtagagaggctggtcccctgcagcagagatggactgtcagtgggtgcgggccccgctgtcccggctggggtccgggtggggctgaggggtctctgccggggggtctcccagggggtctttaccggggggtctctgccagggggtctctaccggggggtctctgccagggggtctctgccagggggtctctaccgggggtctctgctgggggggtctctgccagggggtctctgccaggggtctctaccgggggtctctaccggggggggtctctgccagggggtctctgctggggggtctctgctgggggggggtctctgctgggggggtctctgtcaggggatctctaccggggggtctctgctggagggtctctgctagagggtctctgctggggggttctctgctgggggggggtctctgccaggagggtctctgctgggcggtctctgttggggtggtctctgccaggagggtctctgctggggggggtctctgttgggggtgtctctgctgggggtctctgccagctgggggtctctgctggggtgccctgggccggaggaggtgccccatgttcatctccttggggatgatggctgaatcactgacaggctgcaggtgcgggggctgaggaagcctgggacccacctggccctgccatgcacccaggctgggcccaatgctcgcatcctcacagctgccgtggcctcaggctctgtccccagaacatgttcccgttctgggacatgaacatgggagaaactgctagatatttcctaatctagatctgagccagcagatctgacagcgaggggcaggaggtggtgggaagccccgtctacctcggcggagcggcaccctggccatgacgaggcgaccagaggaggaagggacgtggacagaaaagcaccttactgatgtggtcagctctgcgtttactggttctctggggaagcagatttccctcactttccagcagcaggtctgaaagaccccttcagggatctttgaagggagaaccagaagcagagggctctgggtcaccgcggccccgggctctgcccgcagcactgaatccttcctcccctcagctctccccctgaaaaagcagactcagtcccagggcccagcacgctccagcaagagccagggaaagcgaccttgctccttacctttgcttttgtggtaggtaaattcatggttggtcaagcgaaaccatctcttcttaaaattcttcatcccaaagcgcttccgtccttgggccctcttgatcatgaacctgtgtgaagagcacacagggccggggtccgggcctcagctgcctccctgcacaggtgaaaaaccacaccccccactttctgcgttctgagacctgaggcaggcagtggattttcaatatcttatcattttactccgagtgatgagattaaaattggaaggcaatgcctctcctttgaaaagttgagcgctgactgctttgagtcaccagttggtgatggcaccaggttttaggagatctccaaccctcctgcctcccacactgaactttcaacagtggtgctgccactggaaatgccaatgcgatgctcccacggcggacctgcggccgtgggctcagggtcagggagggcagcggacgcccacacaacacggaggacctgcggccgcggacctgggatcagggtgggcagtggacgcccacacaacatggaggacccgcggccgcgggctcggggtcagggcgggcagtggacgctcacacacagaggacctacggccgcgggctcggggtcagggtgggcagtggacactcacgcaacatggaggacctacaggcgcgggctcggggtcagggcaggcagtggacgctcacacacagaggacctacagccgcgggctcagggtcagggcggacagtggatgcccacacaacacagaggacctacggccacaggctcggggtcagggcgggcagtggatgcccacacaacacggaggacctgcggccgtgggctcggggtcagggcaggcagcggacgctcacacacggaggacctgcggccgcgggctcggggtcagagcgggcagcagacgcccatactcagaggacctgcagccacaggcttggggccggggcaggcagcagacgcccacaaaacccacacctgtgttgtgcgggagtcacgcaccagcgcctctgccagaccaaacctgccccctcagggccagccctgctgtggtagaaggcgccactgggccacgtcctcaggaaacgtggggagcaggagacaggatggccaccgaggatgcaaggcctcagcgaggaggacctcaagccttgccctgggcagggtcctcgaacaccctcccggcagcccagggccctctgaggctcggccttcattgccgggcaggggtccctgaccagaaccggcggccgagctggaggagaagaaagtggccagacagagtgactggaggacagaggtggaagctgaggacgagaagccaagctggagagacagagtggggaggtgggcgggggagacgcacctcgacaagcgcactcagaaatcggaaagaggggctttgagcagcaacacagccagatgtggccagagagctgtggacgcacaccggagggtgtggaagctgctgggagctgttcaagagagaaaagggcggggcgctgggagccgccaggacagcgcagttcacaaccagtggatgccgaacgccgttcattccagggattcacaggcaggaagtcagcccaggaggctgttgaggaccagcaggacccagtgggatgcgcagggcggggcctacacagacgggggttggggggggactgggagctccacgacatgccggcctccttgagggcaacagggcgcctctgagaagactctggaccatgtagcagttagatttgagtagcagtcttgttataaatgttttcggctttaggatttttttaagaaccccaactttctgagggccttcagtggatgaggctgcatgtgaattttatgtgcagtttccaggttaaggcagcactgagtggagagaagccagtggctcctcactgcacagctctggtctgggcgcctggctctccaggagtcggttttctaaccgggcccatcgcgcgtgtgggacggggaggcaggagccacggctaagccggaagcctcaggctgaaagcagctcggccccgcgcagccacggccaactcaactcagcaaacacacgctgcgctgcagaggccccgtccccagtcctgtgtcccagtgggtgaggacacacacagccctgagagacggcagaggtgtgggagcatctcagcacagggtgagccctcaggaaacatggtcatcaccacccccacacatggacgaacatggcaagacacacttggcaccaagggctgagatggcagaaccgaggccctaggacggcccatgcttgcacaaccgagggtggccctaggtttggggatgtgacagagctgaggtgccggaggagaagctgatccaggggctggaaactcgagggcctgatggaccaaaaccttggtgtgagtcgcaggtggtgcagctgctggaaggagctggtggagcctcagctgcatccagggcacctgggaggcgcctgtccttgaacctctggctggtggcacctgggaggcgcctgtccttgaacctgtatctacagcagcttctcggcgtcagacacacaagccctgagtgtcctgtgttgctttagggattacaggatgaatatctgttgctttgaaagctgtgaatttatgaaatgtagaaagtaaaaagtttcctcttcaaagtttcccttcttgttaaagaataaatcataagtgttagaaataatagtttcttttaaagactaacttccttcaagcctccttgctttgtgctaataactctttgttaagctctatcctgtgtagctgttggacgtgcccacaggctcgtaatatattctgtgtccttgtaccttaaccaaggcaattgtgttagacgtactcataggcatgtcccagctcacagcctatgccccttccttatttaaacatattattatttttctacctatttaaaaaagttttaaattattagccaatcaggtcttaatttagattgtgaggtccggctccaggcaatggggacaggacacgacaacaggaacctcgtgcgtaaggaataaatattctggcgtctctttattctgtgtgtgcccttgccattactccttctgccagggacaccctttctgcagaaagtaaaaattgcctcgctgaaagaactttttgtctaaatgctaatttttccttatggcaccgaagaacaaacattttgcatttctaacatgaaatgtgtgtattgcaaatgttattggttaatatatgattaagttaaatgaaggtgattttaagaaaaatagcaatgtaagtaatgccactggggtatggtccaccagtgacccagagatgatccaggtttcagcagatggctctaacagagtatccacaaaaatagacaaatgggacttaattaaactaaacagcttctgcacagcaaaataaataaccaacagagcaaacagacgacctgcagaatgggaggatatttgcaaagcacagatccaacaggggactaacagccacaatttagaaggaactcaaacaacttaacaaaaaaaataaaaattaaaaaaaaatttaaaagtggccaaaggacagggggatagacgtttttcagaagacaaatggccaacaagcatacgatataaagcccagcgtggctcatcacctgaggaatgagagccagagctgcctgtgaccccacctcacgccaggcagaacgaagccacctgcgaccccagctcacgccaggcagaatggagccgcctgaacccagctcacgccgggcagaatggctgggatcaaataaaacacggaaaaatgacagacgctgcagagctgtggaggacgtgagcgcttgcacgctgtggggaatggaaattagcgcttaaggaaacccacggagatttctcaagaagctaaaggcagagctgccattcgatccagcaatcccacaccaggccccacccaaaggaagagcaattaccaaaaagacacctgcatgcgtacgtttaccgctgaaccactcacaacagcaaagacacggaatccacgtgtccaccaacggacgactggataaagaaaacgtggcataaatacaccacgacatgctactccaccatcaagaggaaggaaatcttatgttttccagcaacgtgaacggaactagaggttgttatcttaagggagatgactcagagacgaaaagccaaacgccccatgttctcactggtccataggagataaacacggaggggcggggcgctctgggacacgtattcggaatcacagactgaggcctcggaagggtggaggtgggagcgggagaggaatgagaaattactcagtgggcacaaagtgcccgttcaggtgacggtttcacgagaagccccatccaatacaactgcacttgtgcccgacatgttggcaaacacataaaaaatacaggaacatggtccacaccaggcagagcaaagccccgagcgggagtgggagccgggccacaggacggggttggtggaaacgggcagacgtgtcagttatgtaaggaaggttgatgggctctgatgctccagggacctctgggtggaggttgagggaggacaggcctgtgtcagaaacacggggtggctgtgggacacagacgtccccctccaaggtcaccgagaaggtggcagaggggtcccaggctgaaggcgcaggggccagacccccagggctgtcccctctgactctggttccctgagcaaagagccctcgggagcctggagggaaggccagccccaagtgcgggtgtggacaacacggccagtggtacagaaatcacaaggctgctggccagcaagggaggaggctgcccccgactagggaatcttctggaatgtgctgggtgctctggggactgggggcccccatccctttctcccctccggccctgccggatgccaccttacccttctcccccctcctgccctgccggacaccaccttacccttctcccctcctgccctgccggacgccaccttacccttctcccctcctgccctgccggacaccaccttacccttctcccccctcctgccctgccggacgccaccttacccttctccccactcctgccctgctggatgccaccttacccttctcccctcctgccctgccggacgccaccttacccttctcccctcctgccctgccggacgccaccttacccttctcccccctcctgccctgccggacgccaccttacccttctcccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgccggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggacgccaccttacccttctccccactcctgccctgccggatgccaccttacccttctcccctcctgccctgctggacaccaccttacccttctcccctcctgccctgccggacgccaccttacccttctcccccctcctgccctgccggacgccaccttacccttctccccactcctgccctgctggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctcccctcctgccctgccggacgccaccttacccttctccccactcctgccctgccggatgccaccttacccttctcccctcctgccctgctggacaccaccttacccttctccccactcctgccctgccggacaccaccttacccttctccccactcctgccctgccggatgccaccttacccttctcccctcctgccctgctggacaccaccttacccttctccccactcctgccctgccggacaccaccttacccttctcccctcctgccctgccggacgccaccttacccttctcccctcctgccctgccggacgccaccttacccttctcccccctcctgccctgccgcccccctcctgccctgccggacaccaccttacccttctcccctcctgccctgccggacgccaccttacccttctcccccctcctgccctgccggacgccaccttacccttctcccctcctgccctgctggacgccaccttacccttctcccctcctgccctgccggacaccaccttacccttctcccctcctgccctgctggacaccaccttacccttctcccctcctgccctgccagacgccaccttaccctccttacccttctttaagcacgatgggctgctcaacactcttggggtctcttctccccgaggacgaaatcagatccaagaactaaagttggaagaaatcaggtcaccgggaggaagccacacatctgacgtgcacggctctctgtataacaacagcgtcggcggctactgcctcctttgtaataccagtggagacagaatctgggcaagtgagtccttccccgagggctgtggggcctctgctccccactgtgccaccccagccccggcactgccacagagatctcaggtgagaggccgggctcaggcaacacctggggatcaacctgcatctccagaggccacccaggggtgactctaagcagggaatctgggtcccggtagtgaggaggctcaggcatccctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctggggcctggaggttgcccccacgcaccgcgttcctgactgtggggaggagcagagccctggggcctggatattccccccacgcaccgcgttcctgaccgtggggaggagcagagccctgcggtctggatgttccccacacaccgcgttcctgaccgtggggaggagcagagccctgcggtctggacgttccccacgcaccgcgttcctgactgtggggaggagcagagccctgcggtctggacgttccccacgcaccgcgttcctgactgtggggaggagcagagccctggggcctggaggttgcccccacgcaccgcgttcctgactgtggggaggagcagagccctggggcctggatattccccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgcggtctggacgttccccacgcaccgcgttcctgactgtggggaggagcagagccctgtggtctggatgttccccacgcactgcgttcctgactgtggggaggagcagagccctgcggtctggatgttccccacgcaccgcgttcctaactgtggggaggagcagagccctgcggtctggatgttccccacgcaccgcgttcctgacactgagtctgcagccccagggctccacgactgcagcctagagtgagtccggccaccacacacactgaggtgggacgcgccctcattcggggggctcagacacagaacaagatgggcgagggccccgttttggccccaaaggcagtcacgccaaagagtttaccaactgtgggaggaggtgtcccaggacttgggacaaggctgtctggacagcgctgtgaatgcaccgaacgcctttattgtttaaaatcgctaatggccaagtctgtgtcatgtgggttctatctcaattttaaaagagaactccgtctcctgagcacggcacacgggcggtcggagggtgagtcgatacttacgttcttcaccgcatcagcatatttctgctcattgaagaattcataaaatgtagccatgtaggactccttaaaactcgcctaaaatgaaacggagatcactcgaggacagcccgaagtacctcggctcacggcccaaatctgaaaaagctagaggcaagaactgtccaagcctaaatgacgataaacaggcaaagaacccggtgttaccgggcaagtgagagcccgcagggctgcccggaggacgaatcacataaatcgctcaggcgccaacgaagaccatcagacctgccagtgcccgtgaggtctccaagcaccctttggcatcagtgactccgtcctggccccgggctgtccctcacacctgggtcccaggctcatgaagaggtacgttggggcccagatgtggctgcctgggaacctggagtcataggccagggtcccagagcccccacgcccatctctcgcccgtggggcataagggccgctctgaggtgggaagagggggcagggacctccatcacacggggaagtggaggcacccagggattcgggggggcctttgcagccaccattcctgaggctcgaccccaagttcctgttgtttccacactgaggtcactgcacagttccctggctgtgaaatgaggtgggtttggtgcagacctcggaggaggctcaagtgcctgttatggagtttccagcccacagcgcagggcctggctggtgggaaagagcggtcggtgcacctcggcctgcctgcgagtgtggcacatcttttactcactcggactcagagaaacccaacgtttgccccaagcgggctgctcctccagtgggggcctctgctccccaaagccctcatttctacctgggccccaccaagaacagggaaccaggaggcctgggcatctgtgcaccacagcccagccctctccagacggagccccgagggggcccgaaggcatcgaactgccctggcctggcccctgcagagacagccttgggcctcaccaggagcactgcccccgggacgcctcaaacgtcagctctgaccccctcaaacacacaaggtgctcttagggggaaatggggcagatgcctgagggactcctgacctggtggcaccagatccagtctgaagggacgaggatggaggacggaggttcatatccacagggagagaggggccctgggaggagggggccgcgtggggaggggagcgccacgttgggaggaggcggccgcttggggaggaagcgccacgtggggaggaggcggctgcgtggggagggaagtggggaggagggggctgcatggggaggtagtgcagcatggggaggagggggccatgtgaggaggagggggccgcgtggggaggtggggaggagggggccgcgtggggaggagggggccgcgaggggagtagggggctgcgtgacgaggagcctccagcaccgcaacgcccaggaggcgccaggttaggccatctgcctggcctgttcagccgcttcccacacctgacaggtcagatgctgctcctgccacggggccggcgacgagccacaggctcccgaaaaaggcaaggggttcactttaggaggggagaggtgagcgggacggggacgctcaggtcctgggtttcaagagaggatgtggtgccggctttgattcttgatctttatcttacgactctctcaaatgtgggaggtttttcacgtgtattttctgaagagagaaaagaatcagttgtccctaaaaagagaaaatgaagaagagggactcacagatttggacttggacaggctgccgagggtctgaacggtcttggagatcaatgtcagcgtcctggacgtctgggggtcctggggaggcgggagcaagaaaggtctatgtcagcatcacagaaatgctgtgactgtcccagatcgaggggacgaaatgcaggagtcacctcagagctgctgtggcttgtgcatgagctacggagaaacaggggtagcgacgcagatgggactggagggggtgggcgtcccacagtctcaggagctgctgagaccatcccgcaggcaacatccgacggcaccgcggtgacccactctctcggcccagcgtgcagggtgcatctcaaagtcgaaagcatcaggtggggtcatggctctggggcgctgagtctcggggtgctgagtctcctggccctgcctggggctcatctcagccttcacagggtttgaaggttcaactcagaagtgctgggggccgggcttggtggctcacgcctgtaatcccagcacttcgggaggccgaggcaggtagatcacttgaggtcaggagttcgagaccagcctggccaacatggtaaaaccccatctctaataaaaatacaaaattagctgggcgtggtggcgcacgtctgtaatccaagctactagggaggctgacgcacgagaattgcttgaacccaggaggcagaggttgcagtgagctgagatggtaccactgcacgccagcctggtgacagagcaagactctgtctcaaaaaaaaagaagtgctggggaatgggcaatccctcacgtcctctcgccctggccatctccttccagctctgccacccgcacgtgcaacacggtcaccccagatccctgtaccctgagagctgcggccccagcaaccacattggggcctggagaaaatcagtgctaaataggaatctgttgactcaatacacggatgatacgccgatcatcaatactccatatgtgatgggcaggggaggagagcagggcggtgaccagcagctaaaaccctggacaaaccgtccactgcttttgtgacactgtctcgactcccccagaacgtacacagcttaaataggtcggtgaaccacctgcaacgaggacgttccaggacccagcgcatccaccagcactccccacgcaccgtccacacactccacacacactccacacgcactccccattccacacaccttccacactccccgtgcaccgtccacacactccacacacactccccattccacacgtcttccacactccccactccccatgcaccgtccacacacactccccattccaaacgcactccccactcactcattacacacactccccacgcattccacacacactcctcattccatgcacactccccatgcattccacacacactccccattccacacacactcctcattccacgcacactccccactcactcctcattccacacacactccccattccacacgccttccacactccccacacactgtccacgcactccacacactcctcattccacacacactccccattccacacacactccccactcactcattccacacacactccccattccacatgccttccacactccccacgcagtccacgcactccacacactcctcattccacaaacactccccattccacacacactccccactcactcctcattccacacacactccccattccacatgccttccacactccccacgcagtccacgcactccacacactcctcattccacaaacactccccattccacacacactccccactcactcctcattccacacacactccccactcactcctgattcctcacacactccccacgcattccacactccacacggtcggccccctacagccacgcagatgccccaacccaggccggcgtcgcaggacagctcagaaagcctcggtccctcagccggtcactcaccgtgtggtgcggcgtgagctggaagaggttgggggagagaatggcgggcgcaaagaacctcaggaagatgaagctgctcactgcagtgtacctgacgtccgggtcatctgcgggagagagaagcagggtgaccgttttcctcgggcacaatggcctcgtggggacaccatgccccggccccctgagggtccgcagggaagtccagccacagtcctggctctatctccacctgtgtctgtctctctccctctctctgtttccctctctccctctctctgtttccctctctctctccatctctctgtctctccccctttgtctctctccctgtctctctccgtatctctgtctctctctctctccctctatttgtctctctctcatctctctgtctctctccctctctttgtccctctgtctctctccctatctctgtctctctctctctctctccgtctctggctctctccccccctccatctgtctctctctctctccatctctttgtctctctccctctttgtccctctccctgtctctctccctatctctgtctctctctctctctccccctctctctctccgtccgtctgtctctggctctctctctctctctccatctctctgtctctctccctctctgtctctctccctaactccatctctctctccccgtctctttctctccgtctgtctctctctccatctctctgtctctctccctgtctctctccctatctctgtctctctctttttctctctttctctgtctctctctctccgtctctctctccctgtctctatctctctgtctctctctctctctctccgtctcgatctctctctccatctctctccgtctgtctctgtctctctccatctctctctctccgtctctatctctctctccgtctgtctctgcctctctctccgtctgtctctgcctctctctccgtctctccctgtctctctctctctctccttgtctctctctgtctctctccttctgtctctgcctctctctccatctctccctgtttctctccatctctcatcaccaccacacagcgcagcccctttggtgtctcattccacagtggtctgtgctcatctgggtgagaggatgtgttttatctcttcacttccaccttgttcaaagtgggtctggggctgggatgtgcttgggaactgcctcccccagaaccctgggcccctcggccggcgctgtctgactgtctgatgtcctgagaatcaggggtggggacagcgtttgtctcctggggacacagaagcgtggacggctctgcaggaccatggccaccccggggtgtctgcagctgtcccgaggccacaggacacgcaaggaagagaggagccggcagcaaggccctcgctgagcctctcagcgccccatacatagcctgagtcctggcggggtcttgagtatcgcaggtgatgggtgggtgcaggcacccagctcctccctgagggtcggcaaggttgagaagtggggtttgggtgctggatgcccaggtccctaggggatctccggcttgggggtttgaagaaagggcagctcccccaggggtcctgtctcttcgaagacacgggcaggcagagcccccaacaccactctgggccctgccagggtcggccacaaaaagaaaccactgggaaaacccaggggtccacatcaggaaaattcacattccaccccgacaaagcctggccacccttcccggcccccccagagaccactgtggtcgtgaactccagggctgggcccctctagagaccactgcggtggtgatctccagggctggggtcccctggagactactgtggaggtgaactccagggctggggtcccccagagaccactgcggttgtgaactagggaacactggcccgggcacaaaccccggaaaaatccagcatcggaactggggttcacgaccccgcagttctagtctagccagggctgcggggggttctgcctgggtgggagtcaccctgcacagcgctatggcagtttctcagcaacatgagggtgttcagggcactcaccctggaagcgcttggccgccgcctcccggagggagaagaagatgtcacacatgacggtcgggcagctcaccccagactcagtgatggcgtggaagacgcggtccacatactgccgtaggttctcctgcaacgggacacggcactgggacccactcccgaggctgcccacaggtgcgtgtagcaccagggcacgcccagggaggggcgcgtggggaggggctgagggcgggcgcagggcagctgcggcagtgagacacgtgtgaacagccactccctggaaatctgtgctgggagctgtggcaattcacgcgtgaaaatcactacacaggcaccacgtcggctccccggctcggccccgacctcgtttactgagtggggaatggacgttcactagaatgtgcctgcccaaggcaaagagctctgtcatttacatacagaaatgacgaaacagcacgctctgcaagaagtatcatgtgaagtgactaaaatgttggagcaagttcaacatcagggagttttgctgttttaaaacgcagtacacagctctggggacagcctggggaggcagggaggccatcctgtcctaggaaaagggaggggcaggagccattgcccaagggaaggaggagccggggcggaggcagagctggtcaggattgtccaggggaggcagagcagggtgtgcagggcagaccctccgggggggcagagctggggcatgcagaccggatcactccaggggaggaagagctggccgggaccccccaggggacgcagagcccggcacacaggccaggccaaaggtggtggctgaggcctcccagtagtgcagccagcgtactgcagccgggtgaggcgggtatccccacgcctggtcctgctcccaccccaaccggggtcacggggtgagtcagagcttccaggcagccatcggctgaaaaaccccaagcaggtgactggctttggttggttcatgaacaaaacctaccatgttgttttcaaggttttctccgtctttcaacttcacagggtcgatttcacagggtttgtggctctggcatatctggggagaggtttaagacagggctctgtgagtgggttctgggggcacaggcagggagggtggaaggggtctcaggcctggctgagatgtagaccctgagcctcatccagaaaatgccacgacagctccccgaacccggccactggcacggaggggcacggtgaggccggactgcagggccaccgtggggtggtgtcgtcccgagcctcagctgcaagggggcaaccctgggcctgtgtcactggctgcggagggacaagtgagaggtcaggcgcaaacactaggcacggggcccagtccatggccgcgatcagacgagccgggctctctcagggagcgatgtgcgcccgcgatcagacgaatcgggctttctcaggagtgatgtgcaccagcccacacggactaggcctcacagggctttaataatatttttacttcaaaatgctgccatgattttgcccacagagcaaaccagaatgctatgttcaattttctcacatttgcaaagaacctgtttacaaacccgctcataaacggggggcacagcctggcgggcatcagagggtcaggtgaggagtgggtgtgcgggcatcagagggtcgggtgaggactgggcgtgcagctcaaacatgccacgcagccagggcccaaacacaggggactgcaggacatgtggagaaagaaggtctccctgggaagagccaggcttttcttgcatgttctcctttgtggagtggtggattttcttatgtatagttttaatttgggagaatttggaaggttctggagtacacagggaacatcctcttgataaaagtgaatgaatcagcatccccgtggcgaggccagaggggccgacattcaagcccagctcgtggtctggctggatcccagtgcagtgccctctgttgggggaaatcctccccacgcctcgtgaggctgaggactctcggccccgtgctcacctcctcgatggcgggcttcagggtgacatgcaggtaatgcatccccgccagcttcatggtctcgtcgatgcacttggacgccagtgagtttcctcggaagatggtgttggggtccctgggaaatggcgatggggacagcgtttgtctcctggggacgcggaagtgcagacggagcagagcctggccccgagcacctgcctgtgggctgtgaggtcagtgcacgcccatcagtcggcttcctgacattttacaaggagcacaaccaggccaggtgcttggaggccctggccatggaaccgtcctgtgtcaacactgccagagggaaccgttcggctacctgcgtggccaccagctcaggaggagcctggctggccttcgccctcccgccctctcccctctgcggcctctgcctgtgcagagagttgggcaccagaccctggcagcatccaagggccagcagagaagcaaaccctcctgtcagctacagtggctgcaggtgcagccagatgtttctagaacagggcgtccggaaacagcactaggcaggtcctgagggaagctgtgctccatttttgtgggctcccaaagtgccccagggaggggacctgagctgtcctcgagccccaggagccgtttcccctccccactcactcactctacccgggatttcaaaggcaaatgggactttcaaaaaaaaaaaaaagaatcattaactgggtctgtgaaagaaaacctgaatcaacatggtttctggggacccttgaattccctcaagccctgccccaggacacgtggttctcggcgacgaccttgccatccctgtagcgggtccaggccgctctcccccggggcagggtgggcactcactgggtccgcttcacctccgcgctggcgatggcactgatgaatggcaccaccctgccatagtgtaggaagagccgcaccagcgggacggccgcctcctgcttctcccggcaaacctcgcccaggatgtgggccgcagacgctgacacgggctgcggggaggggtgaggtcagtgccagggcccggggtgcaggaaccccagaggcctgtccccaccttggctggggtctcacttccagccacaatagatacggctctttgctgagacagaaacacacacattcacaaaaacaccaaacttcccatttgctgctgcttggctggacccttggaggggcatctgcacctccttctagcgacccccccatgcagccagctctagggcccctgagccggtagagggactctgatgatggggtccccctcgaacaacccggagagtccttagcatcaccaggctcccacggctctaactgtcgacggaccagtgcccccagcaaaggggtccaggcatctggacgggaaacaggccaggctgggaggcgtgggaaaggccccctcagggagaaggtgccctctggggtgggcccgggtgtagggtggggccccaggcaggtggcacctcctgcccacacccacaggccacggcgtggacaagcacctccacatccgcagacttcaacagcaggtcccgcagagggctgtaatagtcagaagaaaacacgtggtcttccgtgtataccacgttcagccgcagggagcccaggtcgtctggctttaggctcttgctaccattgtcccggggctggaggaagtacctgggtgggagggacacatggaggggaggcatgaggctgcatctgccaaggagcagctctcagggaagcccagctgcctgcttgaggtcgactggtcaggagggtgatcctgtaggacccctcagagtgcagcccctggggactccccaccgaagacccccagcagggctggtcaccggggatccccaggaggcaagtgttggagccaaaggcgcaggagtcaaggggggaaacgcggagggggatgggggtggaacgtggcaggaacgggtttccgggaaccggcacagaagtggtcagtgacccgccctaagacccacacccagcagtgtcagcagcaggtggaaatgaaaattatctcaaccaaagtgtgccgtggctcccgatgtcacggggtgggggccttgggctagtgagcctggcaggccacctgggcacctggtcattgtaagagacgttttctgcccggacattcttccatctttggttctaccccacgcagtcacccaggagccctcttctgctctcatttgtgggccaggcagtctaagctctcaggtgggtggagcctgtgtccgaggccccgcccccatcaggtgggtggagcctgtatccaaggcattagcccccgtcaggtgggtggagcctgtctgcagcattagcagcccggtcaggttggtggagcccgtgtccgagacattagcacccctgtcaggtaggtggagcctgtgtccgaggcattagatcccccctcagatggatagagcctgtgcctgaggcattagcccccgccaggtgggtggagcctgtgtctgagacattggcgcccccgtcaggtgggtggagcctgtgtccgaggcattagcccccctcaggtgggtggagcctgtgtccgaggcattagcagccctgtcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcccccgccaggtgggtggagcctgtgtccgaggcattagcagccctgtcaggtgggtggagcctgtgtccgaggcattagcccccctcaggtgggtggagcctgtgtccgaggcattagcccccctcaggtgggtggagcctgtgtccgaggcattagcagccctgtcaggtgggtggagcctgtgtccgaggcattagcccccgccaggtgggtggagcctgtgtccgaggcattagcagccctgtcaggtgggtggagcctgtgtccgaggcattagcaaccccggtcaggtgggtggagcctgtgtctgaggcattagccgccccccatcgccccaggtaggtagagcctgtgtgcgaggcattagcaccctggggctctctggggtatgtggtggctgccttggctaccagggccagggattcattcagcataggaggaagcctaactcagctcagggggcctgtgcccgtgccgtcttcgtagaatcaaaagacacgcgtgtttcacggtttctgggatggaaacctgccctcacacatggcagagggacacatggggtgcgaggccccggcacacagtccacgcctgggagtgcacgcttcccgtgactccgggccctctcaggagctgcctgtcgctaagggacacacatgaactggagataaaatgaaacaatggcctgttccttccaccaaaacaccaagcacctggagacaacaggaaagaaaggcaggaggcagcaacacacaacatgtcctggggtgggttctgggtcagagccgaccactgaggtctagacgtgcagaggggagtagagaaccctgtaatgcgccctcaacaggaggtgctgccgagggcccagaacaagacccggagcgcagccgcggcgcagccctgctgtgtgcgcattctgggctcctgcaccggctgctgatgccctcccctactggtgtcagacctcacgagctgctcgcggctcagggccccgctttcacccaggatcagaccccacgagctgctcacagctcagggtcccactttcgcccaggatcagaccctgcgagctgctcgcggctcagggtcccactttcacccaggatcagaccccgtgagctgctcgtggcttagggccgctttcacccacgttccctgtcttgttttgaggtgccagccattgtgagtccctgctcagtgtgatccctgctgcctctcctcacctgccatttctcacctgctgtggggcagaaactcatcaagccagagctcgtcagagctacatgcaaagtaagagcaggtgggtgctgggcacagccgaggaccagcacatgtggcctctgtgcctttccactcagaggcagcacgtgtttttgtggctctcagagatgcggaagtctgcaggtgcaacatcatcttaccacgcctcgtaggagctggactgccgcaggactttcaacgggatccttagttctcccaggaattcatctccaaacttcaggttactggcattccagaggtcaactctgaaaaacagcatcaggacagctctagctgacggcgggcagcccgtgtggagcaaagatgacaggccacgctttgttcccccaggagcagaatggagcctgcagcgcctcccagagtctccatcaaggctcagcccacagggcacgtttcaaacacgtcagaccagcctgtggctttggaataaagatgagtgtctcccagtggtaatgggcaggcagaggaaggcggaaggccatgggcccggactcagacccaggctcttagataggagggagcctgggcatcgctgcgtgcacccagaagctacatgaccccaggctcttacataggagggagcctgggcgtcgctgcgtgcacccaggagctacatgaccccaggctctgtgccaggagggagccaggcgtcgctctgtgccaggagggagccaggagttgctgtgtgcacccaggagctatgtggctgctgccactctcagctccagcaccatctgtcccctttgcccacaacaggcccagcaccagcagtctgtgcacggcgggcaaatgtagaaccctgtctccatggattgctcatgatctaggggcacaaagtggattcaggggccatgcacaccacagcggggggagaactgtggccacaaaccacagcacggtccacgaatctccgtgactaccgcaggcccagcattgtgaagcttctgctcatgtctaacacagcagcggctcccactaatgttctgtcctagtgtgggatggtacgtgtcccctcagacctggggctgtgaaattctgacagacatacagcatccccggctgcaacaagtctacagggctggtaacccagtccctcatggccaggacccactcataggcctgaaacacctgaagtcatgcgtggccagccctacccacgggcctgaaaccacacagttacacgtggccagccctacccagggggctaaaactcggcaggcctaaccacactgtgggcatcaggggcatccccctggagggagaagattccagaaggctggggattttgttacccttgcgaatcctgcagggaagtggcaccacagaggcactggcatctgggccggggagggctgacaggctgcacaggaacccacagcgcgttcctttcagaaggaacatgaggggaccgctgatctgcccatggacactttaaaaaaatgtgctgagtggccaggcaggcgcatttgcctttaataagggaaatatttaaaacatgttttgtgtgcttttaaaaaatttaataactaggacttcactcctgaattcaaaacttggtgtaaaaagaaaccaacaatggcgcttccttctcttgaaaaaggggctggtgtgagtccctggggaggcagatctgaccgaccacgtcagggacattctatggttcaggaccctgacccctcaggaggtggatctgactgaccacgtcagggacattctatggttcaggatggagacaactatgggggacggatctgaccgataacatcagggacattcctacagttctcaaccacaaaaccacgcctcccagcagccgtagggcctgagccacgcaccggctccacgtgtcccattaagggtccccccagggcagtgttagcccctgggagggagggtgaccagggatttgatggccagcacattctccaaaatgacctaaagaaagcaggtgcatcccaggctcagggacatcccaggctcggggacatcccaggctcggggaacatcccaggctcggggaacatcccaggcttgggggcatcccaggctcagggaacatcccaggctcgggggcatcccaggctcgggggcatcctaggctcggggtctcagggccggctggggagggtcaggagggagccgtttccttccttctctgtccagcatgggaagattcgggggcttcaggggaggctcatctgcctcttcatagggaatggaggcattcgttggtacagaaggaacagaggctacgttcaaaaataaacaggaatccagcttattttcactgggaggagggaacccgccggggtttgtgaagggcacattctgacgcctgccctccccagaactctgagtcagcgggatcgtggggctctctaaatcctgggcctgagatcgcgtcctgacctgcgtgaacccacaagcgatttccccgtttcccgtgggaggcgttgaggagccaggaaagggcggtgggggctccatgggcaaaggctgaagatgcagcttctatgaccatacacaggaaacatgaacccaggacgccaggtgagagtgtttcactcgagtcaaaggggacagggtctccacagaggccacccagccgagagtttcagcagtgccagtgggtcctgctcggtcagggccaggcgtcgtgctgacccgccaggccctgcgacctctgagtgaggcctgaacccatggaaggcggagggcttagaacaagaccttaagaacggctgcagcccccgtcactccaggtggatgaagccttacggccagagggatgcggacctctggctttcgcctcttcgcaggtattgcaaggtgagccctaacaccacccacaggctgtcacttcaactacaacttctaacatcctgttgtgaaaattaccaagaaaatggaaattcatttctatctatgaccctatatttagtaacaaagaacaaaagagctgaggagtttgggtgaaaactgccaagttggggacgcggagcctggttttctcacctgatttcgagcttgtccacgtcttcctcctcaaagtcaaagtgggacttcttgctgtagctacagggccgggtcacctggagtcagacgagagagaaagcgctgagaccgcggtgccaccaggcgggggtatatgcggacctaggccccgggctgccctaccctctgcgcttacccacacaccactcaagggccacaaccaggaaggcgccaggcgggattcgggattcaggcctggcttcctgagtgccagcatttcctactcacggcgcccctggaggggcagacccaggtgagacctgccccaaggctgttcacggccacggccggactctcccagtggctcctgatgggtgccgggctctgggtacctaaatgtccgtcacctgcgcctgctctgggcctgccaccccgtgagggagggagggtcccctctgccgtggagacgaagccagcgccgccctcccgtggccccacctcaaggctctatttgccaacaggaagtgaaacgcgtgaggtctgtggagcctgaacctggccggccccgaacaggccccagcactccagggagggtcagacggtggaaagtcaagacgctgctaccttcctcctgacacctccgcaccgtgggttccttagaacagaaacggagtgaaggcgtgaagggtcgaggctccgggaccgccccccgccagccagcagggcccttgcagcagagcaggaggccgacccacaggctccaggagacagtggttatcacctggagttccgatttaaccaccatcagccgtgcaccaggtcacctgcgtttacaagaagggctccgtcctgcccggcctccctccctgcccccccttctccgggcctcagcagtgatgctggctcaggagctctcagctcgaagttctgatgtaaggcttgacaccaaaatcatgttgctaaaactgcctaacctctgagcttgcacttcctgattggtaaactgaggtgaagatcacgcaggggcagttctctgcttcgggttgagggctgctgacgcctcctccttcctgacctacacaccactgtccaaaaatttgcttccccccaacttccccatctcacaaaactcaggtcaggcaatgcctcctccaggaagcccccagtgcccctgcctcatgccctctctgcagggcaggtcaggcaatgcctcctccaggaagcccccagtgcccctgcctcacgccctctctgcagggcaggtcgggagctattgtaggggcttgtctgtttgcatccctcccatgctggcctggtgtggtggccttggactcctctgttttctgccacatcttatcaccagctgatcaccagcacggtgctggcacctgacacgtgttgagtgaatgaaggcagctcctaccaaatttatgagattatttaatctcatttagagagttaaagggtcttaatgtgtctagttgttatcctggaagaaaatggtacagacgctgcttcccatagaaacggaacatctgttttcctgggtctgctcccagtaggtggctgtctgaccacagcccgcgggggatgtgctccctccccggggctcagcctccagctgggtcagaagcagctgaagccgaaagagacagagtcctggtgaaagaggtctgctaaggaaggggaggagacggagtgaaaggtcacagagcccaaagagcagggccccgcgcgtcccacacagcagcggtcagcgaggtccgggccttccctggagccccacaggtggtgacgcagaccatggttttcagactgtctgtggtcactaaattgctcctgtaggctgagacccacgtctttacagagtgaaacaggagtgcacacagtagaaacagcatgagaacactgcaagcgtgatgagcacccgtgtgtggccgggcagtgggcgagctctaccccactgtgtgtatgacagctctgtgtgtggcagccaagccagcagccgaggcggggggagctgccacctggaactcggtccatgctgcatgcctcctgcacctccaacagggcccaccctccccctgggagcctggcagctccctgccttccctcgctctggcaaaaccatcttctccgcctgtctataagtgaggcttccgtttgagacagagaacagattccacctctaaagccctcctcacagtggccctgaaagcctggccctggctttggacaccaagttcccacctctgcctgtggggccctttcgagcctcagcagtgccagtgggtcctactcagtcaggacccactgaccggtaggtccactctcctacggtcccctgagagctgcatgcatcgagccccactcagccatcatggctcaggggagcccgcccgacccctcagatgtgactggccatgctcttgccacagaggcctcatccatcctcacatctccagggcctgtgcaccggaatgtttgtggatgggaagaacatctgcctaaaggccctgcacacagctgtccccaaaccgcaccggccacatggcaggtcctcactccacgagatgcagccatcccaaacggggtcacattccaccaggtgcacccttgcaccctccttttcatggattttggtgcttcatgttctgagaggatctctgtgtctgaatcctttcccctttgtttcaaaaccctgcctatttccactggaacaagccttccgcctctcagggatgcttgggcagagcagccaaaaaaacaaaaacccccaaggtcctggtaatttggaaagcattaatctgtcatcttttaactcaaatctgggccagttcgggagacaacgaatgacctttctctcttgggagaggagggaaggtcctgtggccacgggtccaatccccagggctggctggctgggctcgctcctctccggaaggaacccagggccggccggcggggctcgctcctctccggaaggaacccagggccggctggcggggctcgctcctctccggaaggaacttccagagggaagagactgagatcattctggatccagactttctgccaacgtgtctcgggtgcagagtttccacttaacgttgacccatgaagataccaacctcaaaataaaacacttcatcgaactggggattgttggtcttcctcttcactttcgtcttctttgcttctgatctgttatcaagtgagaaaggattgggattaaaacaacactgctgattccaagtctctcagtggtaaaaccgagctctcaaatgcacaagtcacttattggctttatttattttataaatatttctgctggtctccaactccagatggtatgcaaatcaggaacctttactcagccaaaaatacccagcgtgaagagcatgaaggcttcattttctacaaagcaattttggagcaataaagaaaacaaaaggaagtaaaaattcacattctacctcaaagcgcaacctcctgactcctcccaaatgaggcagtggtctcgtgatttcagagctggaccctagccccccaggaccagaacagaaacctgaagcgtgaggcaacttgcctgaagggtcctgccagcgtcacggtggcgtaggggtcacattgcccattcacgatggggaggccctggcactcgacgatgctgaggagagaagcagaggcggcgtcaggagggagcgcagacacctgggcgaatggcgagacagctctgggtcaggcaggaggcctgagttcaagctgtgagatgaggtttcctcaccggaaggcagggagggccacaccagccattctgcctcggtgtgacgctgaatcacgctggccattcacaaaagcccaaaacaacacctctaaggtgagcatgtgctttagcgtggacgccagcagtgtgtgacagcacatctaaagcagcgtcatcgggggggcggggggcaggacccctaaaacagtgtcatcctgggggccaggacccctaaaacagcatcatctgggagccaggacccctaaaacagtgtcatctgggagccaggatctctaaaacagcgtcatcctgggggccaggacccctaaaacagtgtcatcctgggggccagggcccctaaaacagcatcatctgggagctaagacctctaaaacagcatcatcctgggggccaggacccctaaaacagcgtcatctgggagccaggacccctaaaacagtgtcatctgggagccaggacctctaaaacagcgtcatcctgggggcccagaacctctaaaacagcgtcatcctggaagggggccagaacttctaaaacagcatcatcctggggcaacctctaaaacggcatcatcctgggggccaggacctctaaaacagcatcatcctggggccaggacctctaaaacagtgtcatcctggggccaggacctctaaaacggcatcatcctggggccaggacctctaaaacggcatcatcctggggccaggacctctaaaacagtgtcatcctggggccaggacctctaaaacggcgtcatcctggggccaggacctctaaaacggcatcatcctgggggccaggacctctaaaacggcatcatcctggggccaggacctctaaaacagtgtcatcctggggccaggacctctaaaacggcatcatcctggggccaggacctctaaaacggcatcatcctggggccaggacctctaaaacggcatcatcctggggccaggacctctaaaacggcatcatcctggaggccaggacctctaaaacggcatcatcctggggccaggacctctaaaacggcatcatcctgggggccaggacctctaaaacggcatcatcctggggccaggacctctaaaacgacgtcatcctgggggccaggacctctaaaacagcttcatcctggtgggccaggacctctaaaacggcgtcatcctgggggccaggacctctaaaacggcatcatcctggggccaggacctctaaaacggcatcatcctggggccaggacctctaaaacggcatcatcctgggggccaggacctctaaaacggcatcatcctggggccaggacctctaaaacggcatcatcctggggccaggacctctaaaacgacgtcatcctgggggccaggacctctaaaacggcatcatcctgggggccaggacctctaaaacggcgtcatcctgggggccaggacctctaaaacggcgtcatcctgggggccaggacctctaaaacggcgtcatcctgggggccaggacctctaaaacagcatcatcctggtgggccaggacctctaaaacggcgtcatcctgggggccaggacctctaaaatggcgtcatcctggtgggccaggacccctaaaacagcatcatcctggtgggccaggacctctaaacagtgtcatcctgggcagccaccggctctggaaattcttgtgcgttggtgtgaaaacccctgtgtgctcctcgggagccagacatgccactcgctgtgcgctcggtctctagtgaggacgtgtcttaccgtgtggcgagcttgtggcagacgaccccagtgtctgtgatgacctcgctcagccgcagctccaggtgcactttgccctgcaaggcacaaggatggggtgtcagaggctgtggcgctgctcccacaggccactagggccgcgcgcccagggaaagcctagagggcaaagggagcaggcggccccgccctgccctggccaatgggcacgtccagcccctccactccacccccgggacgcagggtcccagctgtggcctttctccaggagagctgcttgcctgactgctcagccccatgtggctgcccaggctcctggctctgctgagagcaggtcgctgcctcagaagtgaggggtccaaccgtgtaggagacggtcattcagtgaagcagacccccaaaggctctgatgctgcaggctgctcgtgtgtccgtcgggacaaaccagaggggaagcacagctgtctcccaagcaggggccactgcctttacctcccctcgggcgaggccggatggaggcccgcaggaacctcggagagctcacacagagggcaaggctcacacagagggcaagactcacacaggaggcaagactcacgcagagagcaagactcacacagagggcaaggctcacacagagggcaaggctcacacagagggcaaggctcacacagagggcaagactcacacagagggcaagactcacacagagagcaagactcacacagagggcaagactcacacagacagcaaggctcacgggggcttctagcagagcagacagcaaggctgccctgcgggtccacctgtctctctagatcagtctgtctgtgtgtgctgctgtgtccatccacctgtctgtctgtgtgcacggctgtgggtgtgtgtccacctgtctgtgcgtacaactgtgtgtctgcctgtgtgcgtgcggtttgtgtgtgcagctgtgtatgtgagcatgctgctgtgtgtgcatgtccacctgtatgtgtgtccgcctgtgtctgtgcatctggctgtgtgtgtgcagctgtgtgtcctcctgtgtgtgcggctgtgtgtctacctgtgtgcgtgcaactgtgtgtgtctatgtgtgtctgcctatgcatgcatgcgactatgtgtgtccatctgtgctgctgtgtgcgtgtctgcctgtgtagctgtgtgtccgcctgtgtgtgcggctgtgtgtctgcctgtgtgcgtgcaactgtgtgtccatctgtgtgtggctgtgtccacctgtgtgcatgcgactgtgtgtctacctgtgtgtgcatgtgattgtgtgtatctgcttgtatgtgtccacctgtgtgcatgttcgcctgtgtgtgcatgcagctgtgtgtgtctgcctgtctgtgcatgtggctatgtgtctgtgtgggcgtgcgattgtgtgtgcgtgtccgtctgtgtgcacacggctgtgtgtctgcctgtgtttgcatgaaactgtgtgtgtctgcctgtcggtgtctgcctgtctgtatgtgcatctgcctgtctgtgtgtttggctgtgtgtgtccttctgtgtgtgtgtgcgactatgtgtgcatgtctgtctgtgtgcaagcagctgtgtgtgcatctgcctgtatgtgcatgcaactctgtgtgtgtctacctgtctgtagtgtgtggctgtgtgcatgtccttctgtgtgtgtgcgcgactgtgtctgcctgtctgtgcgcgtggctgtgtgtccacctgtgtatgtgtgtttgtccgcctgtctgtacatgcgactgtgtgtgcatgtctgcctgtgtgtgcaccgcctgtgtgtatgtgtgactgtgtccacctgtgtgtgtgtgcggctatgtgtgcctacctgtgtgtgccgctgtccctgtatttgctccagcctgaatggcaatgaatggatgggataaacacagactcatccatgcttcaggggctctgcctggcccggcccttagctctagctcctgaggctccgggaaggccaaggcgtgttccccagggcttgtccctgcctgtgggagggtgggacagacgggcagaatgcctggcgctaagacgtggacggcagaaccgacagcagccctgcagcacgtggcctggtgcagaacctcggatggagcagggacctcgcttaggccccacccacctaaatgattaaaaaaccttcgagttccttcaaaaatatatcagacacctagccagccttgagtggtaaatcacctaacaagcaaaataaataataaaataatagccaaaaaattagtcaggagatatttattccctatacaagttaaaaatagcatcttaacatatgtccctaaattgtttttcaaaaaccgagaccctcaccaaacagatctaccaacacagaccacaaatgcaggggggatcacaggcccgaaccctgaacccggctctattctgaatttcttcctcaggggccaggaggggtcatgcctgtgggccagagccaacattcttttctgctgatctcaattgtttggacaaagcttctcctccttaaccaatcacaaatcaaaaacgctctatatccgacccatgggccacacgtcgtgatgtctgccttctcaggtcaaactgacatacggcctccatgtactgatttatgactttgccacaacctcagcctccccaccttctgaaacccttgcctgtgaaccctcggggtgcctgggtcgtgggcgcagcctgccctgccagggtgcacaccccgaagcccctggtcagggagtggaacataaagcccttcagccctcacttgacaccgcgtcggtgcagccccacggcacccccacacttgatactatgccccacggcacccccacacttggcaccacgttccacggcacccccacactgacaacacgtcccacggcacccctacacttgacaccacgttccatggcacccccacactgacaccacgccccacggcacccccacactgacaccacgccccacggcacccccacactgacaccacgccccacggcacccccacacttgataccacgttccacggcacccccacactgacaccacaccccacagcacccccacacttgataccatgccccacagcacccccacacttgacaccacgttccacggcacccccacactgacaccacaccccaaagcacccccacacttgataccatgttccacggcacccccacacttgataccacgttccacggcacccccacactgacaccacaccccacagcacccccacacttgataccatgccccacagcacccccacacttgacaccacgttccacggaacccccgcactgacaccacaccccacggcacccccacactgacaccacgccccacggcacccccacactgacaccacgccccacagcacccccacacttgacaccacgttccacggcacccccacacttgacaccacgttccatggcacccccacactgacaacacgccccacggcacccccacacttgataccacgttccacggcacccccacactgacaccacaccccacagcacccctacacttgacaccacgttccatggcacccccacacttcataccatgttccacggcacccccacactgacaccacgccccacggcacccccacactgacaccacgccccacggcacccccacactgacaccacgccccacggcacccccacactgacaccacgccccacggcacccccgcactgacaccacgttccacggcaccccacacttcataccacgttccacggcacccccacacttgacaccacgccccacggaacccccacacttgacaccacgttccacggcacccccacactgacaccacgccccacggcacccccacacttgacccagcgctcacagggggaatggaactgggtctgtgctgcccaggcaggtgtgggaggtggggcctccgctgctgtcctgagactctggggtctggaggttgggtgtggccttcccgccctgtggctgcagccccagagcaggtcctgaggggccacaaggatgttgggccgggaaggtgggcatgaaccccacgccagcactgtgggcggggaaaacaggtgcctaaaatgacaacaaagaccccaccaagaccacagctcctcttcccacacccatcagagctcagggctgagcggagtatcgcctgtggtcctcaccgcctggcagcgggcctgctatccgtggctatccatgggctaaaggagtgccctgaacaccagccgggcagtgggcctgctatccgtggctatccacgggctaaaggagtgccctgaacaccagccgggcactgggcctgctatccgtggctatccacgggctaaaggagtggcctgaccaccaaagacaggagaaagtgcctgacccaagaataaccaagaatccccactgcttcatccccgttctcaaatgccgggcgcaaactctctcaggacagaagcgttcagatttgcaaggctgtgcagacggaggtagctctattcacattcgggagcttcaggaagagtcacgactgcatgtggggggtcctggtccccagcagcaggctgtgtggcccccgtgtgctctcccggcccctggcagcaggctgtgcggcccccgtgtgctctcccggctcctggccgggtccaggggcacctggctggtcaccatcaggtcctgaggctgctcctgttcctgcagcatgaatccctcctgaccagctgacttgtgtgctttcgtcttctgctgattcaggagtgggaacaaacaaaacccacccctggaaggccctttctcctgccagaaaagccaatgagtaaatctgcaggtgctggcgcaggctggagaatcccagacatttagaggttaaacaacacagttctaaataacacacagatcagagaacgcaagacaaattttaaaatgttccggaataaacagaaatgaaagtgttactcatcaaaatcagtgggatgaagcgggagccgtgctcggggtggaggggaatctggagtgccggccacacagactagagcagaagggagatctgaacgctgacctgagcttagagcagaagggagatctgaacgctgacctgagcttagagcagaagggagatctgaacgctgacctgagcttagagcagaagggagagctgaacgctgacctgagcttagagcagaagggagatctgaacgctgacctgagcttagagcagaagggagatctgaacgctgacctgagcttagagctgggagactgagaaaaatgagtaaactaaacccagagcccaagaacagaaaacagaagtcagatcggaaaccaataggtaaaaatcaaagccaacggcaaattccttgagagatcaataaaattaataaacctcaaaccaggctactaagagcaaaagggaaaaggcacaaattcccacaggaaaggaacgagaggacctggctgccgaccctggcacctgcctggacgctgcactgaggtccctggcgctgcactcctgcgaactcacagacgcagcaaaggggccccagcgtccagctcctgacaacgtgtggctgcagtgtcacccatggggccctgggcgggggctgctgaggggtgtatggaaactctgtactctgctcaatttccctgtgaacacagaactgcccccaaaacagagttaattaatttttaaaaagcagccaatggtccctatccatctttctcaggaaggccttccccagggagagagcagcgcgcagagccgggtcagggtcctggccccacccaccggttgccgtgtcccccactgagcgggcagcggcccagagagcagccaggacagaggtgccttggatgcaggactgttccacgccggccgcagagaggagacgaagtccgcgggcagatgagacaggatgcagaggccatgaggaaggaagcccagcctcggccgtctcctcttacaaccctggagagatgtgaaagcttgacgacggacggtgactttgtttgctccgaaaatccttccaagaggactgtctgctgcacaaacacaaaattcccagaggctgtagcaggaggctggaatttccagcccagtgagatttcacggtgcaactggaaggctccaagggggaaacacgtaggtgtctcttgggcggatggcagacccaggggtttgctgtgatcccctgcagggctgtgctattttctgaatacgtcacagatgcacttgaaagcctggtttataaacggagctcagtgacccccaggcgcccagatcaccgcggatgcctcgctgtcacaggcggtgccctcgctggcatctgacgctggcatctcccccactggcatctgacgctggcgtctcccccgctggccctgcatcaggggagggtcagagagcacaactctgcataataaagtgatttaacaaagactttccaacagtggccgttccagaaggaagcaagaaaggtttaattgtgtttcccccatttctgtgactcacttgctggcctcccccatgggctgcttctgtgacactcgctgtccggacacaggactgttcctgggaatcacagagcggagggactcatggagccacatggctaccccctgccttcctgaaaatggtcactgtgacatcttatgatgaaacggcggctcctgagactggagttgtggggttttttttcttcttcttcttctttttttgagatggagtttcactcttgttgcccaggctggagtgcaatggcgcgatctcagctcacagcaacctccgcctcccgggttcaagcgattctcctgcctcaacctccggagtagctgggattacaggcatgcgccaccacgcccggctaattttgtattttcagtagagacggggtttcaccatgttggtcaggctggtctcaaacacctgacctcaggtgatccacccgcctcggcctcccaaagtgctggaattacaagcatgagccaccgcgcccagcctggagttgaggttttaaaggttggctggagtccagcagggccactgctccctgtcacgctacgttttgggcggcgttggggctgactgcatcagtgaagcaacgcattggagagcagcgggcattggagagcaatgaccttgcctcctcccttttagacaacagctcgcatttgccttccataaagtgcaaattcccgggagactgacaccactcggttcaggatcctcatgttccggacagtgagagtcaggcttggaggacgctgggcttggccacgggtacgcagcctcgggcgttaattatgagattccaccagctgtgagatcaacctgcggcattcttatttacagctttgtggagatgcaacgtctgagtcctgatcgtcatggtggttacactatctaccctgtgatgaagttgcaccgactgtcacaacagcccatcggcaggtgactggagcaacagcacacgcttcgcacctcggaccattcctcagccttggaaggaaggaggttctgataccacaagcgacccggaggatgtcacgcagagcgacattagcctcagaaagaccagcagggtagagctcactcccatgagccacggggagtggcctgcgtcagagacagagtgccatggggctgccggtggggaaggggcggacgggagcgtgtgaataaaactctagccaggggacagaggggacggaggttccgttttgcaagatgaaaggagctctagagatgggtggtggtgacggttatacaatattatgaatatattcaatgctataccactgaattggacattttaaatggttaaaatggtaaatttcatgtctctgttttaccacataaaaaactggaaaaaatagcatagaatacacagagagacacacacagaaacacgtgcctgtgaactggtgaaatctggataacatccgtggactgcacaaacgtcggcgtcctggttgacgttgcaccagctgcgcatggcagtgcctggggaagccgggagaagggagcacagccttctgtttggggaagccaggagaagggagcacggccgtccgttcgggggagccgggagaagggagcacggccttccgttcgggggagccgggagaagggagcacggccttccgttttcagggaaaggtgggaattcgcccctcgccactcctgtgtactgttttgatgccttcctatagatctataaccatttcaaaattaaatcagtaaaaaaaaaaaaaaggcaagaaagaggaaaagctacacctgccaataaaaccaaacttgaatccgaggcaaacgacgaggccgcactctgccagctgctcagaggccgttgtgacggagaccccagcgacggcgggtatcccagaatagaagagctggggaactcgccgacacgcaggcgggagcggcccagtcaccaagccccgtctcccgggcagcacgtgggaaaccccgcctttctgccgggacgccaaggtccgtgggagcagcacgctggggcccttgtgctccggggatgcgaggacagtcattagttctgcagtaatcacagcgtccttcactttccacagcacgtgtgggttccccagccagtgctttcccaggaagcagagttaattaagtgtgacgcacaattagcacaggtcccttggggcagggccatccccagggcttcttggctccactccttaatttccgtcaagggcctcaccccacccccacagctgggctcatggtcaacttcatgaatgaaccctttgctggccatgggcgtgtgcacagctcatgaccttggcaaatggcaaccttgacccagtgaagcgcagaggatgagggttgccagggcaagacggttcccagaggacgagggttcccagaggacgagggttcccgagggatgagggttccaggaggatgagggttgccgggggacaagggttcccagaggacaccaggccatccagtcccccagcccaaatttgccctgaacttgcgggcacagagcctccatccgacccacccagttgcctctgctgaagtctcaggcgaagtcctcacaaggaacctattttggggatttgtccaggatgccagcctccaggtgtaaaaataaccatcacagccaccaatttacgatgcgccaggtgccttcgagtggcacacacgccataccagcacgcttcacaaacccacccagatgggaaaactgaggcctgcaaaggacgttggcaacaatccgatgagggagctggctccgagcctggcggcctgtgctgggactctgcactcagacacacactgtggtaccagctgaggacccaggaagccctcccacatcccagggccgctgtgctgcaaccccatactcagacactcaccctcctacgtcccagggccgctgtgcagcaacactacactcagacactcactgcggtcccagctgaggacccaggaagccctcctgtgtcccagggacgctgtgcagcaaccctacactcagacactcactgcggtcccaactgaggacccaggaagccctcccgcgtcccaagggcgctgtgccacaaccctacactcagacgctcactgcggtcccagctgaggacccaggaagccgtccggtgtcccagggaccctgtgccgcaaccctacactcagacacttactgtggtcccagctgaggacccacttgggaaaccctcccacgtcccagggttgggccacggtgcctcttgcttgtggcctttgcagctgctctgtgtcacagaccagggctcagggtgaccccacaggagctggtgcaggcttgggctccggtggactgacccccactgctccctctgttacaggcaagcctggagcagctgttgccgggcagctgggcaccgtgcgtccgtgagcagctgtgaacacaagggtctgggacatgggccccagcactggagcccccggtcttgcgtggggaggtgggacaagctccccccactggacaggaccggggtgagccccagtcagcacacagtcccggcaagccagggtgagcccctggccactttcgacaatggacacgggagaccagaacgctctttcagctcagacccttcttggtgccgcgtgccaggcaacagcccgcccagccaaccgtggggaagtgagggtccctgagggctgaccctggctcggcccttccccacccatgttttctcttgggcctcaatgacgcgtgcctgtcctttcccaccgtgtttgttttcacagcttcctcagttgtgcatgacaaagggcggcagtaggcaaagggaaaacccaaaatccatgcacggagcccaggctcactccgagcacaagtgggcgaacagacacaatgcaaaatccatgacagagcctgcgctcactccgaccacaagcgggtgaacacgcccaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcagagaccgcgctcactccgagcacaagcgggcgaacacgcacaacccaaaatccatggcggagcccgcgctcactccgagcacaagcgggcgaacacgcacaacccaaaatccatggcggagcccgcgctcactccgagcacaagcgggcgaacacgcacaacccaaaatccatggcagagcctgcgctcactccgagcacaagcaggcaaacacgcacaacccaaaatccacacgcggagcccgcgctcactccgagcacaagcgggcgaacatgcacaacccaaaatccatggcagagcctgcgctcactccgagcacaagcaggcgaacacgcacaacccaaaatccatggcggagcccgcgctcactccgagcacaagtgggcgaacacgcaatctgctcatcgttattcccagtcaaggccgaagcccgatctacgtctttagccacagtcggagccgggcccgtctcgaagccccatggtgtcccagggctctggtttccggggctgcgccgagagtctcacctgcacttccgagtcagcgtccacgtgctgcagctggaaccaggtgtccctgttgtggtacttctgcaagtcctccttctggatggccaccttccctgcaacacaagcagagaagacttcaccacgggcacaggccccagagccaggacgcctgtgagcagaagccagcccatcatcaccgcagcttatttccaacagtttaattcagaatggggcaccggccgggtgcggggctcatgcctggaacccccacgcttgggaggcccaggggggagggtcgcttgagaccagcctgagcgatatggtgaaaacttgtctctacaaaaaataaaggaatgagccgggcatggtggcactgtatctctaaaaattgatattaaaaagtcaaaataatcaggtgcagcggtaagtctccactgtgtcccttccagtaaggcgttccagaggcttcgctgtgaaggcgcgaacgtccgctccatcggcaatgtgcgcctcactttcactgtggtccgtggccagttctcacagcaggaggtgcctcggagctggctgcaccagagctctgatctcacaaatgaacaccccgtgcctcacacaccaccaaggcagcagcatcacgccacaagagacacgtgtgcacccgtgcgagcgacagcctgaaacacacgtgtgcctagggtgctttccgtgtgtgtggacacgcacgtgtgtgcatgcatgtgggtgctcaggttattcacaggcaggactgagagccagaatgagctgccaccttcccacgcgacgtgggttggtctgaatctgtgcctctaaagtgtaatgaatgagccgccttctgggacccctggagagcctgaaagtgtagattcctggccttctccagacggaggagaacagaggctctggtgtgggctggaatctgcaccaccacaggtccctgggcacttgtgtgggccccaaagtctgggaacgtccactctaaacagtttcccgtgccttaaacaggcttagtactttggggctacgcttccagtgaaaatacgtatcagaatatatttgtacaatatacgtttacctagtatggatttatatgtgtaaattcgcatctgcaaccattattatctgcttatacgttcacctcattccagaaacattcccgaggcgcggcaaacgtgtgcccatcccatccccggcaggacagggcttgtcaggcgctgggcaccgagccatctcccatcctgcgtcccttcatggcaccaccatgtcaaccctgccagtggcctccgcacactgcggaccacgccacccaccacggtgagcacccacggcagcacatgcacctctgttgaccgatgcacgtgaactcctagggagtcgcacacacatgtgaagtctgagcccatcacagagcacacacgagagcaggagtgaggaaggaaatgttggcagactcctcacgtcttcgttctgcacccagagacacacacgccctccttaaggatcttggtccagtcactgaagtgagaaactctgggtccccgcagacccggttcaccgcagcgtccgcagccacagggtctgagcacattgtgcatgacctgggctcccgggagcggcctgggcctcctacccggccaccctgcctcacgccaggacagcgcagcccagccccggttctctcttccaaggaagatccttttatatttccgtgtctcaaaaaacttccgcaggctcccatcggaacaaccctggcctggcatccagcagccacatgcttgggcctgattctctgtccagcctcagtaaattcgggaacactccactgccagcctctcacaggtgccatctcagtcggtcctgcggtgaccctggaggagcaggtaccactctgcacaccccacagacgagcaggccggggctgcagggagagggagcttccgtccctgccttcctgccagcgttccttcctatgttggcgtccccaccctgcgaggtcccaggacgcatcttccctcaggagctcctctgcctcgcgggctcatgcgagcgagacctctcagcctgactggtccattccgtgactaatctcagagcccgtgggcctgggccaccaggcccctcctttgtctgcaaactcagagggtctgagacacgcccagctcagcaccagctccagaccctatgggacagcgcaaggtcggccacatgatggagcaccacatggccacaggacatggtgggaggtgcggaaggtggaaagaggcacaaagacgctttccaagtgcccaaaggagagagacggaatcaggacagtttgcctccagtgctgctgacacctgccatgcacgtcagcatcttcatctgatgtcctcaggggagccggctgcacctcacaccatccactctgcaaagcaaagcagccctgggaacagccctggaaaaagccccttcccagctccgggacccccgctcacagccagggccggccagttccacagctacccggacgtagatacagcacacaggcactcatgggttcctaagatcagcctggtgacctcatcggctcagctcttgccacacagacatacacaggccatctggagctgcacgggacgctgaaaccaccactgagggcaggcgagagccaaatcaagaaccaagggggccggcacaggaaacaggccccagcacatgtgggagaaggaacaccagggaggctcagagagaaatccagtgacacaccacgtggactccctccaatggcctctaatggcgcagaccacgagggtggacgacagccaggacacctccgcctggcccacctcactcgctgagccccccgccccgcctcactcgctgagcccccccgccccgcctcactcgctgagcccccccgccccgcctcactctctgagcccccccgccccgcctcactcgctgagctcccccccgcctcactcgctgagcccccccgccccgcctcactcgctgagccccccccgcctcactcgctgagccccccgccccgcctcactcgctgagctcccccccccgcctcactcgctgagctccccccccgcctcactcgctgagcccccccgccccgcctcactcgctgagccccccgccccgcctcactcgctgagcccccccgccccgcctcactcgctgagccccccccgcctcactcgctgagccccccgccccgcctcactcgctgagctcccccccccgcctcactcgctgagctcccccccccgcctcactcgctgagcccccccgccccgcctcactcgctgagccccccgccccgcctcactcgctgagctccccccccgcctcactcgctgagccccccccgccccgcctcactcgctgagccccccccgccccccccgccccgcctcactcgctgagcccccccgccccccccccgccccgcctcactcgctgagctccccccccgcctcactcgctgagccccccgccccgcctcactcgctgagctcccccgccgcctcactcgctgagccccccgccctcccaccggcagccctgggcgggcgcctttgacttcaagggtccggagtgggggctctgtcctctcctctgacgaccgctgcgtggctcttgcataacctcccctttcccccacaacacgaacctcagttttgagtctcacaggaataaagccacatgaaagcaaaaacttcttaaaactgagttgggcaatatatttcagtgaaaagggataaatcttcagactccaagacgccttcagctggacaggagggtcagttttgaagtctgaagttttaaatacttgcaatgtcactgtgtcttcacatttttatgagctgaaactgggacgggagaagtcacatatttacgtggataaaaatcttgtaactggcacatgattacaagtctttaattttagaagtacttcacttaattttttaataggtaacacagaaacagaacaaaatccacaacattcaaaaggatttaaaatcccttcgagaagggatccctgcccctgccacctcattcccgacgtggggtcacttctgtcaccagcccccaacctttccttctagaagccagccacattcaacaatggggaccgtggacatttgaagcatgcgtgttcgtatctccagatgctgacctgagagaatgcctgatctaaaagccacggcgtctacttaaatttctctgatgtgcctaatccacagggttgtccccatctatttgagtcacaccgaaaagtttaccgaacactctgggcctccctttctcacttgggcaaaggcggctgccttctcaccacgagaggccggaagggtcactttcttctgctgcatctgtgctggccaggcccgttcagaaaggaggagccaggggtctggagggcatcagacgggggaccagctgcagagggaccagaaaaaggggaaacagccacaggacacaactgagcaagagctgcccgagacagggaatgcggctgaaatgcgcgcgcctccctctgaccccacctgtgtcccagccagggccacgaggaaaaaacaaaggccatacagatcccaaaggaagaaataaaagcctttattcatagaatgtacaaaaaaaaatctacaggcaaagctaatagaactaattggtgtgttcagcaagaacagagaacacaaagtcagtgtggagacgtcgactgcgtttgtacatacaagcaatgaccatgaaaattacacaaaaacagcacctttcacaaaattatgcttttaggtttgtgcttttggtggactacctcagaaatctttaaccactccactaaacacataaaacacagggaaataaatgtttttaaatgtgcaaaatgtgtaggctgaaaacacatcacaaaacactgatgagagaaattggaaagacccaagcgtgtaaagatataccatgtccatggatttgaagactcagttttgttaagatattaattctccccaaattaatctatagatcaatgtaatcccagtcaaaattcctgtgggactattttggaaattgagaagctcattcaaaagtatatatggcaattcaaagcatctagaatagaaaaacaagtttaagaacaaatttgatgatcttacactacaatgtaagacctgctatgaagctatagtgatcaagactgcgtggtattggcatgaggacaggtggatcaatatgacacacagcaggcgagccccaaattggggcttagcctcagagggtctgtagcttcactcaggaaagaattcgagaatgaggtggtggtggaagaaaacagttttatggaggcggcagtggcagctctgaaactgctcctgcacagcaggactccccacgggcggggtgttgacagtctcagccgttcctgcagagaagggttccccataggcagggtgttgagagtggcacctccgggcactgctgcagtcttatttatcctcacttttaactatatgtcaattaaaagattatgcagacatttctagaaaaagggtggtaatttccgagtcacggggttgttcctatggaaaggggtggtaacctccaggcgttgccatggcaatggtaaggtgacatggtacactggcaggcgtgtccgatggaaagctgcttccacccatccctgtctcagctagtcctcaatttggttcggtgtccgagccctgccttcagagtccagtcccgcctcctacctcagatggaagagaatacagaggccacaaacagacccacacaatgcagccaactaagctgtaaatgtgccaaagtcatcaacggaggaagggtcgtctttcagccaagggtgccggaacaaagggatgtctacatggaaaaaacagaatcccgacccttttctttgtgctataagtgaaaattagcttgaaacagatcatggaactaaatgtgaacgctgaaagcacatgctttccaggagaaaaccgccacaaccgtggaataggcaagactttcttagacatgacaccacaggtacaaatcatacaagaaaaaaatgtgataaactggaccatcgaaattaaaaacttctgttcttcaaagccaatggtaagaaaatgaaatacaagccacaaactggaagaaaatatttgcaaagcacacttgtgatagactcgtatccagaatatacagggaactttaaaaagtaacaagaaaacaacccaattaaaagggcaaaagatttgaacaatgtactaaagaaggaatggagctgtcactaagcccaagaaaaggtcctcgacgccactcttcacggacacgcaataaaagccacagtgagacagtacacacctatgggagtgcaaacggtaactagagaataaaaactcacagtcctaagggccgggcaggatgcgaaatacctgctgctctcacccgctgctggagagaaggcagactgggtgaccacttggagacacggttgggtagttttaatgaaagtaaacacacaccctacagtgacccagcaacctcgctcccacgcatttatctcagagtaagaaacagaaacattgtccacacaaagacctatccgagaatgtttacggtgactttattcataattcctgaggattagacacaatccagagggtggatgaggcggctgagctgtgtctgtatgatggaaacccacgggcagtggaagggggcggcctggctcacagccgcacagcgcgggaccagcgcagtggcagagggcacggcccctccagggtttgagtcacgtggcctcctggaaaaggcaactgtgggaacaggcctcagagcagtggctgcccggggctgtgggccagggtaggaaatccaccccaaaggggcccaaaggagtgttccgggctgtgggaacatatcttagctgtgctgctgtctacacaactgcatacactggtgaaggctacacctaacagtgaactttaccatatgtcagttgcagaccacctgatttatacacaaagaacggaggtctcggccgggcgcggtggctcacgcctgtaatcccagcactttgggaggccgaggtgggcggatcacgaggtcaggagatagagaccaccttggctaacacggtgaaaccccgtctctactgaaaatacaaaaaattagccgggcgtggtggcgggcgcctgtagtcccagctactcgggaagctgaggcaggagaatggcgtgaacccgggaggtggaggttgcagtgagccgagatcgcgccactgccctccagcctgggcgacagaaagagactccgtctcaaaaaaaaaaaaaaagaagaagaaaagaatggaggtctcactgcacccccaccccattgggaagcctcagagagtctctaggggctggaggggcaaatggagggggacatggtgctaccagagccggggcccagaggaaggtggaggcctagcgggaaaaggagggaggcgccaggatcgggggcggagaccccaatgctcctgacagcaccgagccgggcctcgcgcatttccgtggttcccgcatcccagctgcggggagccatagtttccggtctgtgctctgtgagggcagcgcccggcagccgagtccaggcagaggccgcctccctgcgcctggaatcccgaaggagcctgcgccccgtgtgtcccgcaggtcacggccctgcagctgggagcccggcttgactgacagttcccgccggcagcagcgctctgtgggccatggacccagggacagaggaggctacggtcacgccgcccgggacccgccgacactggacacttctcctgctcctgctgtggcgggagctgactgcagccggtggaggtgccggggtgggctggggagggctgagggcaggcctttatttccccaagtctcacttgccggggcgccgtatcccggcacggcttcagctgcctttctcggtttctgtcgccaccgccctccccctccaggctgaagatgccctcccgtccccaacccacacccccgaccccataggaatgcacccccacttccttctggcacctgccagtgcacctctcactcctggacctgaacttgcaactgagcacagctgtggctgccccaagggaaacttgctggcaggtggggtttcctcagggcgtgggcggctgctagaaacgagaaccaggagaaccacgcagccaggaagccagtggccaccgcgcacttccacccagaaacgcattccccagaacctggtgtttcatgcccggtaacaacataattaccatcataaagataaatcgttaccggagatccagacagccacccattttcatagctgcgaaagccacagtgaaacatctaagtccagtcaccataatcgtaaagccaccaagaactactagcagacgacgtcaacagaatgattaataaacatcttatttggttattttcagagcatataactccagaactaacttgatcagcttctcttactaaaatgtgcaaaaattttttaaatttctttttccttagggttgtcgctcaaaaaatgtctcatacaccttcgagaacgaatcaagtccctgtggattctcgagtataaacggagctggtgacgaggcctgacacacggtcacacctcaattcgcgcgtggcgcccggcacaggctgagccccgccagatacaccattagcctccgctgaataatctggattccatgcctccctttcttctgagaacacccttggaggcccctggcaggggctgagaacacaggagcgagacacaggcctgccctgcaggaccatgggctccaggaagctctgtccagtggacacagcacaacaggcaagagaaccacaaccaacgagtggggcaggggaggcaggtcacggagggcagcccacccatgccgcggggtcggaggccatctcctgcagcaggccccagtcccagaggtgggcatggcaggacatggggatggagaaggaggtgcctcaggagtggggtgcacagcggctgagcccggaggcaggagggagaactgccagccactagccctggagccgatgccctggtcagagggagagaggaagagggaacccttccgcagcacccagcttgaacgcgacataaagctatgggcctgaacctgagggcctcccaggcagacactgagcaagggggtgcaggggtcacgctggaccctcaagaccatctcaccgacaaggctccatgaagcccagcacagcaagaccctgaaggggggtcaggtgcccgctgcactcagacaccttctgcagccgcatttcagggccagggtgtccgctgcggaagcacccagcacagtgttcccgctcaaaatgaagtcaaatgtcaattatctgagatccatgtgacccattccatgtattttctaaacaaactctggagacttctatgaaaaacacagcagtttctaagaataatcacttgggtacagtgaacaacagtcccaaaaatgtccgggtcccgacccctgcaatggtgagggggcactggccttatcaatgccaggtgaggccctgcccggccccgagggcctctcacccagccaagcccctctcaatgccaggcagagagcaagactggtcaggataggcatctcatctctgtcaggggacttgctgtggaggcccgggacatggcagagtgcagacagcctacgcgttacctactagcccgtttctctcatgccccctctctctctcaacgtcgtgctgacacacactagctgccggccgcccagtggggacaggctgggttttaggacactcaagctctgaggtggacctttggccgtgcctctcacttctgtgtgccaagcactgggaatggatcagatcacagatcctggtccatggctcacaaacagaggaacagggacgatgaagaaagcccacagctgagggacacaggtgagcgctggggaaagggggcagccggcgtggggtggagcggccgtgacacggtgtgaggagccagtgtgagcagcgagcgtcagatggaccgggaccccgcccacgcacagcaccctcgtggcctcgctggcctcctgcacccccgggccctcaggctgcctggggccaagctgggggtcccctgggggactcctcctctcgccctgtcccactcagcatcccggcagccatgaagacgaggagcctgcaccacctggggtctgggttcaggctgtggcagccagtacacactggctccccggccgcccgtcctgggcgtgagctcaggcgccacaggacccctcctcccttcctggctctcccagcgtcacggcgggaattagcctgatccctcagcctcccacgcctgctgcgtgaggtctgctcctgacggggtcctctggctgcatttaggaacaaggagctccccgagtaacctgaagtccactctgcccagaggccccacaacttacaggatgccgccttcctgtgataccaggcagggctgcccatgagctttctccaagagcagccccacccctgctccaaacacaccatctcctggaagtaacagtattgccccaaaaaccagggggaaactgaggcaacatgcccccacccccacccgcccttcctgtgcccacactgtggggactaaagttgggacagggacagccaagacgtggtgaggagggaggccccacatccatgcaaaggtccccccacagatgccccggggaacagccctgggaagttgtctgaagagggccagagatgctgtgctcttgccttgaggggccatggaagcctcgactggcagtgctcactgacctgagcctggtgtgatgctctagcagggaccacagatgccaggccagatcccaagagcagatcaggaggaacacccagggctgctgtgacctcaagccctgcagcgacccctcagcaccatccagccaggctctggactgaaatgctaatactcgcctggtacagaacaggcagaaaaggggaagtaaatgctcattcatcacctacctatgatggaatccctccggaaaacgtctctatcgaaaatgtagaaggacaggtgacgaaagctccgaggaatttcacagtaaaagtcttctccgtaaaacgggctagtgagacaaagaaaagcgccagttagaacacaggccacgcttgcgcctcacccccggggcacacacgtgtggtcttagttttaaacatgccataagaatgccctgcactgtgtggcacgcatgagacatgaacctgcagctccctgtggggtgaagggcctcgtagctgctccccggcctccacctcgagcctttgcactgcacagatgaacttctgtactgggctgcctggcggcccggaagctgagacctccacagagaccacggccactgccagaatgacttccatgctacgtgctcaggtctaggtgcagcctcagggccatcgtgatgtttcgaaggtacctggtttggggcaggcagtggctccctttatgcattaaacataaaacacagcactccagtgccttggaccgctccttttatccagagatccagtacaaagtcctgactgcccagccgccctcactcctcggggagagacccccgctgctgactgtacttagagtcctcgctcctgggggagaggcccccgctgctgactgtgcttagagtcctcgctcctgggggagagatccccgctgctgactgtgcttagagtcctggctcctgggggagagacccccgctgctgactgtacttagagtcctcgctcctgggggagaaatccccactgctgactgtgcgtagagtcctcgctcctgggggagagacccccgctgctgactgtgcttagagtcctggctcctgggggagagacccccgctgctgactgtacttagagtcctcgctcctgggggagaaatcgccactgctgactgtgcgtagagtcctcgctcctgggggagagacccccgctgctgactgtgcttagagtcctggctcctggggaagagacccccactgctgactgtgcttagagtcctcgctcctgggggagaggcccccgccgctgactgtacttaaagtccttgctcccggaggagaggcccctgctgctgactgcccagccgccctagctcctgggggagaggaccccgctgctgactgtgcttacagagtgcatggctcaggccgcccatgcgtgagtcaccaggagatgcagccgccccacagaggagacttgaaataaccacaaccccaataaagaagcagaagccagtgggctttgccattcagcaaaccttcctgttgtcctgggctggcacaggtggggttagtttcctccccacgccggacctgttggcgattactgcggtgcacgcacagctaccaccaactcagaacttaaaacaagcccactttcatgcacattgatgctaaggtccaaaataggaaagatgtaagttattcaaggaggaaccattctgatagaaagcaaaggaaggtcaacgtgctgggccagggggcgtccacacagtcaccaacggcacaggccccaccccagccacacacagaaatgagctcagaccccgcacccatctgtaagggtgtaagggttggagctactagcctctcagaagaaaatgagaatgaacctgcaccctaaagtcaggtaaagatgtcttagatctgtcaccaaaagcacaagtgccaaaagaaaaataaatggaaaatcaaacttcatcaaaattaaaaacattaaaaacttttttgcattaaaagcattatttaaaaagtgaaaagggccagtgctgtggctcacgcctgtaatcccaacactttgggaggctgagactaacgaatcacctaagatcaggagttcgagaccagcctggccaacatggcaaatccccatctctactaaaaatacaaaaattagcagggcatggtggtgggcgcctgtagtcccagctactcgggaggctgaggcaggagaatcgcttgaacctgggaggcagaggttgcagtgagccaagattgcaccactgcactccagcctgggtgacaagagcaaaactcagtctcaaaaaaataataaaaattaaaaaaataaaaagtgaaaagacagactagaaaaaatattagtaagtcagttatctgataaaagacttatatacagaatatataaagaactcttatgactcaataaatgatgacaaataattcagtttaaaaaggggcaaaagatttgaacacacatatcaccaaagacaaatggccaacaatgtattaaaaatgctccatgtcattagcccttgagaaaatgcaaattaaaccaggagatacggcacaggcataagcccaaacctggggcgggcgactgttgctgcccggagcccaggtgggaggggcccagagtccaggtgggaggggcccagagtccaggtgggaggggtccagagtccaggccccaccccttctccctgcagcggccttaatgacaggcatttcatttggatttcactgatttcagtatttttataactgggtcagagactgggtaacatttactcagaaaaccattttttgtcataaaacaatcttccaagggaagcctaaaatgcctaggttgttttaagcattttggaaacacagcagtatccatttacacacaaaagaaacatcactttatctttcaatgaaggcagaatgctcagggacttccaccgactccattgtagcagcatcctggttaatgaaggcccattagaaagtcacgtttcctttaaacacattctcgcgttggtcgttgacgcagcgagccatcctctgatctcctgcgtctgcgtgggcaccgccgagatctgatgtcagggacccccaggggtgtgtgtgcccacaggcatgtgtgtgtgggtgtgtgcacgtgtgtgcccatgggtgtgtgcacgtgtgtgcccatgggtgcgtgtgcccacaggcatgtgtgtgggtgtgtgcatgcatgtgcctgtacgtgtgtgcccacaggcacgtgtttgtgtgtgcatgtgtgtgcccgtatgtgtgtccccacaggcaggtgtgcatgttcatgtgcatgtgtgtgcccacaggcacgtgtgcatgggtgtgtgcatgcatgtgccatgcatgtgcccatacatgtgtgctcacaggcatgtgtgcatgttcatgcgtgcatgcatgtgccctggagcacttgggtgcacatgtacacaaaggcaccacagatgcgccccacacaatgcgctgctttcataacaaggcgcaggggtcgtgaccctgcctccaccctgtgtaaagtcacagctgcaggatctcggggcaggacgcacactccccaggcagcgccctgtggcctccctggagaagcttggtgctctgcggacagcgtccccactggcaggaaaaaccactatcaacctcgaagccaaaagggacaccagacgtgcattttaatattcacgacaaggcctcaggtgacgagctactcacaggacaagcgttaacaattaatagtaatccacaaaacatttgggatttttacaacgacaaaacggcctcttctgtacgtcctagagcaactttcagggccactgaggcctaagtgatggcaggaagccgtggtgtttgaatgtgtgaaagcagcctggacttggcgtttccagccccgttcgctcccggcagagccccaagaaccaagggctggaggcttcacttcctgctccagagtggcaggtgcccaggctgtcctggctgcggtgcatctcacacaagaagcccagcgggagcacgcacagctctgggccttgcggcaaatgcgtaaccaaaaggcgtaaatcaagcttcgttcaccatggaggaacctcagaaccaccggcaccgatagccaagctgccagagaatggaacggacgccctccattggcacaaactccagcagccggcttgtcaggaagctgcagcagcttcagagcaacccaggcctcggggttcacctggcgcgtcaccgtttcccgagagccccccgcccccgcacaggcactgaggaccccaccacatgggcctgtgcctgcctggcaggaaggcagggaggaggaagtgggtcgggctggattgcatgtctgatgtgtgtccgatgaatgtccagtgcgtgtccaatgcgtgtctggtgagtggtgagtgtctggtgtgtgtctgatgtgtgtctgatgcatatttggtgcgtgtccggtgcgtggtgaggggcggtgagatgaggatgccagcgctaagcacaccccacaaacgggcgccgcgcacctggcatttaaccctgcacacttcctcaccaccctgatgcacagggtgggaaaccgaggcactccaacatctgatgaaacgaaactaaccccagggcttgggcagcagggctgagagtgcggcgtccctgggcgctgcccggtagcggggtgttcagttgctctgccaaaggctctgcacaagtggctcctctctctgtaactctgcttggcagtggggggctcggtggggggaggcccgtgctggctgggcacctgggagggtcccgtgaggcttctggtggtgctgacagctgtccgtggaaattgaggtgcttaaaattcataaataaaccagaaatccattcaataaaaagagataaaaatagcagaaagaggaagctacaagaaaacatacgaactccataaaattatcaccacagactggacgtgcccctttctaaatgtaaaagcggtttatagcaacacagcatggccctgctgcactacccctggggagcaagacctcctccagcctccacccaggaatttctccagcaatggctttagaaccttgctcctgaatcgcagcaggggaggcagcgctttggggccctctgtcaggctgccccccctgctaagaggagctgttgtccttgggaaccacgggtcccccctcctgaagaaggggaacgtcacactcacagttccattttacacatttgcagctgagaaccctggagccagaacaggctccagcacaggcgatgggtgagtgttttgcatgtctgatgtcgtttattctagtggttccaattgcctattttaatgtttttcttcttatttcatataactttttaaacttaaagtaataaagttattactaactttgtttcctgcgggtcacctcaagtctttcaggaaaccaggcaggacatctgcaggcggccggccagccttatcaacggagctctgagccaccaaccactgtgaccaagcttcattcccacgagctggacgagcagaaggcattgcagggcagtggggtccggagaggcggccgtgctacaggccttgcactcattttaatgaaggctctgcaggatttcaaggaaagctggagccagtctctgtgccagaatagagggttcgttcagcttcttagaccgatgatttatttagggaataagaagggcgattccagggacagtggaggcccccacaggaaggaaacctctccccacaatgactgtgcacagagccagcctgacacccaaggccacgatgccatagccagggagccctgaagaaactcctggaagaatgtaaaacccccagctcaaggaggagagtggaggcggttccccaccttctgggggcagttaacctctgagaatgaacccacagctaaaacccataaaacctccgccaaccacacccagacctggaaggggcacctctggccagggcgctcagcacgaggggacccagaacaatggcttccctggggtgcgggctcggcctgcaggatggaggctggagagctgccatcctagcgcacactgggtagatgcaggtgtttccaatgtgctgaagagggcagggcctggctgaggccctgggaggtcggagtcccggaggtgggtgggggtggtgagttcccaggtcacttccccaggtgtgcgttttcctcactgtcctgtcctattcattcattttagcacggaggccagaaccagccgagtgaagcccctgcctgaccactcaggggtgtgaggacaggggcgaggaccgggatcatcagtcagctcctagaatggcaggtttgtacctgcaaacggagcaccagagtgacatccccccaagacccccgagatgccatgagccccatggagaccacccacccggcaggggccagctccaggtgctgctgctgcggcgaggccgtcaccaccatccacgcgtccagcaggaagagcggattcctcgggcgtgaggctcaccactcacgttgtctgcacacctgcctgacgacctctcccgaacctggattcccaccacagaattcagctcctcgggtgctcaccagcccgtgacttgtggtcaccagaccggacggaaaacacagagaccatttcctgttttgcagaaaatcctgttgggccatgccagtcctagagccaaaacacggtgtccacttgagggtccagacctgaggccacccttgctgggacagcatctccttccctctcagagcaatgccactgatgcccagaccagcaaccatgcccgtcctcgcctgcccgacaatgcccttcccaggccctgctcctcggaggactggtcatgggcaccctggactatgccgacccgcagtccccagggaccaagtcctgctgctgtggacacaggtgaccctgcccctcgcaggggagctgctcttctcctgagcccaggagtgctctgaaacttatatcccaatgagaaccaaaatcaggagtagaagtgggagttgaaggccagagcctttttcgaagaacttccctaagctcttttaaatacctgcatccaggccagatgcagtggctcacgcctgtaatcccagcactttgggaggccatgccagaagcgccacttgagcccaggagttagagatcaacctgggcaacatagcaagaccccaactcaacagaaaatttaaaaattagatgggtttggtggcgcacgtctgcagcgaagcggaggattgcttgagcccggggttccaggctgcagtgagctgtgatcacagcactgcactcctgcctgagtgacagggcgagatcctgtctcaaaaaaccaaacacctgcatctcctgcatcttcagagcacagtcccgcctggaggagccgccgtcaggccctcctgcatcttcacagcacagtccccaggtgcagctgctccccccaacctaattcaggccctggtaagcttcacaaggccaaggggacgttggtctccaccaggaagactatatggcacgtctaaatgtaagaatctgtgacagacgtcgctgaagccaatgcgaggaggcgcaggtacccaggaggcacaggtacccaggaggcacaggtgcccacacgggccttgccgggggaagcacgactttgaagatggggacgtccacgtttcaacgctgccttgccagaggccagttccctcatctctcagcctcaggacaccgccctctccacagtgcagcctgcgggcacagagggcgctcggctggggaagggcagtggctctgcccccaaagcggcctccccaggacacaccactgcctggcttggaggtttcttcctctgccctgcacagtgagacaagcacatggcagggcctcccacacaccaggaccaaacaacggggagcactttcgatgtctttggcccccgccaggcgtggctcactggacccagaaaccacagcgctctctctctccatgactgtttcagctgcccatccccgttctagactgtgggaatagcagccaatgaagcaaagtcctggccccatggagccagccaaagagcacacagaaccacgaatgtccaacgcgggcaaggctggcgggggcagcactgtggcctcgctcgggggacagggaggcttacggacgagtgagcgcttgaacagcgctgtggacggtgaggagacccgcaggaggacaagggaacgcatgaatgaggccatggacggcgcggagagcgcaggaggggtctaggcagagggacaccaggtgcgaaggcctcgaggcagcagggcttgtgtgtggtaaagacgtaggagcaaggagaaggctgacgtggcctgggcagggcacggcaggaccggagcatgctgggagccgaggtcagaggtcagggtgcagccgaggtcacgtggtgcagagcagacatttcaccacagcagctgggaatatgcaggcccgtgcaagacactggatggacggatgcacggatggggcagtgggcatgcagggaggaatcacctgtctcaggtcagcagccaggagctgcccagacctggcacagtggaccaggaagggaaggtcacccaagcctccacaggtggggctttctgcaagcaaggtgcagcggtcagcccgagaggccacggtgccgagcaaatcctggttgtcctcatggggacgacaggaattcagttctggcagagccaagactgccgggaagccagaggggctcctgcaggaggtgacgggcctgcggggacgcgaagggccaggaccggacacgccccgttccgctctgcttccagtgaggcgagaggcgggcaggacgcagctggagccgcgcacgcccggagctcaggccaggactgtcccccagcgctgcgctcgcccgcggtggagctgcagtgttatcagtggtcagctcaagtccagtggcttgaaagggaggcagaggcctcaccttccctgaggctccctgtgaagagcaggaggctgggccctcgggaagaccccagccaggctctgccacctccacagccgggagacggggcctccaaagccggcagacggagcccccacagccggcagacggagccccccacagccggcagatggagccccccacagccggcagacggagccccccacagccggcagacggagcccccacagccggcagatggagcctgggcactgcacacagagacatttcttcttcccgagacctcgcacagaaattactcacttaaaagcacttagagttttttcattttttcagtggcaaatatttcgagggaataccacagaaatagccacaccaaaacccaactcagttctcccttctccacccccgccacggccggggacgctgcctcgatgcgcggggctccctccgccatggccggggacgctgccttgatgcgtggggcttgggttcttcaggtctcttgatgtttttcctcttagaaccgcaaactacggttgcctgaaaaggtttctaaaaaccccaggcgcccaggcccacctcagagaacggctctttaagggtgatgggttatgaaacaggagccctttgggaggccaaggtgggtggatcatgaggtcaagagattgagagcatcctggccaacatggtgaaacgccgtctctactaaaaatacaaaaaaaaaaaaaattactgggcatggcggcaggcgcctgtaatcccagctactcaggaggctgaggcaggagaatcacttgaacctgggaggcggaggttgcagtgaaccgagatcgcaccactgcactccagcctgggcgacaaagcaagactctgtctcaaaaaaaaaaaaaaaagaaaaagaaagaaagaaatacgagctttgaaatctatactagccatggagtctaacacgatccttaagcgaactgctcattacaaagcgtggcaggctgccttctctccagagggtttctggtgccctatccacggaggcggcagtgggattcagccgtcacctgtgcttgcggtggtaactccatctcagactcaacaggggacgtgtctgcacagagcacacggcgcaggggttgggcggggaggacggcaaggtcaagccagctcaggggacatggtgggcagggggctccagatcccacggtgggcagaaaaggcgggggtcggactgacgccgtcctggaccatgtccacgtctggggtctgcaggttccatctccctttccactgtgcctaaccttacatctataacctacatccagcaagacacgattttccacgatgagttgattcgtaattccatttatgtgcaagtttttagaattttcctgtgggttttttttttacttacttatgattttaattttgtttgctttaaaaaaaacacatgcataggaaagaatgcttcctttcatttcaattaaaaacaacaaattgcttttttttaagcaaaaattcattgagggggggctcgcattgtacaaagaaaatcagacccaccgggatggctgtgatcaaagagacagtaacaagggtagggaggtggagatgcgaatccaaacacacaacttgtgcaaaggtcaagtggccacagccgccacggaaaacaggctggcggttcctccgacgttcaacacacagtcgccacgggacacagtggttccacccccaggtgtgcagcaatagacatcacagcccacgtccgcacgcagactcggacacgcgtgctcacagcccacgtccgcacgcagactcagacacgcgtgctcacagcccacgtccgcatgcagactcggacacgcgtgctcacagcccacgtccgcatgcagactcggacacgcgtgctcacagcccacgttcgcacgcagactcagacatgcgtgctcacagcctcagtcatgacagccagacagtggaaacaaggcaggtgggcctcggctgctgagggagcaacagcagaacggtgctcagccctggagaggaaggacgcctggaccctggccccacaccacagcatccacaatgtggtgccaaccaacaggccacgcacacagaggccatgggccagacgcttccactgacacgaaatgcccaagagaggcacagccggcgacagaacggggacccgtgtctgccgccccaggagaggctgcaggccggaaactggaggattacagggcgcgagtgtcgttttagggagatgaaaatgttctaaaattggctgtggcaattgttgcacaactctgcaaatatactaaaaaccactgaattgtacatttcaaaatgggtgaattgtacggtgcttgaattatacctcaataaagctatttttaaagaaacaaaattttaaatacgtaaaaaaatcagaaagtgaaatctggaattaacattccaggaaacatcctcctggagttttttctccaaaaatataaaatagaataaaatatataaatgttataggtttaaaatatacaaaatataaatatatttgtattacatttataacataaatacaatatttataatacaaatataagtatattcatactataatgactcattatattataatacaaatatattaacaataatagtaaatatttatgttataaatatagaagatacgaatggaaatacggataaattttttaaataaaagtgaggttatgttccctgtgacagagtcagctttttcctttcacatcaggccatgggccactttccaaagagctgataaaacgctggggtcagacggcacgtgtgtgcgtggacagcagtgccaggtccccctgccatgtgcacgctgtgtggtgggagcagcaggggtgagcaccctgggaacgcagatctgtgcagtggctgattgtccccgtgggataaattcctccaaggatgtgcactgtcctgaggcctttgaaacacaaagccacagaaccctccagggagtctggaccagtgtccacccccagcatacgccgtcttataaatatttctacagtttgctaaaccggtggcaaaaacctgcttaaattttaaatgtctggctcattggtgaggtggaatgtccatctttttatgagcagttttaaatctcattttttcttgaaatgctctgggcctgttttctattagaatgaccatcttttcatgctcaggatttaaccctccgggaacttctgaatgtgtgttgcaacttaaaagacatattatttcacaacatttaaggaggatcttttttgaactaaaaaaacccccacaaatttgttaaatttgtcaccagtgggtgactatggacctgtgatcagccaactctgaaatgagctccagcagatggacacagcgtcccaggacctgcaggagcagaggctgcgaggccagccacgtccacctcgatcacgtcacctcgtgggcagaatggcctacgccccatgtcctcccagccccacccagaacccacggtgagcacccggcaggaagtggccacagcaccatcactggaggccacgcggagtctgaggacagcagctttcccccctatgctgttgtggggactccaggctcagcctgaggacagggtcagttccctccacacagcaccaacactcccaggtgcaaagcccaggcccacggacagccccccgctgtccgtgggtctcatggtgggggcacccattttctttcatcagcaggaaggtttgtgctttctccttcctgggcagcagagtttgaagcgtattccaaaagaaaaatgaaaccggctgaacgctagggcattcctcccatcccccatcctgttcggtggcctgtgccggacaatctcttctttctgatggactcaaaggggccacacagccaccaggtgccccccttcccatcagcagcttaacctcggggtatctcttggacaggccggctttgtctccagccgaggtcagcagcagtcagatgcgggatgaatgcctggcccaggcggcccccactcaccgcccgagggctctggaactctctttccaaataaagaaaaagtgcggcctgagaggaccaggctcgcctgaaatcctgccatgtggcctaaggaaattaacgcacgcagcagcctctccctctgaggcagagaccctggcaaagtctcctttccctcagtcatttctggaagaagtgcaaatgaagtttcacagaatcaagcaaactttcacggggaaaaaagaaaaaacctcttgcagaaaacagagttgacctttaagtagtggctctgatgaggggaaaccatctgaactgaattcctcctcctcctggagcctggagcaggggctcagctgggaccagcagagaaacccccgccttctcctccctgagtcacttcccagcatctgcgcaaggctggcgctgccccatcccgcctgcggctgctcccatcacgtgatcataagaaaataaacctggtttcccagctctgtgctctgccgcaggctcggggcccatttcccaaacgctggggggagccgggagctgccagggctgccccagcctcggggtagagggtaaaggctgcgtgaagaggaaccaaaccccaaaccgggtctgcgaagcagccctggggctcccaagccagcctctgggctgagctctgcggtcctgagtcactgcctgactcatcctcagaggcgccccacagagaaggggcaacttggccagggaaaatgctccatctccgcaaaggacaggaggcaaaacacacccatcagaagcacatggccagtgcagggccacacagccctggctcccacagaccgcaggctggagaatgggggtccgcggtcagctcatagcccacccgccacccagcactgcagggtcacacagccctggctcccagaggtcagaggctggagggcaggggtccgtggtcagctcacagcccactcaccacccagcacggcaggtctcagcggaagccccacacacactgggttgcagcctcctgtggttcaagatgggtggggttattttgaaatgttggcaaatagagctgtgagtcttcaaacggaacccaaagactcagtgaggaaagcaggcgggctgggctgagactcacagctgcagcggccgtggtgagccacctcacctccccgagcctcagtctccccatctgttcaggggcaccgaggagctgcccctcggctcatgggctctgtggtcgccaggcacgccacacaccacacgccacacaccactgcacgcagcaccccgggacactgtggcctcggctcccgcctctcctgcacatgaggctctttcctctctcccaccccataccccccaaaaaagaaccaccatccttacaaacaaatgaaaatcggctgggtctttagggcccggccacgatgtgtgactgcagcagtgactctcaggaggaggcacaaccagacaccgggtcccctgcagcagctgagacacctcaaaccccaaaccctcagtgaggccctggtgggaaaaggggctctccagggaggtgccaggggcaggagagagggccagcggccgaggagcgggaggcggccgggcgagaggaggcccgggcaggagggagaaggggggacctggcctttgctcctcatgggatcctcggtgcggccccctcgtgacaggcccagcctctccctgcagtggcccagccacagctcagggccaggaggctcctgcaggcacaggcggccgatgagtcccttccaggcctgggcctggggcagcctgccatgtgcagtagacactcagtactcacagaatacgagcaacctcatgctctccgccggctgagttcctgtgcggctgagagaaccccctgcatcattctgacacaggtgcgctcctgtgagccagcatgacacggaaggacacacacatgcaggtggagatggagatgctgggccgggcttgggggtcatacagacaggaccaggggctctgacctgctgggagatttggggccagcattccaggactgagagaacagatccctggcctggggtgctctggggctgaggatgggcccccacctgggctgaggatgggcccaacctgggctgaggacgggcctccccacctgggctgaggacaggcccccctacctgggctgaggacgggccccccaacctgggctgaggacgggccccctgacctgggctgaggactggccccctgacctgggctgaggacaggccccccaacctgggctgaggatgggccccccagctggggcactctggggctgaggacgggccccccacctggggcactctggagctgaggatgggcccccacctgcggtactctggggctgaggacgggccccccacctggggcacttctggggctgaggatgggcccccacctgcggacaccccggggctgaggatgggcccccacctggggtactctggggctgaggatgggtcccctactccagcagttctgggatattctgggcttcaagaagcctccagtcgtgtcaagcaggtttttgtttaagctctaacttgagagtgaaaataaatgttcatgggaaatgtgacttttcatgagtcgcctaatgtcaaagtcggtgtttcctaagtcagcaacttggtttttattaaaagcatctgagagaatgaaccgtctgtctcccaaaccaccaacttcctcctgcccctttcagtttctaaccccaaataacttctcccctcccgaaaaactttggagctgtggagacatttcttggtttagtcatttctactacacaaaagtactattttgggggtgatttacatcttgcagtatgaacagaaagaaacctccctgtctttaacaaacacccactgcgtgcacacaggacgggacgggcttccacccagaagagctcagagcctgcccctcagggctgccaagtgagggtccctggtgatgtctgatgtcctcgtctgcctgggaagacccagctctcctcgctcagctctagaagatctatctgttccttgacttgtaacttctaattgtacataaaacacacaaacaaaagaacaagaactcccccataattccacttctcagaaatcacatcacattgacgtttttgtctgcgtatccagatcattttgggggtgctcatgattttttaaacaaaagaacttttcctacagacacagctttgtaacctaacgcataaccagctttcggagcaggagttcaggccgtggcacctctgggtggagggggcacagaaaccagccacgcctgcagtttcttcctgttgtggccacggccccttctccccgagatgggcatgcaaatgaaccctgcaaaggacgcaggagcaactccacagaaagggggggccagggctccgcgtggggcagagggctttgcccagcctcaaccccagtggcagggggtagggtcagacccagaaccctgaggcagagcctccctgagccaggactgtctgcgtggatgagggtttggggagaggtcagccacgtgggcgcagaggaagcaggcagggacagacaccattccacgtccttacgtggatggaaggaaatgaggacacgacacttactgaatattcttgcaaatgactggactaacccagcaaggagagatttaggttctgttgtgtgtgacgccagctgttcctttctgctggacaagacggtgatttccactgcagcgcagccttggggagcggggtcatctccttgttttagggtcgtgggtgccggcccaggggaggtccagggcgggaagctggttcccaagccccagccctgccaacccaatttcagggagccttttagtttaagtaaataaggaaacaaatagtggctgccctttaaatgattaaaaatgattgctctaaaaggtatggattgtgaacacagttcactctcaacctcagaaaattatttttctagtaggacagaaactgccaaaatcacttccttggagaagggccaaggccagagagaaagggcttgttctctgaaatgtgtccacttcgatgcgttctgaagttaaacctgtgacagacactgcccttcaacctccaccttgaaaaatacagaaaaaagggaagacagaggacgctctccccagacgtcggctcagcactcgataaagaggccccacagactccagggcctcggacgcgcggcccaggggcccgggccacacgcagggaggaggcgtgggggacacaggcctgaggtggagctgggtcggtgacctccttagtgggaaagagggaagaagagaagctgagttccgcctttccttcctcacacattccatttgcagcttcctgctaagtcagacggcgatattgggcaacagcaaatcaaacttgacccaagtgcttctccccagggaatgtgagaaggggctcctgcccggctgcagacccagcggccagagagcaccctggggcccttctgagctcagagatgcagacgtgggcttttttctttccacagcgactttgccaaatgaaccatcagaccttaaaggtgacactgaccttggaggaagcacacggggggctgggagactcagggaccgggagacttggggggctgggagactcgggggccgggagactcgggggaccaggagactcagggggccaggagacacaggggccaggagactcaggggtcgggagactcgggggttgggagacttgggggtcgggagactggggggtgggagactgggggaatgggagattcggggaccgggagactcggggagccgggagactcggggagccgggaaactgagggggccgggaaactggggggccaggagactcggggggccaggagacttggggggctgggaggctcgggggctgggagacttggggggctgggagactcgggggccgggagacttggggggccgggagactcgggggctgagagactcaggggaccacttggggggccaggagactcgggggccgggagacttggggggccaggagactcaggggccgggagactcaggggtcaggagactggggggtgggagactgggggggtgggagactcggggactgggagactcagggagccgggagacttgggggaaccgggaaactggggggccgggagactcgggggccgggagactggggggtgggagactggggggtgggagacttggggactgggagactcggggagccgggagacttggggggaccgggaaactggggggccaggagactcgggggctgggagactcaggcggccgggagactcgggggttgggagactcggggggccgggagacttgggggctgggagactggggggtgggagactcgggggatgggagactcggggaccaggagacttgggggaccggccccaaagtgggtgccaccatggagcaaggagggggcggtggccaggactaaactccccagcatgtggggcagccctgcctgacacctgcctctcaggtggatgtcgaccaatgactaatacaggactctgttaatgcatgtgcaccgatggagggcttccgaccacagatgtagcgtggattccagctgcaagtttatgagagagccagcttttgggttcaagtacctttcctgccaactttttgtatggggtgggttgatttgcgttttgccctcacactacaggggcggccagcccgcacagccctccaaatggacagggctgccagcgtccacactaaacggcgccagtgttacacgtgggcagggctgccggcgtccacgctaaacggctccacagtcttacacgtgggcagggctgccggcgtccacgctaaacggcgccacagtcttacacgtgggcagggctgccggcgtccacgctaaacggctccacagtcttacacgtgggcagggctgccggcgtccacgctaaacggcgccacagtcttacacgtgggcagggctgccggcgtccacgctaaacggcgccacagttttacacgtgggcagggctgccggcgtccacgctaaacggcgccacagttttacacgtgggcagggctgccggcgtccacgctaaacggcgccacagtgttacacgtgggcagggctgccggcgtccacgctaaacggcgccacagtgttacacgtgggcagggctgccggcgtccacgctaaacggtgccacagttttactctcttggaactgtcccacatgggtttctctttctttgctatcagtcttttgttgtgtgtgttttgggtttttttgagacaaggtcttgctctgtcgcccaggctgaagtgcagtgatgtaatcatggctcactgcggcctcaacctcctggcctcaagcaatcctcacacctcagcctcccaaagtgctgggattacaggtgtgagccaccacacccggccagaaccatgatttctatttctaaattcttctgaaatatctgaaagacaacaggcccccatttctcaacctcacctgaaagagaggttcccaaacagattctcctcccactggctctgattcagcgggtctgagaggatcccggcctgagaaagactgccagtaattctccaggcccacaatccataggcctctaacaacagaccatttaaacacagaatggacttttatccagggaagctccaaaggcacttctgaagggctcggtctcttcccattttcttcagaagaatggctgtgcccagtcatcgccatggcaaccccaagacactctcataaagccagactgggcgcctgacaatgcccctcagcctgcagttctttttgacgagttatttcaaagaacccggagcgtgcattaacataacacaaatgactctcactcctcggcctggagggcagctgcgccaaagccttttggaagcactgtcagtgacggagtgatatgagccccagtctctccagggcaggagacccctcacagttttctagtaagtaaactcacccagtcatcagcatgggttgttcattcccacttggaagtagccagatgcaaggatataattctttagctaaacatgttctcaaaatcaaaatagctgttttgatcaaagcacacgacccatgcttctgaactgaacggtgcagtcacagctgcaaggatgtcttctctgatccccaagccgctccttataacccggtggagtcacagctacacggacatcttctctgatccccaagccgctcccttataacccagccgccccatgcttcccccgaggccgcagcactgaggccctgcctggcacactctccctggcttctctcttcccacccccgacataaatcgccatggcttcctgtccctgtgcatcccaccccgtgccatgtcctggtgttcaactgcagtggtcctccgagtacggcctggccacttagctggagcttttcagaaacacaagttctggttgtgctctggacatcctggggtcggcacccacatcttcacacgctcaagttgagggggaaacttgttgattttaagagtttgtttttcttggctgactcctctcttcctcaaatcatatcaataaacactttctaggcctcttacctcagttaacacccatcttctgtatagctattttagaaaattttacaggaagagaaaagctttctcagtatttccccctctcgaaatccttaatttgtactcttttgtggagtgcgagcttcccggttcatctctaattaaaaagcactcgtgcgagtccacgcagggggaccgccgcctacatgcacttcctggacagcgggagcatttagccaacaccagttcacatccacgcaccaccaaggacagaagctcagctgcctgcacaccagagccccagggagcatctcctcctcaaactaagcaggaggaaaatgggaaggtgatgtacatgctcaggacataatctacatacagaaaaattctctacacgcgggaaaataggatggtgacgtacacgctcgggacactgtctacacacagaaaaattctctacacgcgggaaaatgggacagtgatgtacacgctcaggacattctctacacatgggaaaatgggacggtgatatacacacttgggacattgtctacacatagaaaaattccctacacgcgggaaaatgggacggtgatgtccacgctcgggacattgtctacacacagaaaaattctctacacgcgggaaaatgggacagtgatgtacacgctcaggacattctctacacatgggaaaatgggacggtgatgtacatgcttgggacactgtctacacacagaaaaattccctacacgcaggaaaacgggacggtgacgtacacgctcgggacattgtctacgcacagaaaaattccctacacgcgggaaaacgggacggtgatgtacacgctcgggacattgtctacgcacagaaaaattccctacacatgggaaaatgggacggtgatgtacatgcttgggacactgtctacacacagaaaaattccctacacgcgggaaaatgggacggtgacgtacacgctcgggacattgtctacgcacagaaaaattccctacacatgggaaaatgggacggtgatgtacatgcttgggacactgtctacacacagaaaaattccctacacgcaggaaaacgggacggtgacgtacacgctcgggacattgtctacgcacagaaaaattccctacatgcgggaaaacgggatggtgacgtacacgctcgggacgttctccacacatgggaaaatgggaaggtgacgtacacccttgggacattctctacaccaaagaaaacacatcagtgccaagtaaagcaacagaagacattaccagagtgacttttccacaattttggtcctgaaaacctcctcctggtccaggttcaccgtgcagtagcaatccctcatcttgctcggccccgggtaagagggaaggtttttggcttcacctaaaaagtaaaagcgacatacatcatcagcagcgtagaaatgtttgttccctgctacatcgcagacacgtttccagcctttgcttgtgtgcattcactagctctctataaagccttggtttttttgccaccacaagtcaaaatgtggatgtgcaccccatgtgtactgccgaaaggcgagggacatgcacgccaccctctaatgcaagtcccgcaagcagggacctgccagcctgggactcaggattgctgtgtcttgtttacctgcattagtccctttattttaatttttaacatacaattttccatctctgacctgctcgcgtgcacagttctgtggcattaaccacgttcaccgagttgtgcaaccatcaccaccgtcctctctggaacactctcgtcttcccaaacggagactcggtccccattcaacactcactcccatccccctcctgctgtctcccagtggccctcaccccactttctgtctctgtggatctgactactctggggcctcacgtcggcgggatccacaggacgtgtcctttcagcccggctcactctactcagcaaatgtcctccagggtggcccctgctgtggccgctgactggattcccttctattttaaggttgaataacttccatgatgcaaagggacctcgtcttgcttattcatttatccactgagtccctttttattttgaattttattttatattaggtcaaagttggagccagaattaaaggaaagagctctttcttgtggacgtgagttaactgtaaactccagctgttcgaattgccagtaaagagaagcgtcccagagggacctaagctaggtccacctctccctccttcaagcccacagagacgccacctggacgtgcttgaaggaagtggggccagttcctggctggccctgcagaaaacgcccgtgatcccggactccttgtttgccaggggtcagtctggaggtcataactgaaccccagctgcgacttctctgctggaagctcggagcatgccccagcggcaagcctaacggcccagtttactggagaatagggagtgagcaggaagggatgagtgacagctgtcaatccagacagcggatgcccagtttaagtccattctgtaaaaaaaacgcctcaaacacactcgcgcctccccagggccttttctgcctccgtcatttggctctaaagacgcctggcagtggcgtctccacgacgcaggatgagaggacagatgcaggcacaggcaccacgctgagaccacaccaaggctcctgctggcgccactcagggccacatcaccttattcttgttgaaacaaacaaaatcaaaaacgggagcagagtagaagtttctcagaaccccacttccgccactccgcgctgaatgtttcgcgtcaactcagcaagcgcacacgtcatggctcacatggggcagtcggctcatttcaaagatgccagtttgcaaactggcatgccagcaactccaaagggcagagataaactcagtttgaagctttttaaagacttttcatccacaatattaacctgaggcactgtgagaaggagcagaagccccagggtctggacaacgcctcccgtgtccgcgccgcgtatctctgcgtgtggaggcaccggcaggacgaagcctcccgtgtcggcgccgcgtatctctgggtgtggaggcgccggcaggacgaagcctcccgtgtccgcgccgcgtatctctgcgtgtggaggcgccggcaggacgaagcctcccgtgtccgcaccgcgtatctctgcgtgtggaggcgccggcaggacgaagcctcccgtgtccgcaccgcgtatctctgcgtgtggaggcgccggcaggacgaagccgcccgtgtcggcgccgcgtatctctgggtgtggaggcgccggcaggacgaagcctcccgtgtccgcgccgcgtatctctgcgtgtggaggcgccggcaggacgaagcctcccgtgtcggcgccgcgtatctctacgtgtggaggcgccggcaggacgaagcctcccgtgtccgcgccgcgtatctctgcgtgtggaggcgccggcaggacgaagcctcccgtgtcggcgccgcgtatctctgggtgtggaggcgccggcaggacgaagcctcccgtgtcggcgccgcgtatctctgcgtgtggaggcgccggcaggcgttcccagcagcacccgctgctgcccacacggagcagctctcagggtctcactgcttgcggccgtttcccgccagtgcccccaacacacagtctacctctctgggcctcaaagtcctgaactgcaaaagcaagagacacagcagctctcgaaggctcctccggctctgagacgcctctaattcaaaaggttctggaaatttttattttgggaatcattaaggaagcatcaatgataatcggttggtgggaaaaaatgagtatttcctgataggcactggaccctcagaacacctcaacacggcgactctcccgggatgcgccttcttcacccgctgcatgggagaacacagctaggctgctacgaggcacctggctccaggccaggcctcaggtcggtcatcccatgtcagaagacaggctttccgaaggctcccaccgatgtgaagatcccacacgcagcacacgcacacacgcagcgcacacacgcagcacacgcacgcaggcagcaccgcacacacacgcagcacacgcaggcagcacacgcacacacacgcggcacacgcaggcagggtgtgtgatgagttcacaggcacgaaggggagaacatggccggcgagcttctccagagagggaagggagcctgggggatggcagttgaggttcccggagcagacgcagccttcctggtggccgcggctgcccctgaatttgagggcagccgcagcacacccagcaagtcggacaggggcccctccagcctcccggccctgttttggaactgacggcttctgcagcagatagaagtccttaccctcaaacacagcttgactttgctgactttccttctgacacctttacagtgtgacctgacgctgaccatatttcccttgggattttactgggttttttgtttttgtctttgggagttttttgtttttgttttgttttctgggatttctttgttttttgcaacaaatgagtgtagatatttagctgtaagttcctgtgtttcttaaaaggagagagaaaaaagcttttgaaagtcctgtgggagatggtgtttgtggataatacggaactgagatttgttcccacagggcctcaaatcacagcagtaacagctgggtcttccgaaggcggacactgcaggacggaaacacacaagctttctgtggagtccctgtaagacagacgccgtacgacatgaaaaggccggatccccctgcgctggcgccaacacaccagattcatccctccctgcctgatgatgcccagtcccaccgcactggcaccaacgcaccaggttcctccatccctgcctgacgatgcccagtcctaccgcactggcaccaacgcacccaattcatccctccgtccctgcctgacgatgcccagtccccccacactggcaccaacacaccggattcatcccttcctccctccccactcaatgatgcccagtccccccacactggcaccaacgcaccggattcatccctccctccctgcccgacgatgcccagtcccaccgcactggcaccaatgcaccggattcatccttcctccctgcccgacaatgcccagtccccccacactggcaccaacgcaccggattcatccctccctccctccctgcccaacgatgcccagttcccccgcactggcaccaaggcaccgggttcctccctccctgcccgatgatgcccagtcccctggccccaaaacacaccaggttcctccctccccgcccgatggccccgtctttacctccttctccttgctcactgtcatctggggctgagactctttctttttaatctacttttgctatgatgcatttaataaaaaaaaaagtggggggacaaaatgcaagcccatttccctgcctcaggcttctgatgccatcacctccaaggcactggttttgtttccaactgttaataaagcattgaaacagaaaaaaaaaaaaaaaactcctgagaaacatcctggttgctatgacgacagcaacaccagggagcctgctggacgcaccaacatccaatgagctgctcagaccaggagggctggggctgctgcagcacggcctggccacgtcgccccggggcctcgccgtgtgtgccacatgcaccaggaccgagcctctccctgcagccccacagctgagcgggacgggggctgccccagctcccaagcaactgtttcttctccaccgcaccccaaacagttcattcagttaccttcaccaaaggtgcctgttctgtctctcttagaggaaacacgttttctcttttttttctggtgcacagagacgttcatataaaaagacaaagctgtctgtggtatacagtaagtacctaattatctgttgcatgcatggatgaataaatgaattaaaagaaaagtaaactggtttcatcctaacagccaaataagtaacagttctcatgaccacttttcccacagaccatgcctctaaaacatatgcggtgtgttcaccagccggcagactgatgaagacagccaacacagcacctcgcatcggctctgaaaactcaactaacaggagtaaaaggcagcacttaaacacatttaatgtaaacagcataacaccgcaaaacctgatttccaactccagggatcaggcagtgagtaacaaaaacaaaggccctgatccaaagcgtcatgactcccacgcccacggcagcccttctgggccatggagggaagctgcaccctcagggtgagcacaggcccagccctgaccgagggttaggatgcccaggcttccctggaggcccacacagggtctccaagtgctgacagcgagctgtcggggctgcccgcagcacccggagccacacccctgtacccaggaggagctgtgagggcatggggaggtctccacagaccccacccagcactgctcctccctgcaggcatcctggggagggccctcaggcggggctggcctcatgtactgctcaacacagcagcgggcgtctcccaggcgctcagcagctcagctcagcgcccagtgaagagggcggaggaaggaatgaaggcagccacgggtgaggacgagggcccagggctccactgagcaaagctcctggcaccaacccagacagaagacgtcctggagaggccagggctgtgctggtactggccgcgtccacccaggctgggcgctcttctctttcccacgtcatcacggcgttttactcaactacaggtcggcctcactgaaataacgtggaacaggtgatggcgacagccccggtgcatggtccagcgaaagcaaccccgtcccagcaataaagcccagggcctgttggggaaggagaccctgcgggagaattggaggaagtgcggctctcaaggctcccaacctcagccttttagtcgtcccaacgcaaaacattcaaaggggcctaaaaattttgctaggcacacagcgtcttctaacaacataaagtatttaccggaacaatagtcttgtgactaaaatatctgaataaaggatgaagagccccgtctactttgggctatttagaagcctggaacagcgatcccagccctggcccctgggatcctcactcgaacaggtcctcctccaggccctggcagggtctcagtgaggcacagaagcctctgtgccatgcgtgggtagagacccctctccgggctctgagctgctgactgcaaggcccatgtgccccctggctcctgttcgcctctggacacgggggctccgtgactggcctctgagtgggcctgagtgcccgtccgcactggcctccccacccggcaccctccgtgggacgaggctgcacatctcggtgggctgactgcggtgcagaggccataagaggaagaggcgggggggccccgaggcaggggacacagcgtcttgaggacacagcatgaccctgacccccacgacccctggcaacacaagtgccttcccgaagggcctgcgaagctgccagaaataggcagaactcggcgaggccgtgggagtggggtttcctctgggccgagtcgagggcagacggcacctgctctatcctcacgctcaggaggggcagaggccgctgggcttggatggagccaggcccaggtcttgtccagggctctccagggcaccatgctcctccctcaagaggactcctgtgggttatgaatgacagaagcccaggctgccatcctcaagcaaggcaccccccaatcctcctggccgggaggggctgctgggagcccctggcaccagcgggcttctgtgggcggtggaaggaggagagggctgtgcgggctgattccaaaactcactgggtgacaccacctgcccagggagggcccagcactgccgtccagggggtctgcctgtcgtccagtctccttgagagcacctccagctccctccagtctccacggctcttcagagggcacgggaggttctgctgaggggcgggtgaccaggcccagatgttaaaccctcccaaataacgggcatattcaatgtaattgaaacttccaccacagggagaatgagtctatggtgacggggtggcaggaggggtcctagaaggcgcccactgtgcttactggaggcctgaccccgacaacggctgaaacaggggtctcccccaggggccactgaaacaggggtctcccccaggggccacctcccagggcacgcttggatttcactatgggctgtgcaaatggcatctggtgggcagagtgcagggtgtcttctgttcagtgtcctgctgcacacggtgccccagggcacagggccgtccacctagaacaccaatagtgccgtgtggcagagggccgtccacccaaaacaccaatagtgcccctcggcagagggccgtccacctagaacaccaatagtgcccctcggcagagggccgtccacctagaacaccaagagtgcccctcggcagagggccgtccacctagaacaccaagagtgccccacggcagagggccgtccacctagaacaccaagagtgtcccacggcagagggccgtccacctagaacaccaatagtgctgcgtggcagagggccgtccacccaaaacgcaacagtaccccagttacacgctcctggtgcaaatgaccctcctctcgtgcttggtgcaaaggctgttagcaacgggccacacaggagatgctgccacgtcactccagagactcacgcgtcccgagacccaagtgatccctaaacgtctaggaggagacctggccttggagccaggtcagccagaaggttgtccaggccgggcctccccagggctgcccagtctcccgatgcagtataactctcaaggcgcgggggccgcatcacccagcactctggaaatgctgtccgcagaccacggccaccagcacatgcactctcgtggttctgactgcctgtgaatccagctggtctacaatgagccgctggggaaaatacttcaagtcctgagatgaatggagcaggaatgcctctggaatatcctgagaaacacgactccaaaccctgtcagctggttctaactgtgctcactcttataaacaggtaataaaatatgggaaagaaggcgattgcagacaggggacctctcctccacagagacgtgtccaccaggagactgaggcaaatcctatgggttcaaaaccgaagtttcactggcggctgaaaacacccagggaataacgaggaaagagaaggcaaaggtgggctgaaatgaagccgcccttctgagttcacaaaggagcagagacacaccggtgctgcacaggaacccccagggcccccgtgttcctagcgcagcagagcctgccccgcatccaggctgcatctcctggggctgtgactcctctcctgagtccacacacaggacctcacacctgcactcaccggctgcagctgcacacacaggagagcttctcacaggacaaatgcctggaccccacccagagattgccattctttgactaggacgggctccaggcagtaagaacagacattcgtcttgattagaaagcctgcaggtggttctgggtgcagccaggactgagaggcattacttactgctgagaactgagaaggtgtgaagatgcccctacctcctcgccccactcaccggggagctgcgggtctcacaggggcaggcaggaggccagagacgtccacgtctgagacaaaggacatcaccgcaacagcagagccagagctgcagcgtctgcaggtgccctggtttgcctcacgcagtaccaaattgggattgggaacccagtgatgcctgcacacatatcggctgcaccttgggagcagggcctgagcctggggaaccctagtctcttataacgggcagtggcaacaatgctgacatctgcctcggagagagatgctttcttcctgatcacggacagtgggcaaacctccctgtgctccgaggctccgaggctgctccccgggtggacacacgcgcttgaatggagagtgaggaacaaagggaactgggtctttctcccttgatgcgccgcactgagataaaaccatgaagaacgtctcccagctgcgtcccgtctgggggcagccccagagaaggaatggggggcagggaaaacaactttccttaacccaagcaacgtttagttcacacccagcctgtacgcaagaggggaagggacaggcctggggctgcacccccaggtgggtggtcccaacagaggtttaacaacctggttctctaggggaaaaatgcatgcacgagctcaactaggttaagtcatacattgcactagtgtaaaagatgtgtagcacacaactcacaaaaaataatgagatacacagtcctctacttcaaactcacagagctaattgattctcacagcaaactcttgtctctaagccaatcctgggctgcatttaaccaggatttgacaaacagaggcaacgcaccctctgctagctggttctcaaaaagtgcgtcatcactgagtgtgatatgtgtcgaccattaaaacatttctcccactcatacaaattatattaagctgacatctcttctggctttcacactgggaatgctggcgcttcactcattcatcaatgtcacaagcaactttgttgaatcaggtgaagttttaaatgccagaaaaacattgtcttaatttttttgtgctattgcagtgtaaccgctatatacaagattatttaattcagggtagcaagattagatgatcaacaaaacctttgttcaaacgtgagctcaatttcctccgatgtgtggcccatcctgatttctgtggtgtgaacattcctggccgatttcaagcgaccagtgtggccccaaagccagagagaggagagcagggccccgttcagaggcacccacacctccagaagcacccagccagacagcctggagcccagcagcaatggcgtgccgtgaaatcacaggaagtgctgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtggtgagtctggagtatcgactcccttcgtcctcgcggggaaatcacggggaagtggtgagtctggagtatcgactcccttcgtcctcgcggggaaatcacggggaagtggtgagtctggagtatcgactcccttcctcctcgcggggaaatcacggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtggtgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcacggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcacggggaagtgctgagtctggagtatcgactcccttcgtcctcgcggggaaatcccggggaagtgctgagtctggagtatcgactcccttcgtcctcgcggggaaatcccggggaagtgctgagtctggagtatcgactcccttcctcctcgcggggaaatcccggggaagtgctgagtctggagtatcgactcccttcgtcctcgcggggaaatcccggggaagtgctgagtctggagtatcgactcccttcgtcctcgcggggaaatcacggggaagtgctgagtctggagtatttattcccttcgtcctcgcggggaaatcacaggaagtggtgagtttggagtatcgattcccttcgtccttgtggggaaatcacggggaagtggtgagtctggagtatttattcccttcgtcctcagcgtatgtgatgggattctgaatgggggctgtgtttatctgggcataaaactcctgaagattggcagcaggagtccacgcagagacctcctggagatgggcgcgctacacgagcttttgaaatgagcaagtttccagagccggcgggattgcgggggcacctgggaaggcaaagtcacctgcacccgctctgcagccccggcctgcgcctctggagggagggccccgggcagtgccagcaggaacgagcctgcctcagagccccaagtctcagtggagctccttccaggctgacatggggctgacggctcccggggccagcagggcgcccgcccgacaccaccacaacccatttcagtgacagataacttcagacaacttatcagagggccttggagggccggaggcagcaacacacacagcctgattctgggagcagcatttccttccaaaaaccttaaatcggataatgagccgggcgcggtggctcttgcctttaataccagaattttgagaggctgaggctgacggatggctcgagcccaggagttggagaccagcctggccaacatagcgaaacctcatctctactaaaaatacaaaaaattagctgggcgtggtggcgcacgcctgtagtcccagctatttgtgaggctgaggtgggaggatcacttgatcccaggaggtggaggttgcagtgagccatgatcacaccactgcactccagcctggatgacagagtgaggccctgtctcaaaaaaaaataaaaggaaagagagacacatcagtcacagatacacacacaacaaatctaaaatagacatgtgaaggcctacacaattaaggaataatattttggaaatgtcaatgattaacgtgcctttagacttaaaaaattctgctgtgtgacttattttctaacacctcagctgcacacccttgagccacagttctgctcactctcagggccacataaggaaggttctcagtcttccccgccctggagctcccagccatttgctctgatcccttctacagcaattctcttgggctccttcaagtgtaagcctcttgccccctagggaaaggaatgcctgaagaatcacacttcgacttccttatctgaaggccatacttgatggatttgaacagatttgcacatttaaattcccaaattaattttttttttttttgagacggagtttcacttttattgcccaggctggagtgcgatggtgcaatcttggctcacggcaacctccgcctcccaggttcaaacagtctcctgcctcagcctcctgagaagttgggattacaagcgtgcgccaccatgcccagctaattttgtatttctattagagacaaggtttctccatgttggtcaggctggtcttgaactcccgacctcaggtgatccaaccgccttggcctcccaaagtgctgggattacaggcgtgagccactgtgcctggccctaaaattcccaaattaattttcacatggtaaaatgttccctggttactaataacaataaataagattatggaaacaaagtagagacgatccgtaagaaataaatagggattaaaaactccaccatatatgaagttcataattaccagcacagcggtgcagggacagcccccagctcctcctcccagggcagcagagcctggcgagtcccgaatccctggtggagctcccctcaagcctcccagcagggctctgtcccctaagccttctgctccttcgctccttcctgctgcactttctgctacttgcacagcaatttctaatagttctcattagaggggcagagcagctgaaaagggtgaagaaaataagagaccaagatggcagggatgttcggaggaggagagaggaggggagacgaggggagacgaggggagacgagcggggaggagggggggaggaggggggagggggaaggggaaagctgcagagaatgaaggtgaggacctggtggaaacctcacagagggtgatttgaatacaacctgatcttccctggcatggagggcaggaggcggccacctgagccccgcacaggtgcccggcaagcccaggcagaggaccaagcagaaggtgctgtctgatccagccgcagaactaaggaacgcctttagcccctgctcccagctgcagaagagttgcccggtgacccaggaagcaggaggaaagggcaggcctgggccagccctgcacggacatcagccctgcacagacatcagccgcgcacggccgccccacagcctgcacacaggtgttcacggcacgtgtgtgggtgtcttgattgacaccacacaactccctgcttttaaagggcacgatcccgtggtttttagtgtattccgagttgagcaaccgttatcacgattgacgcgagcatttccgtccccctgaacgaaacccaccctcctcccccagcccccggcaaccacgagtccactctgtgtctctgtgggtctgcttgtcctggacatttcatggaatgggaccacacggtccttccccttctgtgcctggctgctttcactgaacgtcctgtcttcaaggttcgcccgtgcttagcccgtcacagctctgcccatcttcctggccagatgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattatttaccaacgggtggggccgcacggcaacaggtttaattaccctaggagccacccggctgcctgcccagggccgtgccttcacacctgcctgcaaagcgcaagcgttaccatgtctctacaccctcgtcagcacttgttactgtctttttggttatatatttgctttgagtcagagaaatatctgtctttaattttgttttgttttgttttatgatggcaaaatgggggtacatgattgtggcaacagttttgagacagttaatatttttggtgtaagaccagacagatgaagaaactgtctctgaagagaagggaccgaggctcctccctgcgtggcagcaaaaggtccacaacacatcactttgggtctcctgtcccaggagattccgcttccgaccaggcaggcttgccccctgagctcatcacagcgtgagtctgggttcacattgcccacactggagcatgggctgtgaaactacaagagaaaaacacctcacagcagagagcccacgtgacaagcacacatgcctgacgggcacgggcgtctctgcagcaggctcaggcagtgaacacgcagacccttgcttcctctaaattcacagggctggccctcaggtatgcgtaacaaaaagaacgccagttcccttttcctggagaaaatacaagaggttccagagccttaatctacaactccagttcaaagtttcaagtagaaggtggagagaggtgggaacattctatttttgaaggtttccctataaaatctgttacatacatatatatgtatgttttttggtggtgttattgttcagtaataccagaaatgcatggtagaaaactttcaactataggagtccaagattaaaaattaagagtagccctaaagccccatgcccatctgtagacgcactctctagaaataaccacagttactaatttcttagttttttgagctagcatttcaactttaaataacagtcccattgctatttcttagatcaacttaaaatcagctgctggctccctgctgtgaaagatgaagggtctggggccacatgggtccccctccactgtcatgtcccacatttcagtggaaaggcttccgagatttccccatttggtgtgaggtcgtgtcccagatttcagtggaaaggtttctgagctttccccattcggtatgaggttagctatggttttgtcatcaacaggctctaccattttgaggtatgttcctctatacccaatctgttgagtttttgtcatgagggatgctgaattgtatcaaatgcttttccagcactgactgaaataatcatggtttttgttctgggttatatccatgtgaccgatcacatttattgatgagcaggtattaaaccatccctgcattcctggatgagtcccacctgtcatgctgaatggtctttctaatgtgctgctggcatctgcttgctggtgtcttgctgaggacttttgtgtctgtgttcatcagagacattggcctttagttttctttttgtgttgtgtccttgtctggtttgggtatcaggtaacactaacctcactgcttgagtttggaagtatccccttctctccatttgtttggattagtttgaatataattggtattagttctttaaatgtttgaatgatccatcagggcctgggctttttctttgctgggagattttttgttctgatttctacgtctgttcaggttctgtttctttatggccccaccttggtaggttgtatgtgtccaggaatttataaaatttctctaggttttctaatgtattggtgtatagctgttcataatagtctctagtgagcctttgtatttctgtgctatcagttataatgtttctttttccatccttgattttatttattggggtcttatcttttttttttcttagtctagctagagctttgtcaattttatcttttcaaaaaaatcagcttttcattgtgttgatcttttgtctcttttgtctcaatttcattcatttctgctcggatctttgttatttctttccttctactaatttgggggttggcttcttgattttccagttccttgtggtgcatcactaggttgtttacttgaagtctttctacttctatgacataggcattcattgctataaatgtccctcttagcactgcttttgctgtatcccataggttttggtatgttatgtttccattttcatttgtttcaagaaattttaaattttccctcttaatttcttccctgacccactggtcattcgggagcatgttgtttaatttccatgtgtttgcatagtttccaaagttcctcttgctatggtttctagtttttttgattgtgttgagaaaagagacttgatataattttgacgttttttaattttttgagattgttttgtgagctaacctatagtctatcctggagaatgttccacttgccaatgagaataatgtgtattctgcagctgttggatgaaatattctgttaatgtttgtcaggctcttttggcctagagtatagtttaactccaatgcttcttgttgatttttctgcctggatgaccttcccgttgctgaaagtggggtgtgaagtcccctactattattgtattacagtctgtctctctctttagatatattaatatttgctttatatatatcggggtgctctggtactgggtgcatatatatttactattgttatatcaccttgctgaattgacctccttttgtagccctcataaggcttatgaaaaacattcagtagttataacaagttattaaaactgataccaacttacctttgattgtaaaaaaaagagacaaaaccatgtacatgttaactctcttctcctcccatattttgaatttttggtgtcacaatttatattttgatattgcctatctcctaactaattgttgtggttattattttattaattgtgtctttcattcttcttacaaaagatagaagtggtttacacaccataattacagtattagtatgacaatcacattagcatccttttcctttggtttgaagaactccctttagggcttcttgtaggacaggtgtggtagtgatgagtctcctcagcttttgtttgtctgagaaagctgccatctctccttcatttctgaatgatagctttgctgggtacactatttttagttgacaattgttttcctttagcactctgaatatatcatcccactccctcctggcctataaggtttctgctgagaagttgctgctaggtatattggatctccccaaaatgttgtttgcttcttttctcttgctgcttttgacatcatctctttgatctttgagagttttttgattatagtatgtcttattcttatttgggttgaatctgattggtgacctttgaccttcctgtacctgaatatttctatctttctccaggttggaaagtttgctgttacttatttgaataggtcttcttctgccttgtttttctcaattccctttttaactctgatagcttgaatatttgttcttttgatgttgtcccatagatcttgtaagctttcttcatttcttttcattttttttcttttttcttctctgtgtattttcaaatactctgtctttgagctcactgattcctccttctatttgatcagttctgctactaatgctctctctttcatttttgcatttcattcactgtatttttctgctctaagatttccatttgattttttctattacttcaatctgttaactttctctgataaatttgtaaattcagtctctgttttcttgaagttcattgagcttcctgaaaacagctattttgaatcctttgtctgagagatcacacatctccatcatcatgttagggcccgtctctcgcaccttattttatccatttcgtaaggtcacatttgcctgaatgttcttggtgcttgtggatgtatgataatgtctgaatcccaagagtcccacagagagacttttgactgtgcataggtacagaattcttgttgttgtgggaaatatgagcaggttaccttcaattccaccactcaataaactaaacatagcattaccatatgatccaccaatttcactcctaggtatatacttaaaagaattgaaaactggtgtgcaaatcaaaacaaacacgaatgttcatagcagcactattcacaatagtccaaaaaggtgaaaacaacccaaatgtccatcaacacatgaacggataaacaaaatgtgatatgtcatttgtggctgccaggagatgggaagtgattacttaaaggatgttcttctggggtgattacaaagtgttgaaactagagagggatgatggctgcacagcattgtaaatgtgctaaatgccactgaatcgtacactttaaaattcttaaaatgctgaatttcatgttatgtgtattttgcaacttaaaaaaaacatgtttacctaagtattgatagaggcaacattggcaaatgtgaatgtgtttagtacacatgcatcacattctacctgacatccttttttggagcaagaaagggtataaataaatacttcttttagagcttatatttaattgtattatttttatttatgcattttgttgggctataatatacactcagtaaatagagctcacacgtttagatatgtgcacagccacacagtcagtaccgagaccgaggcgcgggctcccccgctccagaatctcctctcatatcccgccccacctaaagcttagcactcttcagagttctagagtcaccctattcttacatctcagctcaacagaaccatgcagtatgtacttcatctgctgctctagtagggggttaaaggtgatgctattattctacctttcattttaattcatgaaatgaaataattttataagcggaatttactatttagtaacccatcagtgaagttcacacaggaaagtcaggataaatgcttgattattcccttttatttactgggttttcaaataatgacttggctacctatcatcctccattggtgaataatttggggcttttcagtaattttctgcaattattttttattgagatgtaattcacatatcatacaattcaccctttaagtgtaaacacagtggtttttagtatattcacagagctataaaaccatcaccactaactccagagaattttcatgacccgaaaaagaaaccccatacccattcccactcccatctcccctccctacagtccctggcatccattaatccaccttctatcactacagatttgcctgtcctgaacatctcacagaaatggaatcacacatgtggcctcctgcacctggcttccttgatgcagcctcatgttttctagatttttccatgctgtagtctcagggcttcactccttcctgcggctgattaatggagacttgtttatgtcatgcacacaccttcacatgcgtccactcacactcacaagtcatcaaagagctcaagcagcaggcaaggctcaggagaggcactctgagggacaggatgatgggcccggctgtttccaaaaccaggtggcttggggcgactcatccaacctctccaggcctcagtttccccatctgtaagctgagtggctgggcctcaggtgaccctgggtctctttccaactccacaattctgtgatttgagcaaataagtccaatcctgagttttgtctcactttctaatccagtaaaagttaagctattgtgtttacttgactcagcagagtgtgtgggggcagagcaattatgacataaaaccacgatcctctttggtactacaagctaatcaacgttaatttttcacacaacgactgggaaaatctgcctacaggaagatgccaccctgggtggcactggtgtgccgggagggggtgctctccaggtggccctggcggcatcggtgtgctgggaagggggtgctctctgggtggcctgggtggcatcggtgtgccggaaaaggggtgctctccaggtggccctggcggcatcggtgtgctgggaagggagtgcgcaggcccaccccggcgtgctgcctgggagtccacgttctcgaaaatgcagggtgaccctggcgcaggatcgggtctgagagctgctcaccgacccatgcctcctctagcaaatcgcctctctcacagtcacctcaacagcatctcagccgttgtccgacactgggtgattctgcacgcccggctcggaaccctgtgcattgcccatctgtgagccgacctcctgcctgaagccaccttctcatagcgctcagtactggggaccctggccgggaagtttgcacagagtatgagctctggctgaccatccatgtcctgggtacaactcaccctcctccgtgattcaaactgttccagcctggaataacccgattgctcctatgggaacaactgctcctttccagccaaatgacccatttcccaaacgccttccctttccattctctaaatactgtagcaccacactgactagcgtgcgggtctccaccacagttatgaccacccttccctcctcgtcccccaaagcactcaacagctctccagcacccaccgaatgaagcactgacccttcagccaggctctggagcccctacaagcaacgtccgtctgtgtccaggccgatctcgctgctccctcggacgtactcgccctacaccccagccaaacgcactccgtgtttgccaacatgtgcgcctttgaacatgcgttctctccgcctgcagtgccctcctctgtgtctcaatccttcccgtgcaccaggccactctgagtctgctcctccacgaggctcccagatcacccccaaagccaccacacctgtccctgagtgttcatggcgtcacagttgtcactgaggctgtggcacttccccttccaccaggcacagcagctatagttgtgtgcacacatcccctcctgaaccgagcagttctccgcagatatgggctgaccaaatgagcatctttagagctaactgggaactgtccaggggcgagaggcctgggtggtcttagtactgtcactcatctctgcttcagttaacttgagcaataaaataccctgcagataaggtcagacggcaggtgccagtgtgtcctgaaaagccgcaagtctacaagcagccggcaacctgcccggctatgctgtgtgcatccccacagggcgccaggagcaaacacccaaacacccatcctattcccgattcagggcaatggtccaaaagacgccatcgctgctacatgagacagaacgtcacagcgaagaggcaggcagcaaatagatgcctcagggcgtttctcaaagaaaggcatgatgcagcctgaaaaccccaccagaagtgtcttcctgaagcatctaaacgccctctgagttccttctcccagaagagagcagttacatgaagcagcaatcacagaacggaagtgcccggccacaaaggctgccgtccttctcctcgtcccagtccatcttacagaatggctcccctctgcagggccacacagttgcccgggatgcagacgctgagacgggagctgatgtgcaggtttctagggcaagaggcgggagagagtgggcagccgacaggacgggggacgcagcctatgcggagtggatgcctcaggaaggccctgcctgggtctcaaggccccaccatggggtcttgtctcattcgtgaccctgtgcacgccgtgcagcagtgcagacggccggggccccaccacagggggtccagggagaccaccagcgagagagtggatacccctgggaacaaagcgggcccagatggagacctcagacaaaggcagctctcagccctcagctgagcacgccgaggggctacagcccccatccaggcccaggccggctgccagcacagagaggcccaagtggaccccagggccaaaaccccaagtctgggggctgcaggggagcacggcacctggctaaagacacagcacacagggctacagcgggcagcctgtggtcaacagctcatcagcgacgagccaggcccagccaagacagcaggaaaaaaaatcaaacgggaggccatgccctctaccctgggggcagagctgagaggacagagaacaggcggacaaggcaacagggacccaggtgcgggtcagcaggcgctaaggatcccagggtctgcgtgcccagccaggcctcacaccagcgacatccaggggtctgcaccagagccatgggggaacagagacacgaacaggtgaaagttcagcagggctgcaggcgcccaggccagccctgaggcagagacgtgaacaggcgaaagtgcagcagggctgcagccctgagacctggtgggctggggtcaggacgttaagggtgtgtgtgtgtggaatggggctggccggccccctcccaacaagatgtaggaaaccccatggccgggatgaggggaggcaggaagggcaaggggcatggaggccggctgagagtccagaggagagaccagcccagacccagggaagaaggaaccccgtgggatgtcccagacagcaaggagagaggcagtggaaggcacaagggcgggagaaagacctcagaagggatttaaagaatgaagaaataaaagctctgaaatttattttaacagagctttgggctacactctaacctttgcttcagcagcacaagaaaaagaggctgcacagagtggccccgcaggccagaaggcagcaacgcccactgatgccggaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacagcagtcggggcccggccacccgagccccccagaccacccctccttttctcaaggtcagaacagcagtgaaggtcagagccagaagcacagcagacgctcccaagccacaggcagctgctgaggcctgagccggggacgaagctcctccctgcatggggacacgcggggctgcagccactcccaggcctccatcacacagggacggtacagaaatagcgtgtcttgtgggtgggtgctgggtcggggagggagggcgactgcctctccctttccaggcacatttggattccccggggtgtccgggaatgactcaggcctctggtcagcgcttctcagacctgtgttcacacagcgcgtctccctcctttccctccctgcctgggacctaagtacggctctgtttaaaactggcccaaatgcagggtcagcgcctgagatgcagcccccacagcagcccccccacagcccccccacagcccccccagcccccccacagccccccacagcagcccccccacagcccccacagcagcccccccacagcccccacagcagcccccccacagccccccacagcagcccccccacagccccccacagcagcccccccacagccccccacagcagcccccccacagccccccacagcagcccccccacagcccccccacagcagcccccccacagccccccacagcagcccccccacagccccccacagcagccccccgtagcccccaccccacagcccccccacagcccccctgcagccccccacagcccccacatgctccactcgatgctcacacgcacagttttatctccttaactctaatgctgtttaaaaactattgtcctaatcaagcaagaaaaactgcaggtttgcaaagcgtctgctctggaagagcggcaggccagggtggagagaccacactgccacacctgaacacagcaaggctttccaaactctgcgcaataggaagacgccgaatggtaaatggaggagctcgcaggagacgcagctctgactctgccccgccccggcccgcggtgctgagggcgcgccgatgtggatgcctctgtgccagcaccagcggctgcccctcggccccgaccctccccactgcgtcctggggcaccctcagagcttcggccatggggtgcacagcaccctccaagcattctgaaaggagattttagactcttgtgcgcaacacccaggagccgcccgcctgcaaagcacttggtcagcgtggcctggaaaggggaggaaggtcctggaggcagggctctgtcaggcggaggacgtgatgctcagagcagccagggacccccgtctgggcccagtccccctgcgctgcgccccacggctggctggaagtttgttctggaaaccacctccaagacaagtgcagcagccggccctagcagttgggaagaaggcggctgacgtggcttccatggaaaatgccagaaagcacatcccacaccaggacacctgggcaaacagcctcaactcggaaaatcccaggctggttcggtctctctgctgcccggacctgtttaaatgtccagccgtttgggaactgtgtacccttcgagaaacactccaaggccccagggacaccggaagccgtggagcccgggccccatgcgtctgtgttctcgccacctggagaggctgctagtgactgacaggtggactgcggggcctcaactgctactgagaatgccacacaattttaaaaactcagaaattgcttatttttagaattttccatttaacatttttggaccacggctgaccacatgtgactgaaaccgcaggtgagggggtgagcgtcagcctgtgtcaggctggacacacctgggggcctgaggagcagccgggggtgtagggacaggggctccccacacccacatggatggcctgtgcagtcaccagcaaggcgggttctgcaggcctgtgtcccggccaacggcagccaccaaacctctctgcacttctgttacagacaagtcagagaggcccagaaaaagggaccaaaattgaagaaccagggaatttcagagggaagggaagggaaaatccaactggcaagcagacccctgggccatgtgctaggaaggggttctgcccagcgaggtctacccccaaccaggacgggtaggcagtggccccagcaccccctgcacccccacggcccaccaggggactgcacctctacaggaaggacagaggcaggaggaacccctcagggctggagagttgccagccactgcccgtgctgggccccgccctgagacagtgtctaagcaccaccccatggacaatccgaacctggaggggcctgatcccggccctgacccatgccaggggccccagccggcactgcacgccggagatccgggctttccttggcaaacacgcttggctgtcctcgtttccaagtcagccctgttggtaaaacagtgaagccagcagtgaaatacacgaaacccgaacagccccggagttggaactggaagcttccagggaagacggcagtgtctaagtgtctcccttaactgctgtggctgcacccggggtcctgggggtgagaggcttgtgggccctgaagtcacctgctggattccaaagtgggccatgccaatgccgtctggaaaacatacggaaaatgtcattcccaggaaatgtggcacatcattcaccctggaccacggcacaaggaaatcaactcaccctggaccatggcataaagacagacggggccctctcatcagaaagtggggagcgggggtctcagtttccaaggaccccacaagcgacgtctacagggtgaaagaccccgtgcccagcaccgaaggacctgcccgacacacagtccccagccttgagcggagacccccagactgcatacaactgtgcaaatgcacttgacctccctttggttgtgagtcacaggactgtcttaaaaagagtgtcttcttccagtgccagaaaacagagagacgggggctgtgaagcacaggatccacagcgggcgggtggtaggcgggcagcaggtgggcggtaggcgggcagtgggcaggcagcgggctgagaagcagagcagagccccagccaggagcccagagggcggcagagcagcgggcaccgaaccagactgtcggacctgtgctgggggagagcgagagtgaaggaggaagagagacggagacagagagacggtgagagggagagggacagagagggagtgagagcgcttcccacaagaagaaccaagctcaggtcccaccctcccccagagcctggtgcagctgcgtgggacgggcaggaggtgcgaggggccctgtctctgacgttttgtgccagcactgccctctacacacaaactctcaggaaccatcacgaccccattttgcaggagaagatgctgaggcccagggcggtgagcaggccacatggccggtggcaggggcagaagtgggactgcagcccaccaggtggtgtcacagccaaggctgcggcgtcactgcctgtcctgcctcacctacccccagggcgacgctcccgactaaaccacctctgtcctatggtctccggggcttcctgacccctggggagggcggcaaagcctgtggaggctggagtcctgtgggctggggacgacgggaagaccaagtcgtctgtataatcgccgtgggcgcagccggcagtgccacccacccacccacaaggcaacacggggcctgagtccagccccaggcaggtgggctcccagagttggggtccctgaaccaaaccacccctgctgctcgctcacccctaagagtgaggctgcgatgctgtcagccaaggacactcacgtgggcagctccggtgcagccggccccagggggagaaatgcagctgtggctgtcgtggaggtggctgtggccaatggccgtgactgttgctgtgtctggcagagaagccaggtgcactggctctgtgcttcaaggagacctagagggtctcccccaagtccaccggaaatgtgtgcacattcgccctaccccactgtgtacctggcccaagtcgggagagatgcccaagagaccacagccagcctcagcacagtgaaggctgccctggcccttcggggtgtctgggaagagcctggcattctctctggggtagctctcacccttgcaaagcacagagaacaccaagagccccagacacacactacatccaaagggaaggtcgggcggctcccagacgggggacggggggacgggggacacagaaccaagccgccgaggagcacctgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgacaccggagcccgagtctcggctcagcaccaccacccccgatgcgtccacactgccacggccacagacacccacccccgatgcgtccatgctgccacagccacggacacccacccccgatgcgtccacactgccgccgaccacagacacccacccctgatgcgttcacactgcccccggccacagacacccacccctgatgcgtccacactgccccggccacggacacccacccccgatgcgtccacgctgccacagccacggacacccacccccgatgcgtccacactgccgccggccacagacacccacccctgatgcgttcacactgcccccggccacagacacccacccccgatgcgtccatgctgccacggccacggacacccacccccgatgcgtccacgctgtcacggccacggacacccacccctgatgcgtccacactgccacggccacggacacccacccctgatgcgtccacactgccctggccacagacacccacccccgatgcgtccacgctgccacggccacggacacccacccctgatgcgtccacactgccacggccacggacacccacccctgatgcgtccacgctgtccccggccacggacacccacccccgatgcgtccacactgccgccggccacggacacccacccccgatgcgtccacactgccccagccacagacacccactggtgatgcggcctgagatgccaccacaccctggccagaggctcagtccacagcccataccccatgacctgtacccacaaaacctgcagctagcaagaaccggcctctgcctgaccctgtcatcaggggcgggaactccggtggcgggcacacccagcgcaattacagggcgagcatccgatgccctcctagtgggccggccacaaagcctctcatcagccaccccgtggagaaccacagccaaaagcctgaaccgcacaagatttggcgtctcaatggcaccttcagaataggagaaaatagcaaatcgaaactttggttttccgttccttatttacgactcaggacaagactgcctgagagagcagcagactccaagtgcaggctgcagtgcagtgtctgttctggagggggggctaccgcctccccagcccacacatgctcacccctccctccccacacacacgttcacaccctccccacacacgctacccactcccctccccacacacgttcgccccctcccctccccacacacgttcacctgagcattgcccacaccagcgtcagcagccctcacaggaagggtggcccccaggctctcggccccccgagcccagcttccatctcgggccataaacaccctttggccaattggcgcaccctcctccaacagactatgacctccccaagccccagaatccctggagatggagagcacgcctggcccccagtcagggcaggtagtctccagggccaagccgtcacctcagaagggtgggtggggctctccccaggaggagggcaggtccgggactgggaggacgacccccacgcaagcccccaccctgcccttgggctccagcctcatccccagcagccgccagccctctgagatgccagggtgccatggaccctgcactgaggggtgctcactgggcagccgtgtgaccagcaagcagaggcaggttcacagcagcagtggagctctccagaggcaactccaccaaggggtgccgcagagctctgtacccccaaatttatgaggagcccggctttgggaggggacacctaggggaaaagggctcaggaggcctcagccaaggaggagcagcactggcagcccccctcctccagcacggggacagggaccaccggcatcgaagctcctcacctgcctcctgcctgacaaggccacaggcacatccggggccagcactgaccagacgctccctccgcctcgcttcacccagcctgaggctggacgggaggcactggcgtctgcagcacatccacagcattccagaaacgacagaaaccaggccaggctctgagcagcccgtccgttgtcctgacacctgaccatgacggcatatttacggtgtcttctcaatctttgaaaaatatttttaagagaacatgagaacaaatcaatattccagtggcctaaggaagtcagctagctgtgaaactattacggtaagctacacagtgggggaatcagcgtgggggaaaggaagcgggcattccacagtgcaagactctgacacacagagcgtcttgcacccgccctgagctgagcagtcctgaccctaaagagctgccattcctctggggccacggcaggaaatcgcaggcactgagtgggaggaagaggatgaccgggtgttgggatgggtgcacatcgcagagcggcacacggcagcctccggatgggcgcatggcagagcggcacacggcctctgctgtcttttccgatgaactttcaataatacatagaaacatatgggtttaatgtttcctgtgtgtgtttacagatgtgtgtttaatattgaatatgtgtgcgcgcaccgtatctccacggagcaaaataagaatggagagaaactaacgcaaagaaagacgctaacgtgccaggctttcagtggggacaacttctcattcttgaaaacttaaaattagcttttccaaaacatctataaagcaacagaaatgcttacaaatttaacagcatttgagattattgtaaataaaaatgataggtctaatttttcttttgccaacatttccttcgtttatattgacagtcaactcattacgtgtaacaataatggcaatttttcctaatgaagtttaaacataaaatataaaacaatgtaattcggagctttgtaaataaatgcccattttacttagcgtaggtgtagaaattcacacccaagtcccacttagaacacgcttcccgctccggagcataagcccctggcgtggggaggggttgggctctgtctgaactgatcaccaccactgctttattaattgtttttggcttaacacctgaaccagctgggtgcaaactatgacacacattacaaaaccacctgtccatcctccaggcacatggaaggcacacggcccacagaaaccaaactatatgctgcgtcccatttagaaagctctgcgtatgtttaaaattaaaagtcttataaggaaactatttttctgtattttaaaatgttcttaattacaaagaaatagatattcattctagccagttaagtctccaggtagaaaaagttaactcttttccctccctcagccaggcccccccagagccacatctggcaaggacggcttggtgtgcacgcccacacctcctctctcgtgcacggccacatctggatcagatgtgcaggcatttcaacatggcagtctccatccagccacggtctgcggacagcgttcaggctccagccttgaccctgggcaccttgaccctcacggggtacgtggcctgtgtgtctgcctttgtgtcctggtcctcgcaggggacaggcctgtgtgtcccacgttcgtgtcctggtcttcgcaggggatgtggcctgtgtgtccctccttcgtatcctgacccttgcgggggacgggcctgtgtgtccctccttcgtgtcctgaccctcgcgggggacgggcctgtgtgtcctgccttcgtgcaccctgacaccatgggtctgattttcccacgctggaggtctgcttctgaacagctgcatctcctcctgcaggggaagctgtctgttcacccaggtgcctgtcctgtctgagggctgggctcttcctacccaagggttgggggctggcctgtccctcatgacccaggcaggcggccagggctccccggaactccaggctgctgcgggtgtctgctctgccctgggtgaggctctagaagattcctgtggaagcgactgtgtctaggggagcccattccccagtttaaaggacgtccccccccatggctatccacatgcccagtcctctcaggaagttccaggctgccaggatcagaggaagcagaagccgctgtccttcagcaggaccctgcaaaagcaggatgaatcagcggggccattcagaacaaggttcaaattactgctgcacttttcagaatggagccaggctcagtgtttcagaaccagaggctgacgcggatcagctcgcacccagcctgggacctgagccagcccctgagtgccactctccacggccgcctcagagggtaagcctctccaagcctgcttcctcgccggcatggtgggggtggccctgccatcccctaggggctctgcgggatcccctgaacactacgaaaaacctgagccccactcctggccactgggtaaggacctctccgagcctttctccttcccattcactcccacccccaggcaggagcgaccagtgctgagaagtcctatcatcccacaacccatcatcctccgtcatcccctgtccgtcaccccgcagctgtcatcccccatcaccccgtgtctgtcaccccgcgtctgtcaccccatgtctgtcaccctgcatccgtcaccccgtgtctgtcatccccgtccgtcaccccatgtctgtcaccctgaaaccatcaccccatctgtcaccccacatccgtcatcccgtgtccatcaccccgcgtccatcacccccatccgtcaccccatgtccgtcaccccatccatcaccccgcgtccatcatcccccatccatcaccccccgtccgtcatcctccgtccatcaccccacgtccatgatcccccgtccgtcaccccgcatccatcaccccatgtccatcaccccacgtccatcaccccatgtccattatcccctgtctgtcaccccgcgtccgccatccacatcccatcaccaggtgctgttttcttggtgctagagcaaggtgggattcacaccttgtgtgcacagcttctgagtcactgggcggctgggcacagcctaactcaggagcagggacccacggagggtgtggcgacgacacagccctcagcttgctctccaggagttcttctgatacctcgaggacactctggaccctgtgtctgggtcccagcccttccgtaacaacgtggctcctctgaatcagtcacaaggaagatccaacttaacacagagagtttttcccaaacagcagaactggcagcaacacaggcatcctgcagttcagtccactgcatgcagcgtgcaggtgtcggagggcgaggctgccgtgggctcccggcggacggtggcagggcaggcccaggtctctatcacagcaaggcctctccactcggccccctccacctgtttacaacctcaagctgggtcaaaaccccaggggtactcagagggagtgtttctccccaactggattccttaagccagagggcaggcggcagggtcctggcctgacaaacacacacgggcccccgaacacgaccggctccgtgaccgtcacaggacgttcaggtggcttcattttcagtccacgcctctggtgccagggtcttgcttggcacttgtgtgaacggcgaccacgtgaagcctctgtcttgagaaaagtgtaaacagcagctgcctttcaaggcactgaggccttcctcgaactcagctcgtttgtgctgcgtggttcccagtccaaaccctcctgttcacagcctcctcttgcctcaagcatcttagagctccactccaatccacaccccagctgccttttacaaaatcccaagccaatgacagcttgaaaataaagtgagaaaaacaccgaccaacatttactcagcacctacggtgggctgcggacgttgacacagggtcctctctaatcttccatacagatcagccatgagggccgcggagaggagaaaagcacagctgagctgttttctcttaaagcaacataaacgtcaaagcaaaactggagcccaggactctctgacttaagctcatcctccttctgctccatcccggctgtgcacacctggagaccaggccctcgagcctccaaacgccgtgagcagcctcctcctgctgtggcttccaaagagacgtcaccagaggcggggctggcgcagggccacgaggcaggcgactgggtctctttgaccgggggtggcctcgcggcggcacgagactcagcatcgtgtgggtctagctctgggaatcgaggcagcccccagaacacccttggggcgcaacttcccggtgaacgtcccgtctcctcagccacccacagatgctgccacagctgcaccctcagggcaacgagcgtctggcggagcccagtgagagccgtgaaacacagacctcagggccaggccctctccccatcacagaaacctgaccagtcacaggtggctgcagcctgggtggttggtaaaagaaaaattattccttctataaccagaaaaaaatagtgaatcaacagacacagaaatgctcagaataaaacaaaaaatctaagtcagtgggacagaattcagcagtccccaggggggcctggaagctggacccctgctctgggtctacgggcttacatggctgccaggaccagggagagacagacccgggcccctgaccataccctgtgctgtaacgcctgcaaggtagattttaagtaatttaaaaattatcaaaaggataacatttcatgcctgtgaacattacgtgcaactcaaatctcagtgtctgaaataaggtgaaatggatacagtccggctcactggacggcaccgtgcctgcggctgcttccctgcacagctgcatgacccctggccctacacaggacaggttctgcgcactcggccgccaccttccttacacggcttctcaggaaagcagcaggcagctgtggcccagcgtgagccggcaaagcacttccctcccagagccccgtttcctcatcagcaacaaacacaacaagcttcctcccctggctgctgtgaggaccgacagcccctcctggcacctgcacagggcatgacacgcacatcacagccgccttcacccgctcagcctcccgcgtccccacagcccggaccggagcctcagagcaccaggacacacccatccggacaccggcaggtttgacaccacagactgtgcttggctggggagtgagaatcctcctgagagagccacggtgtcccaggtcgggggcagcagagtgagggtctggccgtgggccccggtcgggggctgagccacgctctggtcaggaaagacatcgccagacacctgtcataatccagggctgctcaaagtaaaaaaaaaaaaaacctaaaactgcaacatggaacggcacaaacgagctgcaggccgagttctaacgggctgagcctcaaaccagctgcaggccgagttctaacgggctgagccacaaagagctgcaggccgagttctaacgggctgagcctcaaaccagctgcaggccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagccacaaacgagctgcaggccgagttctaacgggctgagcctcaaaccagctgcaggccgagttctaacgggctgagccacaaacgagctgcaggcggagttctaaggagctgagcctcaaaccagctgcagaccgagttctaacgggctgagcctcaaacgagctgcaggccgagttctaacgggctgagcctcaaacgagctgcaggccgagttctaacgggctgagcctcaaacgagctgcaggccgagttctaacgggctgagcctcaaacgagctgcaggccgagttctaacgggctgagcctctaaggagggaaacgtcacttcctgcctcacacagagcccagcgtctccatgtccactgatagccttggtatttgcaactatgtccatgaccatctctgtttctccaaaacagcctctagctacataaactgtttagaaaacctcatgcgtaaagcagagtatgtcaaacctccatctgtggtcaggagttaggacatccccagctgcaatttgagcaaagacggcgcttccagaggatcatcggatcctgtgtcttggttggggttggggcccatcaacttaaaatagcttctgtttatgctggtgaaggaggcacagacttcaccctatctaattccaaggaacaggcgagggtgggagctgtagcggaagagacaaaagcaaaaggcagattcgcccctttgtgtggtcccgtaagtgacactgtccctccctctccctggaaacagcagcccccaggcaccccccccagcaactgggacaagggcacaccaggctaatttttaatcagatggatttagtgatagcaaataaagagaaggagaacaaaaccctcagccaggctattgtgaatgggtgttaccaaaaaatggcattagcagggcaccaggggccaggccagctccaggcagccccgcatctgctcagcaatccccggagtcttctagggggcctggggcagccggaacctggccgggtggaggatttctaccacgagaaagtcagggccctccccgaaggagcagaagctctgcgggtgactgtttgggaagctggtctgctcctgatactctgcaggaagagaatcacactctttagaccggggtctcagatttcagccggacgggaactctctgcagggccggtggaaagagatcgccagccccagctctgtaggggtgcggcctgcctcgagcacttcacacgcgtgcccggggatgctggtgctgcaggtatggggaccccgctaggagagccccgggttaagggttggtaactggagaatggggtgggggtatgccagctctccctgcttgccctggtcccacacactcaggcctgtgtggccagcgtggtcctcctttcccacagccaaggtgccccgactgccagcgtccactccccgtggggccgcagggtacaccaacatctgaggcagaggcaccgctgtgggctcatctctcagctcaaagggtttccaagagaatcctcagcaaaaaagcaacactcgccgttcagagagtgaatgagaggccagcagggggctgggaaggtgcttagctcagggagggctggagggtgggactaggaggcactaaaggcctgggggctcagagaaaggcccagcccatcccagcagaggccgaccaggactccagagcccgtggaggccctgccatgcacgggaagcctttcccgacttgggggcaggagctggagggctgggatgatcctaaggggatgctcggccataagccacatgccaagtccagagcccaacagctgctgtacctcctgggctgtttccacggatgaggcttctctgaatgtaagtttgtctgctcagccacaccggcctcctcctggcacatcgtctctcacaggcacctccttccatggagactgggggcctcagacggctcttcccgacagggccctgcacttgggcagatgcacctgtggcttgagctcagcacagcacatagtggctggcaaggaacggaaggagaattggagaaatgtatctaaaatgtcaagcagacctctgctacactcactgggaagaaccatgttgcttctgacgaatttcttaaaaagagagaaagatgccaatgagaaaaccagaggggacaaatgctacccgggaatgtaaaacagttgccatcagagactggctggctcacattgtgtccaccaatccacccaccacggcgagtgatgtccgtacagctcacaccgcatccatcaatccacccaccacggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtacagctcacaccgcgtccatcagtccacccaccatggcgagtgatgtccgtatagctcacaccgcatccatcaatccacccaccacagcaagtgtctgcgatgtctgtagtgtctgcgatgtctgtagtatctgcaatgtccatgcagctctcaccatgtccatcaatccaccccaccacggtgagcgtctgcgatgtccgtgcaggggagagagacctggcctatcctcagcacagcccatgtgacgttagaaaggcaaccgcaaattcagctgcggagtgcaaaacgaatttcctcctgtcacacgctaactttctgttctggatttcctggggtttcctttattagacttgagtccagaactcctctagaaacattctctgggatatcttgacctggcacgcagaggggtgaaggaacggggacacggatggatggagggagatgaactaatcagcaaatgctccttgcacatttcctagctctgtcagccaaagtgaggtctgaccacaaaagctacccattcacttgctaaatggtgcaaaatgggcccagaccctcattttacctttacttaaataacagcatattctcgtctggtctttaaaccacacaggccaaaatgagttgagcactatcacatatttaattgactcgtaaaagcaacttgtttttcttcatccttcgccgacctttgtttatgggtaacccttgataacatgtgggcagggtttcagtgtaaacccgagggcaggttaaacacgctccctccaaagcttacttggctttgatttttcaaccacccgccctcatgtgcagggacagggcagagtcgtgaccaacagtggaaagacccatagctcccagctccagggacgacgcgggggtgctaagctggtaagctgggaaattcccgggcacgacccctggccgtgggtgaaagcacccccagccccacccccagctgtgagatgctgcaggttccccagccccacccccagctgtgagatgctgcaggttccccagccccacccccagctgtgagatgctgcaggttccccagccccacccccagctgtgagatgctgcaggtcccggcaggagaaggcttctccacagagaggccgctgaacaaggcacagggccaggtctggccgtgtaaaaatacttggaacccatggggggctttgtgtgtggtgtcatcggcagcttccattatgtccagcggtaacatgtttacggtccctgtgccgccgtgcggtagcagttttcccgagtgtctcctggctgggacggctggtgaggatgtgagttcaatagatgaacaccccaccttggtgacacagaggctggacagtcacaccgacccttggcccgggcgaggccacgtgtcccacaaaacataaggcttgggttagtgtcgggcacgcgggggaggtgcctgcctgcgtgaagactggtcacaagacaacttcccagtttagaaaatggttaactgattcattaatactcacttcctgtcgcaagagactcatgccctagagataaagccgtcggaggcagagtgcaggcctcgaagcagctggtcatgtccacgccctctgcaggcctcgtgtccccctcgctgtcgcctgccgatttggtggctcctctcataacacacagcctcctgtgtatgtttttaccctacaaacgctctctaaccggtccagaggtcagaaacagccgcagtctcctacctctattgcttctcaagggaaaagcacagcctggaatgatgaggagcccccacgccttctcagtctcctgtaacgacgttgctacagatgtatgtgtttgtgtgaagctgtatttaaatgtgagattattcttcttggttaatattttactttctgtcataaccagcaggcttaaagaagaaacccaaacgctctgtgaatgggacatgtgctcagaggcgtctgcagttgaggcgggtgacgttctggggtccctgggaagttgtcatcaccctgctgacatgagtgtggatgttgaggcctggagggtgacaggtcacacagccagagcctggcagcagcgcaggggcggaaccccgggtcccctgtgggcctgtgccctctcggccagccttgcaacgcgcagctaacgctcttcaagaaaacattctctggaggaatcctgctggtcctgaagtttttggccttgagaaggtcatcacagacacccctcccctcgggccaggcctgctgtcttgtctaaggggccctattttatctgaggtgatttgcaactctgaaacacacatacataaaatagaaataccgtcctcactattaacctagagacccccatccctacccctccctatgaatgctttttcataaacatgccgcattctgaggaatccgaaagactccagcgtaggacagaccgctgttccaagccactgggaaaggggaaactggtgactgagcggcgcccgtcagagccattaaaacgtgagggaaaactgcaccttacggcacacgaacccttagaagaggcaaaacactactgagttaatgcttaatttatttgtaatgataaaagtttttatcactttaaataaagttatttgaaaaaagttattcaatggcagcctaataattttgcttaatgaaaaattaactctgcaaatacagtttccactattcacatggagcctgcaggtttggagaatcctctgcatcagtgtgggtgagcacgtgtgtgaggggtgcacgtgtgtgaggggtgcacgtgtgtgaagggtgcacgtgtgtgaggggtgcatgtgtgtgaagagagcacgtgtgtgaggggtgcatcagtgtgggtgtgcacgtgtgtgaggggtgcacatgtatgaggggtgcacgtgtgtgaggggtgcacgtgtgtgaggggtgagcacgtgtgtgaggggagcacgtgtgtgaggggtgcacgtgtgtgaggggagcacgtgtgtgagggatgcacatgtgtgaggggtgcacgtgtgtgaggggtgcacgtgtgagaggggtgcacgtgtgtgaggggtgcatgtgtgtgggggtgcacgtgtgtgagggatgcatgtgtgtgaggagagcacgtgtgtgagggatgcatgtgtgtgaggagagcacgtgtgtgaggggtgcacgtgtgtgacagatgcatgtgtgtgaggagagcacgtgtgtgaggggtgcacgtgtgtgaggggtgcatgtgtgtgaggggtgcacgtgtgtgagggatgcacgtgtgtgaggggtgcatgtgtgtgaggagagcacgtgtgtgaggggtgcacgtgtgtgacagatgcatgtgtgtgaggagagcacgtgtgtgaggggtgcacgtgtgtgaggggagcacgtgtgtgaggggagcacgtctgtgaggggtgcatgcaatgctcctgtatgcacatctgtgggtgagcacgtgcgtgaggggtgcacatctgtgggtgagcacgtgcgtgaggggtgcacatctgtgggtgagcatgtgcgtgaggggtgcacatgtgtgaggggagcacgtgtgtgaggggtgcatgcaatgcttctgtatgcacatctgtgggtgagcacgtgtgtgaggggtgcacgtgtctgaggggtgcatgtgtgtgaggggtgcacgtgtgtgagggatgcacgtgtgtgaggggtgcatgtgtgtgaggggtgcacgtgtgtgagggatgcatgtgtgtgaggagagcacgtgtgtgagggatgcacgtgtgtgagagcacgtgtgtgaggagagcacgtgtgtgaggggtgcatgtgtgtgaggggtgcacgtgtgtgaggggtgcatgcaatgctcctgtatgcacatctgtgggtgagcacgtgtgtgaggggtgcacgtgtgtgaggggtgcatgcacacacacctgtaagcatgtgtgtgaggggtgcacgtgtgaggggtgcatgcacacgcacctgtgtgcacatgtggatgttgccgtgtgcacgtgtgcacaccaagtgtccgtgagtgcacgggaacagccgtttagaagtgccttaatcttcccgagcacaatagtagctcacctctgcaaggaggctgaaaattctcattatgagtctcataaatacgtggccacgttcatgggtttgtcttatttatcccttactctataataacttggaaggcacagccaatatttcccttatatcctgggacagccccagttcatggctcccgacgactgcagctgcctcctgggaaccccaggggggcaaactcaggcccacccccgcctgtgtgactcaaaccccccagccaagtgcctgtgggaggacattttagtgggtggggaagcttctgaaaaatcactttactctaactaatatttgtaattaacacatcaagtaaaactaaaagcttttgccttgccgttgttgccttttggtgggtgacctcaaaaagtcatccatctcacactgactctatcacatcccaactctagccccaaatcctaataaacacaccagttaagaatgcatggcacatttttacaagcctcacaactttctgattagatgcatagaaatgtcccaaatatttctgaaatattttatttgaaaaccgatgtcaccgccacttttaagccacaggcattacactaaaatctggactagcgtctaagcaagtggcagcttttgagctccgcacactccgtgtgaccatccacaaatctatgatgaattattaaccagaccaggctagcccactgcctggccttctctgctgaaagtcagcagctgtatcctgcctgaaaaacaccagcattcttgtgttcataaaacccgctggttccagtgcagctacccagagggaagccttgggtgtgggcagcgacaggggtgtgggtgccaccgtggggtcccccagaaggaaaccaggggagcacagaactaaatggtcacccatgacaatgaatcgtgatctggtgggaagaaatcaaagtgcttttatttggagatgaaattggctgcctgcccctccctctccaccccccgctttcctcctgacccacccaccccagctcttttccccggcctgggaagggcacatggagggcagaaagggcttccctaaagaaaacacagaaatacactttataaagcaaaataaacttaaaaaaaggcacttagcaaaaatgtagtgagaagtgttttttcctttccagtctttcattttcactcagcatttccataaacacattcttgggtccaaatgctgagaaactctttctctaaatactggaggagcgctaaatggagcaggaaatgatggagagagaaaggaatgccactgattccagacggatgggaccagctggggaattcaggaagcggtacggaggtcccggagacaactgctcacgcctctgaggggccgatcgctcaggatcccccagcagcagcgagagaaccagcagggcccccctcccctctccagccaggcgtcgatcagtgcccccctcccctctccagccaggcgtcgatcagggcccctccctctctccagccaggtgtcgatcaagtcctcaccttctctccagccaggcgtcgatcagggcccctccctctctccagccaggcgtcgatcaagtcccccccttctctccagccaggcgtcgatcagggccccccctccctctctccagccaggcgtcgatcagggccccccctccctctctccagccaggcgtcgatcagcgcccccctcccctctccagccaggcgtcgatcagggcccctccctctctccagccaggcgtcgatcaagtcccccccttctctccagccaggcgtcgatcagggcccctccctctctccagccaggcgtcgatcagggcccccctcccctctccagccaggcgtcgatcagggccctccctcctctctccagccaggcgtccatcagggcccctccctctctccagccaggcgtcgatcagggccccccctcctctctccagccagacgtcggtcagggcccctccctctctccagccaggcgtcgatcagggcccctccctctctccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagccaggcgtcgatcagggcccccctcccctctccagccaggcgtcgatcagggcccccctcccctctccagccaggcgtcgatcagggccctccctcctctctccagccaggcgtcgatcagggcccctccctctctccagccaggcgtcgatcagggccccccctcctctctccagccagacgtcggtcagggcccctccctctctccagccaggcgtcgatcagggccctccctcctctctccagccagacgtcggtcagggcccctccctctctccagccaggcatcaatgccgttcaaggggtctggaccaacaagccctggtggagaacaatccccacagagaaactccgtgtgaccctgccccacagataacacggaaagggacttttcatggtcagaacctactgatctagaagtgatcaaacactctcttctcctgacttcctgtcaccaggcacgggtgaggaggaacaccagcaatttcttactaattacggctcaagcaccaatgtttgtccaccgttttcttctcacacagatctaagaggatcaagatgattcccagagtaacatctgtctcatttgaattccagtgtgcttccccgagtggcacagccgagctagtcttgggctctggaacagtccaaagactggggactcccctgtaacatgcagccacctaagagaacaggtcagtgacaagtagggggaaaagctattaggaaaaagaacaagttgtgggcctaaaaacaagatgtttcttatacaaatacaaaatactagaaaattgcacagcagttgccagaaaagatcccaagttgtggaaagtagaaaggcaggtgcatcccagcactgcggccgggggcaggaggccacccgcggggcattcggacccccgtgccccaaacacatcccgccgagcctcctgggaccaggcccctgagagccacggggctgtctggagagtgtccccagcctcagccatgtggggtagaataaaaatgattaagaactgcttgagaagttttaaactgcatgcagcctactcagcacagattggcccgtgtcttctgccacggatctcggctaaaggaaaagccaacagaagcccaccggagcctcccttacctccacccaacactgcacatcaagccgtgcaaccctgccccaaacggtcccagggtcatgggtgtgcatacatgtgcatgtgtgcaagcatgtcacaagaggagacctccgaggaacataaggatgcggactcctccctcagcctgaacctctgtctctcaggcacagctcgacctttgaccttcggcttccccagagaaagactttgaacgcttcactcctctgtagccctgaggacgcgggcggccagaccagtccctgagtgcggcaccatggccgtgtgagtttatggcccattgcgctagccctgtacagtgaatgagatactagttgtttacagctgtgagcatacacaggccccccgccacacgctcaggaaggagcttctcggaatctctctcctgcctcgcaccatgcagccgggctagcaggtttgtgggccgagtgcaggagcctgctcccactgtcactgcaggtgactggctgaggggcacacagggcccagaggctcctacctccagccaccgcccctaaactaatgaagattccagtccgtggggcccaccgcaaatcccagaatctcagcagtcagtcttggacattagttgtcggggagggagaggatctgggaggccaggcgtcccttccaggctgcgcagccggccacggcggcagagcttccccaggctgctccagccttcagggcccctccgcggtcagccccacccccggccagcaaggcttcctgagaaggctgagcttggcacctacagactgggggggatctggaattccccagaaaagccctcatcccaaagcccatgggaaaaccagccctgttggagcatcccacccggacctcggaggagagtccggcatggccagtcccctgggctctgcatgcagatggttttcccagaaccggttcctcttcctgaatctctgctaatggccctgtccatcagtctgaccccagccttggaaacccccatgcagcctgggccagaatgaagtaggcaaccagaggctcagggtgcttggggccgaaccacccccagctccaccacctccttcctgcccccgagccgtgccttcccccgctgggtgggcttgctctgcatctgggagcacctgggcccgggggtgcaggtgggttcgcccctgcccattggagggaaatgttctgacatggaagcagagggcacagcattcaggagaaccagtggggcctccacacagggggacgcagctaggaagggggtctccggccggtcggccccgagtgagggacgcagctaggaagggggtctccggcaggtcggccccagccctgactccaggcctgtgcatctcactgctgcccaaagcaaggaccactggctgccatgacagctgccacagtgctgagcaggcccagccaacgctgcatgagaaagggctctaggaaggaaaaggccgcggcagcacccagcctcctttctgaggaagcgattccacgagccacaaaagcgcctgggctgtggtcatcagagtccaccacaagacaaccttcctgggtccctacaccctggacacaccttcggtgcgtgcccggcatggagacgctcctgctgccggcatggctttggggacagcactttgctcctggagcctcagaggaggggggccggaaacatgtgtcctgcacagtcaccaccggacgccgaggtggccgccccagcaggggccatgggctgaggctggtcctcaggctcccagagcaatggctgctctggggaagagaaaacacagaagtgacaagatcaaggcaaactagctgctccagcacctcgagggtttggaaccaaaacaagaaatctccagagctgaaaagaagagtgaaaccttttccttcagaaggaacacagctaaagagaagatttaggggtgcacgcaagggccctcaggtactctgtgcagcccctcaaagcagggaaaaggccaggaatgaaacctaacgcagaaatgggaactggctccaacgccacacgaacagccagcctgggtctatcgcgcccagttcagacccgggctgcagcttggagacgatgacgtccaaaaaccaagctccaggaagacacaacaacaatcacccttaggctttgtcaggcatcccagagaatcctccgtcctaccctgggcacgccatgcgcaccaggcagggagggtggctctcagcaaggggctgaggactctggcccatcctggggcgagggaggcacccacggggtgggccatgcggggctgggagccacggcccccatgcaggtcctaagtggacatctgtctggtcggtggtcagaaaaaggatccccacggtgtctaggaaagactcagacctcttaccaacctctggaattttatcctatgggcagtcagggccaagacagatgattctttacaggttggaaattattcggataacataaaagaaacaatgtaaagaggaaagaacaggtgcaggagtcgttcctcgatcaattccaggtcaaggcaccggtttcggtccccagtgcggctcctgtctcctgacccagccccccggcccagcccccagaagcccggcacggtgtctctcgggacccaggacacgcaggtcagcgctgcagccgttactggctgtgttgtgataccagcagggcactgactgtccccagaaggaacaaaactgagacttaaatttgggtgattgttccaaatgtgggattcaagcttatttgaaaacgaaaactaagaatgccaaatttcagggtggctagagctacagccccaggaatccagccctgtctgcagaaacacacctaatattttcagacactcatagaacaaggaactactatttttgagaaaatactcacagaaaaacaaaatctcccagacactctgatgccgtttgaccaataacccatggggaaactcacttccggggatccaggcccgacgagggcgttcccgggcacctcggtgactctgaaactcatatctacagcaaagcttgaacgtttgtaactgttcactttggactctgcgtcacacccagagagaccctgaaccatctgtcacaggtgacgtaaccctcagttccccttcacctgtgccagagcctcccagacacaaaggctggagccccaaaacctgtcaggggcctctcaggggccagccacaactcactccgcctgtcactgctggacgcccgctgcggcctgacggagccgctccttcacctgtccacatgcatttcccacacagcacattgtcttgaatgaaggcaagttattttctttctcggccttggcgtcctccacagccgacactgttcttgcaatctgtgaagggatgatttctaagctccgcctttgttcttcactcactcacccaccgtatacatagttgcacattgatgcataatagacatatacttgctgctacggaaggccttgtattcctgtctctcttcctaccacagcactcctgccatcccacaggtaatccaattagcaggctgtgtgggtcttatccctgatctgcgcacactcatctgatctgtgtttatcattcttctagggggtggtgttgggcgctctcattttgcttcttttgaatcttatgccgtggaacttcctgcgagtcatgtggtttggcctgggcttaatatgttccttgaaagccacagagcagcccacatgtggatgcacatgacataatcaccgtttcagttggcgattactcattgggctgttcttgcattgctataaagaaacacctgagactgggtaattcaaaataaacgaggtttattggtcacggtgctgcaagccgtacaggaagtatggaggcatctgcttctggggaggcctcgggaagcttccagtcatggcagaaggtgaagggggagcaggtgtctcacacggcgagagcgggggcaagagcgcgaggtgggaggtgtgccaccggatctcacgagaactcactcactatcgtgagaacagcaccaaggggatagcgctgagctgttcatataaatccaccctcaagatccagtcgcttcccaccaggccccacttccaacgacggggtgacagttcgacaggagattggtggggagaccccaactcctcaacattgcttctactgtttgctatttgctcactcagccactggccacaggtgctgctgcagtagacacgtctgttcatcgccttcacctatggttcaaagctagaagctctggttgcacggcaagcccctcctttcctgcgtgaacacagacccctgctctgacccgcggctgcgtaagacgagacgcgctcagtgagctgcctccccgacccccaccacagttccacaacggctgtccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgcccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgctgtccaacctcgcaccctccagaggtaccggcacctgcggggcatgacaccacatccccacgggaccccgtgtggccccttctgtcaacccatcggccagaggcccatccacacgtcccactggcccctccagctaacttatctgggcccctcaaaggccaggccgtgcatctcataacaccagcccaacccaaatgattccttcccttcctgagacctcactctctcttcaggggcaagttcaaagctacccctcccagaccccctccaagatgacagccaaaaccaaagccacctctctcttcaggagcaagttgaaagccatccctcccagacacccagatgacagccaaaaccaaaaacaaaagccacctctccagagtgtgagctctcccggatctcaacaccctcctacttattaaagtgtagctctttttcaaattatatatttgcttacatagaagtccagttcattacagacgaacagatagcttcaaattctgctagaataatacctcccatctatgaagatctgagcgggggaagtgcctggtgcatctaagtcccattaatctctgcaaaagaaggccttggcctccactttcacaaaccaagaaaccaaggcagagagaggttaggggtcatctaaaatcaaagaattgtcaagaaacgtggccagcacgcagtctcgggtgtctgattccaagtgggttcgctacgtccacgtctcccccgagggcccccaggagctctcctcctcaccaagcccctcccaccatcgctcagcagccttcactttcaaaaccttagcagccatcactttgcttgtggctgtttccagccaatacgtccacctcctttctaaacacacacacgtctatgtttaaaacatgacgcgccacctgcaaacacggtgccacagcctcagggagacgccgctcatccactctgcgcctgcgcggttcacacgctccttagctccaaatgcctcatttgcttccattagctccaaagaagcaagtcaaagtgttttccaccaatgccagattcccttccaggaatgacgcccccagggctgcctccggggtccacactctgcccaccagtccagcaccctggctgagtccacctgccaggcaccatttgctcacacacctgaaggctggatgggtggctgtggccctgcttaaaggatcacctctgcatctccaaactgtcttcccagcacaccctgtgtcttgggcctcccaggccactgtccacccacacagaccagcagccccttccttccttccctgcctgaacactgcctgcctcgtgtccctaaggtcaccaacaagtctctctgttctccagccctccatgattccccccattccaatccaagatcacagagaagaaacagctctccaaactgacaggcaggctgcagtggtgagcacctgtgtcccagctactcaggaagttgaagcaggaagatcccttgagtcctggagttggagagttggagaccagcctgggcaacacagtgaggcccagtctcaaagaaaaaaaaattaatggacaatactaagtggtgaggagaagaactcggatcccaggagcccgtggagctggggtgcttgggcccagataaatccgtgggtctccctttctccacctcagtgccgtggagtttccagagtttagataaaatgagataatacatggaaacgacgcccttagcatctgcatccagcctccacacccacacacgcacaagaaacccactcccctttccaggcaaggcccgggccccaggctgaacctgcccctgccggagcccctgctgtttcccaggtgcagccaggccctgcaccttcgtcctcaggggttaaaaatagcacaggcagcttagctgagctcggttaataaaatatccaagttaattttagcattaggggaatctaggatctctgatgccaaggcccatgtgtggccacacagcccctccttacactgtcagacagacacggggaaagccacggcgtggccagtatccctccctcaccttcacaaaacacttctcttacctgagtgagccctagccctctgaagacactgttgctactttctcttattaaacagaccatcacctaatttgatgcctgtaacagccctgtgaccagcggcctccacctcccgtgagggagtccatcaggctgagagtgtcagctgccacttctagcagagctgggcccggagcccttaccttctagcccaggagctggggccagggaggcacagtccaggggaccctccaggcaccccacttgtcattctccctattctcacccggtgccacctcctcctgcttcaggtgggattctgtttgtgatcaggagagggatagctggggctggaggccggcagcccctggccctcactgccccacaggcctgcaggcaccagcggttcaatgttgggccagaccggccgtgggtcttcttcacggacaagctccagcctcacaggaagggagcaagagcccagcggagccacaggcactgagcccagaggagaaagaagggagcgaccagagagccacaggaagccccagcggggagcccacggcaggcccggcctcccacggacggcattcccggacgctgaccgcctccagctcgacggcagggtcaccgcggtgcgagagcctttcccgccctggaccgcggggctggctttttttttttctgtaacagattgagagaaacaccttgtgtgttgctctttattgaacacatgtatcaagataaggcgccacatttaaaaacaagcagtaagtattgtggaaacggaagacatcactgcgaggggaggaggcactgcacgccttgggggcgggggccccaaaacaacgccgtggccgtggcggaagtgccctccctgtgggtccctgactcatggaaagtccgaagcacaggcttcctcaaagcagcgatcgcataggaagtgtggctcagtcatgcatgatacacagactctactgtgaaaggttaatgactgtttcaaaagacacagtgtttaagatgtttaagtgcacagaaggacatatccaaaatgattccacaaaactgaaatgcagaaagccagattcttcaagacaaagactccaaattgttaccaccaaagcacctcacttctacgtggcgctctcctcttattacctcacctgcaagagctggaaggacaaagaaagaggaagggggaaaggaggaagagattctttccatttttcccaatgtcaacgtctgaatgaggccacacaccaccacacatttcaaagctatttaagaatttaaatggccaatgcccctataccttaaaaaaagctcccaatccccccagaaatgtgctggctttttttcttagtaagagtagtagcagaattgcttatggtataactttagggacaattcttgttctgggagtgagggggcagggtgttaacttaaccctgaacaacactgccttgtacgttcccaccggatgtagtagacaataattgcctggcttttgcaaacggaaaaatgaggttatgaaggggaagacacgggccctgggtcatgcagcaagtcactggcagactcatgggcaaatccagcgctcctggagacaaggctcagaggtgaatgacagcgaggggccctcaaatcaaccacaggggcaccatcttgtctgagccttcaagaccagggactcaggcagggcaagtcagagccaaggttggccatgaatgtggattaaagaaagagcctgaggggctcagtggccccctggcaccagcgccgctcagggtcatcctccacttcgcttctacagatgggctttctgctggagccccggggtatcaggccagcagcacagttacatgagactaaccccaaaccagcgcacccacaggtcaccctcagggtctccagcccagactgcatctctgctcaaatgcaggaggtgccctgtctccccagctacttggggcacagatacccctcaggcagccagccctgcaggtgacctctggaggggagaggaaacggggacttcttgctggagccacatccagagagtcgggcagctggcatttgggcctctctacccgtcctcactgctgctgcccctgggagggtcaaaggttcagatgatatccaggccccacgtgggattagcagcctaagcctcagctgagccagggtttcactggcttgtttaaagtggagcacagagcctgaccaagttgtggcatctccaaacctccttctctccgagggatcctccagggtgcctgacccccacgcctgtcggaagtggggccgagtgcccgcaggccggtgaagctgccttctgggagactcagggtctgagtatctggtctgagactctggtcttccctcgccctcctgttctacttcccatgccttctgtaaagtcctgccgtggcctgaagtgtagcccttcctggagtacacagcgagcatgctgtgccggctgtgggccccccacccccgagccgcaaagccccaggccgcctctgcctgctgcctggagacctggcactgccccacaggggcacccacctccagccctcctgcccccgtgactgaggaagcccagtgcttctcacactcctcagactcgctggctgagccaagcagccttggctgaaggaaagagcagcaaactgacccccacgggccgcgacctttccccacccaggcaaggcgacctcaggcacttcagggagcgccagctctggctttcttgtatgaaagtgacagcggatttaaaccacattaacaaaagaaatccctcctctctggactactcaaagcggaagtgctgccacatcctagctgcagcgcttctgggccaaatatcaagacagtgtctcagcgatgatccgcaaaccaaaataaagccgacaggaaacagcccgctggtttaggggagctggaatgcctccggcagcatcaaatgtcatcaacaactgacactcagcccgttcccggaggcctcttcacacgggaagaggccggctgcgaagtgcggctcagtgggggagaaggaccgtggggaccgcgacactgcaggccctggaagcctctccagcctgaaccgcgctgtggtccagcacactcatggcatgaatatggaacagtcactccaggaaacggtcttgctctgggggagggggaggacttccacatcactctcccaagataaaacaaccagggaaaagcagatccctccagataaaccagaagtccagacacagcctcctctccggaaacgcctccgggagcccacttcagaagctgctgaagcccagagaaaaaccgcagcctcgcaggccctggtcgccaccagctcgcccgccacttctcagtggaaagggacgtggtgccgatgggtccggggtctccccgccccgcgggagccctcagccagaacgccccaccagcacacacgcacacatgcacacacacaaacgcgcgcacacacacgcgcccacacacaaatacacacgcgcgcacacatgcatccacacacaaatacgcacccacacatgcacccacaaacgcacgcgcacacacaccgcccacacatggacacacaaacacaagcacacacaaacacgcgcgcacgcaggcacagacgcgcgcgcacagcagcagcagcgcgccggggcctcacgcccctggggagaagcgtgaaggagcctccacattccccggaaaggaagtttctgggcgcagcggagaaagggagatgccgagaccccgacgtcagtggatttgacacctgaagtgcaggcgcccagacagcctcaggcgcgcgcactcctgcaaacacgcggggcacacgctcgggcgcacacgcggacagacgtccctcggcgcagggaccccacctcctccgccgctaccagggaccggggccgctccgggcgcagaggaggcgcagggagccgcgttaccccggagccgactcgacccagcccgaggcccggggaggcggggaggtggggaggggccgcggagccggaccagccgttctccggggagcgcgccgcgcctggagggcgtctccgccggggtccccagcaaggatctgcggaggggaggcgggcgcgggagaggacagggtcgggccggggggtcggacgcgtggctgccggcggacactcaccgatcttgatcttcacgctctggaagacccggagcccctcgtcctccaccgccatgctgcgcgtccgcgcccgccgagcctcgccccaagcgcgcgccgagcccgggcagctcaggccgagcaggaggagcggcggcgccggagccccgagcgcggccgagggtccgcccgcctgcaagaccgcca

SEQ ID NO: 1653 - DNA, 196677 bp, Homo sapiens
cagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaa

SEQ ID NO: 1654 - DNA, 196677 bp, Homo sapiens; identical to SEQ ID NO: 1653

SEQ ID NO: 1655 - DNA, 26888 bp, Homo sapiens
gggatgcaaaagtgttttactaccaggagttcacaaatctgtggacagcacaccagtgaggattccacggtgttggggaggcaggcagggtggtactcatgacccagaggcagagacaggagcaagagcccttgggcccactgcacccacagcttcacattgtgaaggaggccgggagaaggggaacaggcaggggtgggaagcagcccaaccttgggttttggaaaaagattgcatagctcgttaaaaccctgacctcttttttttttttccgctctgtcctgggtgaccagggtgtctgccagcacttggacacgtcagaccccaccacctcctgttgggttatctgcttttccctctttgggggggtggggagcatttctggagtaggaaaggactggggcatggggcggggtgcggagggcctggagagaggccatgggtcccggggctggaccacagcggggctgtgggaagggtcctaaccttcacaggcccccttcctggttaaggttttttttttgctgaaagggccacaggatatatttgtggtgtaaaccccagaggctgccactgctttcctggggagcttggaggccacacccatgtgactgcagggcaggatggtggacttctaggcccctacagcctcggcagtgtcctcagatccggatgtggaaagtgctagaaagagagaaagggcaagagagggtgagaggccctgggtcgggcaggtaaaggctcctcagggaaaagcacagcaggccccagccccatgctggacagtgcctcattagggaaccctgcatagtggatgcaggtaatcaacactgggggaagacggaggaacagcggtgcccagggagttctgcccccacttatcactgaaggggcccccaggtcttcaaccttccccctgcaggggacaaaggccagtcacacgtctagggcaagggtggcttgaacgtgacctcctgcttcctggccgcacaccactgctcacaaatagcgagtgataggggcctcagccccaacatcccggcctgccctgctctgccctgcccaagcccggcccctgtagtggcagcacctgaggaagtcaggggccttggcaatcatgtcctcgaagtcagcaaagcccagcttgccgtcaccgtccaagtcagcctcctcaatgaccttgtcgcacacaagcaccacctcctcctcatccagctctgacttagtgagccgggccagcgtcagctccaggtcctccttgcagatgaagttgtcagtgttgaagtctgtagggcaggggttggacatgttcaagtccaggctgcgtgcacccagggacccctacactatagctcttcctcctagctggccccactacctccaccagcttctgatgtccccagagcatctccatgcacactcttgggatactggatccctgcccccaagagggcttacccaccaggcatcgcttaaacacccacatccaccaccaacaacaaccccacaatgactaaaccacatcctgaagcaggtcaaaagtccaaatctgaggtttcctgagaacttcaggcttaggccagatagcccttcctggccttagcccacagtggacccagtgttccctttagacttctagagctaaggaaactaaggcccaaaaaggccatgcgattgaatcaaggtgggagagccactcggagatggagcagggattctgactagggcctatgggactctaagacccatgttttctaaactgcaccccgttgcctcagtggtgtgtgaccagaagacacggtgggtcaggagactcaaaatcaaaagacccttagagaggggcctgtgcctggcctttgtgcacacagagcagggaacatggtttgattctacccagcaaaaggcactaccactgccccaaagcacagcaaaatggttcagaggaccgagccatgcctggccacatcaaagtgaactctctcttcttacattttgagcccaactaccagatctgcgcatgtgctgtttcttctgcctggggtcccttcccagcaaactcctggtcatccttcaaattttggctcacacatcacctcccagtggcggggctttctagcgataagggtcctcttccccgcaaatgagcttctgttgcccattggcaaactctgacattaatggtagtgacaaagacccatcatgtgagcattatatgctctttctcatttaattttcaaaacaaaactatgaggcaggcacaattgaatctccactatacacatgaagaaacagagaggtggccaggcgcggtggttcacgcctgtaatcccagcactttgcgagtccgaggtgggtggatcacgaggccaggagattgagaccatcctggctaacacggtgaaaccccgtctctactaaaaatacaaaaaaaaaaaaattagccgggcgtggtggtggacgcctgtagtcccagctactcaggaggctgaagcaggagaatggcgtgaacccaggaggcggagcttgcagtgagctgagatcgcaccactgcactccagcctcgttgacagagcgagactctatctcaaaaataaaaaaagaaacagggaggtgaaaaggagaggtacctgcctgaggtcacatcccggtcattgttggaccctagagcccaagctcttggggtgactctgccctgtctatctctgcagaggcctgggcacaactctagggtatgcgtcagggagtattcatctctgcccatggcatgggacatagcaaatctctggaaagatttgctggctggctggctgaattcctgtggccatttaacctgagtaaactgaggctcagaagtgagatgatcattgttgcaaatgaggccccaggcctccccagcgccagactaggagggccctggctgcctctccccactccacccccagcctagagcagcaaggaagccacagttcttccatgtattcctgtgcccacccggtccatgcgatctgcacgcccctgtcttgggcagacagcagcccgtcccaggagcaatgctatggggtccaagaccgggcggatgttgggtggaatctgagaagctttttacatgagccatgtgggcatagtttgtggagggcagactggcaggtattttctttctaatatgcaagcaaaacgtgggtgcacagacagaaaccaaagtcctctgaaataaacatgataactagaaagtgaaacgtcagtctgggcgtggtggctcacacctgtaatcacagcactttgggaggccaaggcaggcagatcacctgaggtcgggagttcgagaccagcctgaccaacatggtgaaaccccatctctactaaaattacaaaaattagccaggtgtagtggcgggcacctgtaatctcagctactcaggaggctgaggcaggagaatcgtttgaacttgggaggctgaggcaagagaatcgcttgaacccgggaggcagaggttgcagtgagccgagatcacacgattgcactccagcctgggcgacagtgggactctgtctcaaaaaaaaaaaaaaaaaagaaaagaaaagaaaaaagaaagcaaaatgtcagcccctgataggccctgctgcctttgggatccagtgtctgatcaaacgtgctgaggacaggagctttgaccttgactcttcaggtccaagttgggtcccagccccttcctaggccttaggcatctcaactgaggtctatctgaggatttgacaccagtccccatgggtctgtcaggccagcagagggggtgagctcgtgggtatgaagttttctccctgtggctgtgggagaagcatgagtccttggctcatgagtgcccgccgccctctggtggctggtgagacagccagcctgagggcagagctgggcggggtgaatccaggtggccctacctcaggcagtattcgggggggctccagaggcccccctgcaggcctggccttaccaccatggcctaggcagcctctctggctcctccattttacacctcaaagctgctgagtgatccttctagaaaacagagctgcccttcctcactggaaaccttgcagtggccctggtgtctggatcactaggtccaaactctgtggctggctcccacagcctggccccagattctctccagactcataccgccccctgtcccaccaccttccaagttcctcccatctccttatcaagctctgcgcttccctgtgtctgcatgggctgcgccctctgtcaggtctgccagccccctcttctccagtccaagcctctgctagtccctgcttaaaggtcatgcctgggacccctctcacactaaccacccgacctgggatgggtgagtccctccctccttcgttctcaggaccctcacagatgtctctcagggactgatcgtctcccttggccaccccactggacaggcactcttcagaggacagatcagcttcactgttcttggtgtccctagggcaggagccagtagtaaccagacagcctaagggccccacatgttcccccaccgcatattcaggccccctcctctagccctggttaccatagatcttgaaggcatagtttgccttgagctctcggggagccgactcgcagagcacggaaaacatgtccacaaagtcgttgaaagtgaggttcccctcaccatcctcggaaaacgccgccacgatcctttctttgaagggattctcctgaagaaaacacacacagcaatcactgtgggtgcaggataagcaggagggccccggagccagactgtggacagcctgtgtgaccctggaggagtgaccaaatccctctgagcctcggtttccccatctgtaaaaagggaataataataacaccttcttaattgggttgtgatgggattaaatgagctaaagtatgtaaggtgttggtaccaggcccggcacatgtaagagctcaggaagcattctactgggtcatgtcacatcattaagatgggcacagccagggacagtggtgcacgcctgtagtcccgctatttgggagactgaggtggaggaatcacttgagcccaggagtttgaggcttcagtgagccatgatcgtcccactgcactccagcctgggcgacagagcaagaccatgtctccaaaaaaaaaaaaaaaaaaaaatgctgagcacagccagtgtgttatcactggaggcactgcctcatctgaagcagaagcagaagcacagattcgtcctgttacccagaagagcacacagaggctctgcctggatgtgtagggctctgtccccagcagaagaagatgacagcccagggcactggtggccctcagctcaggccgtgtcaggccaggatcgtgggaggtggatgtggggtcagataactggaccagtcaagcagcaagagccatacagccagttcaggcccaggtctgctgtcactctgctcctgtgaattctcccctagaccaccttggatgctgcctctcccagggagctgtacacggatgccttcctagatccccaaatcactcatcctgcagcccttccatcccaactgagctagcgcttggctagcgccattccgtgcccagcccaggccagtgcgggaggctcagagacagaccacttgggtcctacccatgagtgtctcacctgctccagcaaccctctgagcttgctcttgagccccttgctgggccagacggggtgctggtccagggctgagcctggggcccattgtctctcaggactgaggtcacaaccagagtgcaggccccaagtggatgccatatagcactctgactccaccttcaagccacacatcccaggcctggcaaggggctactgacgaagtcccactgcaatggggagttgtgccccaaatgccttcttaatgctgaatgcactttacatattatggataaggaactcatgaaacgaaacattcagatatatatggtctgaggatcagcagcatcagtctcacctgggaacttgctcgaaaagcagaatcctgactctactccacatgtactgagcctgaattggcatttggacaagatccctggggagtttaaaattaaattttaacaggtacgttaaagtctgagaaatgatgctatggatgaccaccatgctgacctcagtgagaagccacagccagacaacggggagacagaaaagttatctaacaaagcagacacaggtctgccaactacagcaggcttggggccacttaacaaagggacaagcaaatgagcacaagcccatggcctgcagttgggtggccactgatgtacagcacccttacagagcccacatagcttatttattcagagtacagatgaggaaactgaggcacagagaggttctgtgatctgctcagagccacgcagacacaaagggtggagctgggttcagcctagacctgggggcctctgctgctggtccagaggcacagatcccctgctcgccagcaagaggtcctgcacatacccggagctctggcatctggatgatgaggctcatgggcacgtggacgatggggctcttcctgtagtccattgggacgaggttgggggccagctcatagaatcgcgaatgcagccttggaggaaagcagagaaaaagcgctggagggggtgccatccctaagccccagcagcccggtgctgtcctgcctaggcctctgcctctgcagaacatcctcagccaggaccaggtaaggggccaatgggaggctctctgctctgcccacagggtgtgaagttgggagggaggtgagttctgcccagacctctgtgctgataaccaggttgtgtccaggcctccctatttccaccacacccaccccatcagcaccaccaccatcactccttgggcctgggtccaaatcttttaattttttctcctttgggctctcataagggttttctatgctcaggatactgtgctaagcacttaacacatcacctaatttaatcctcctccacatcactgtgcagacagatgcatcctgaccccagcttactgctcagcaaacagggctgaagaggttaagagtgatttgtctaaggccacataactagggagcatcaagggccatgggttgagcccaagatgggaaatccaagcagaaactcttagccactcttcccccttacactcctgagggtccatcaaagcctgggcccacttcgtggccccaccaccccaacttaagccctgagggttgggtctctctgggagagctctcagcagtcctcacaccctcaggaagcccctatgaatgggtcacccataaactctctaactgggggccatcgggacccaggctgctaccctggtgggcctggccctccctcctcactgatgggtcaggtccctagctcctgtcccagcctccaggaaatcaagcccacctcaacaagctgcatggaccctcaaaggtgtaaggcatcctggcactgtctcacttggaagctcccttcctccccgccccctgcccattattcagtctttctttgccctatgtccacttgtccaggtccctgtcatcccagagaatagccccccatcccaagacaggtacaaattgtatttagatgacattgtgagctgcatgtggtggcctatgcctgtaaacccagtgttttgggaggctgaggtgggaggaccacttgaggcccagagtttgagaccagcctaggcaacacagcaagaccctgtctctacaaaaatgaaaaaaaaattagctggatatcgtggctcagtcatagctacttgggaggctgaggctggaggatcacttgagcttgagcccaggagttggaggctgcagtgagctatgattgccccactgcattccagcctgggcaacagagcgagaccctgcctctaaaaacaaaaattgtgtccattaagtgctgccatgggtgggacaagtgtaaggggcattgactgtgggctgaggtaggtaacctgcctaaagtgatgtcctaggctgctggtgaatggattaggtatgaccctgtatctcccaggcttgggccggccctgccacccccaaagccagatcagcccaggtctccttttaagtggcttgaccctgtgacacaccccaggcccacctttatcaagccattcagcacagccacccaaccttccttgggttctaccagttcttgtggtcctgctgcctactgtccttagcaaggcacctgactacttacccagctcaaacagataataacaccagctatcgtttagcaagtgcttactctgtgccaggccctgaactaatcttctctgtggattgctttacttattttaatccccaaatcaccctgagaggtagatattagtctcccattttcaggtagggaaaactgaggctcaagaatcaagtgtcttccccatcctacacagccaatgagcagtgggaacaggacttgaacccaggacctctggacaccaaccacttggctcctccctgcaagtcaagccctggtaagcacatcatctgctggttcagagcctgtccagggcaaatgaacagtaaaatgccacatgcccactttgccagtcgcacattcctataaaagggtctgaaattacaaggatgtgccatgacttggagacagagcaggaggggaaaacccctaaacttgtactttgggtgggaggaggctcagcaaatgccagggcggtgggatcaagctgagactctccacaagagggcactcaaggactttctttgctcctatttcttgcatagaggaaaactacttttttttttttacactgtccccaaataaggaacaaccacttgtttcaaaattcatgcatcttctttctttctttctttcttttttttttttgagacggagtctcgctctgtcgcccaggctagagtacagtggcgcgatctcggctcactgcaagctccgcctcccgggttcaggccattctcctgcctcagcctcctgagtagctgggactacaggcgcctgccacaatgcccggcacattttttgtacttttagtagagatggggtttcaccgtgttagccaggatggtctcaatctcctgacctcatgatccgcccacctcggcctcccaaagtgctgggattacaaggcatcttctttcataattcatgcatctggtactttgacatatccattgtgcttccaactgctacatttcccacttgaccttgaccccacctcatatgtggcagtgtgatgttggagtgtttctaggggttggcctacacctctgaagttttgtgggatggctgcagcaggagcatgaagtcaggctgaggttggagccctgcctacacctctcattagcagtgtgggtaagtgggttaatccactgaaggataagtttctctatcagtaaagcaggggctattctactgttctcacccctggatgttcataaaaccactggccttcaactggcagcttttagcatgctgcctgccacgtcagaggctccctggaaggggtggactagggagagaggctatgggtgcttggcagggttgaggaggtatcctctggggtgggaaggccagcttctaccctgggacacagatctgttctaaaacagtaactaaaatcacattggaatttttctttaaagaaaaatccaaggagaatttgaaaacccaaatcactgtgaaagaaactctaagcattgtcaaagaaccacatctctgtcacctctcccccaataaagggcactgaattcaagaagagttatatattagtcctactgtaacatccaggaccagaaaccatacttacgctacttgaactgcccccgagtatgaggcaagaaatgtgaaaactctcactttattttacaaagttaacaagaaccctgatacaagaacctaatatgtagcatccagaatggaccaatggcacttgcatagatagatgaaaaagtcttataaaataacatactgggggccaggcacagtggctcatgactgtaatctaaatgtgctttgggaggccaaagtgagagaattgcatgaggccaggagcttgagaccagcctgagcaatgtagtgagaccatgtctctacaaaaaaaaaaaaaaaattaaaaattaggtggatgtggtgatatgcatcagtagtcctagctactcaggaggctaaagtaggaggatctctagcctgggcaacagagtgagaccctgtctctaaaaaaaaaaaagataagtaaagaaagaaaaaaatagcatactggtaaatcaaatctaagactttaaaagaataatatgttaggatcatgtaggatttattccagaatgcaaagatagttcaatatttggaaatctgtggctacaaatcatattaagcaaaaaacattttgaccaatttgatagatgcatttatgactgtatatgtgaatacagaaaaatatctgagaagttatatactacatgtttacactgatagtccctgggaggtgggagtagagaaatgtgaaaagaaggaggctaacttttacttgttatttcacctacttctcaattatttgaaattttagaagtaattatttatttatttatttattttttgagacagagtctcgctctttcgcccaggctggagtgcagtggcgcaatcttggctcactgcaacctctgcctccagggttcaagtgattttctcatgcctcggcctcccaagtagctggaattacaggggcatgcgaccacactcggctgatttttttatatttttagtagagatggggtttcgtcatgctggccaggctggtctcgaactcctgacctcaagtgatccaccacatcatcctctcaaagtgctgagattacaagcatgagccaccgcacctggtcaaaagtattttaaagtatatgttgttttgtcaattaaaaaaacttaaaattcttagtaaaacagaaacaaaaggagtttctgcttaggagcagaaacaaaagggtatctccttctctttttttttttttttttttttttttgagtcttgcactgtcacccaggctggagtgcagtggctcaatctcagctcactgcagcctccgcctcctgggttcaagcaattttcctgcctcaacctcctgagtagctgggactacaggcgcccgccaccacacccggctaatttttgtatatactggggatatacccatcaatgtgggatgcctataatcaccattattatataacatttctccccaggagcactaatcaatgtactattcgccatccaggtccatgagttctgcatatgtgagtcaactgaagacagaaaatatttggaaaaaaaaaattgcatctacgctaaacatgtatagattttttttcttgtcattattccttaaacaatacagtatagcaactctttacacagcatttacattgtattaggtgttataagtaatgtagtaatgatttaaagtatacaggaggtgccgatttaaagtatataggaggggctgggcacggtggcttacacctgcaatctcagcactttgggaggccgaggcgagccaatcacttgagcctaggagttttgagaccagcgtgggcaaaacagtgtcacccttgtctctacaaaaaatatatatatataaattagtcaggcatggtggtatgtgcctatagtcccagctacttgggaggcagaggtgggaggaccacttgagcccaggagtttgaggctgcagtgagccatgatcgcaccactgcactccagactgggcgacagagatcctgcctgacaaaaaaaaaaaaaaattatacagaaggatgtgcaaagtggataaggttatatgcaaataatatgccattttatatagggacttaagcatttgcagtttttggtatccttgggaggtcctagaacctatcccccacagatactgagagaggaatgtaattagttaagacagtaaaatagtacacttaaatactggagaggaggcaagttaccatttactggaaaaccaaaaataattagcttaaagactatttgaaatagaaagagttcagaagcctttctacacaatagtttttctattatgtattaacattagccttttcaaaagtaggatttggctgagtgcagtggctcatgcctgtaatcccagtgctttgggaggccaaggggaaaggattgcttgaggccaggagtttgagaccagcctgggcaacacagtgagactgtttctataattttttttaattaaaaaaaatgaattcacaatttaaaagaaccaaaaaaaaaaacacaactaagtataaaattggtataaaatgtactaattttgaagtatcaaaaaaaccatgaaagtttaacaaaagatataaaaatattttaggtacttagataactattgtgcattcctgatcggaaagacttaatgctgtaatgatgacgatgatctgttcatttttctataaaatgaatatgaccctaatcaaaacctgcaaatgatctatttgggatctagccagcccaattcaaaagtgtgtttggttaagtgtttcttcaagctactggcaaaaaaaaaaaaaaaaaaaaaaaaaaaaagtttgtttaaaagaataaatgtaggagtgttgcaggggaaccctgaaaaaaaagagaaactggggaaacatttttccctatcaggtattaaaacagtttaaagctataataaggacaatgtatgaaacagacattggcatttacaaggcagactagtagaagtggtagatcccaatgtaaatgagaatgagcccatgacacagcatttgaaatcaatggggaaaagattaattcctctgaaagtcacaaaccagcaatccaccattcatgcctagtttccatatagcattttaaaataattaaattacgtcgaaataataaatttagaattttgctgccaccatatacagattgaaagatcttacactataaacctgggtttcttaatcaagatggtctgaattcccccaaggcaacaactagctggggctaaggagcagctatttctgcaggtgtccgttctaaagagttcccacccgactagacagcttcatttatttacagtgcatgctggcccccctgacaggcagctgagcttcagactcttgggttattcactgaatgatctggggtcagaagacaaaaagcatataacagcagtgggaggaaaaagcaaaagtcttaaaaatatccattatctttgatcaggaaatttgttggaaatacccatatatgtgcagttatgtgaatggtaccacaagaatattcactgaagtacaaattaaaatcgtgaaaagctggaaatctaaatgttcaactatacaaattaagaaatatccattaaatgcagccatttaaaatattgtatcagaatatctaatgatattgaaagttgttcgcaagatgttaaatgaaaaaagcagaaggtacagtataatcccattttttttaaaaaagcttgtatatatttatatactcacaaaaagaaagactaagaggaaggctggtcactaaaatgttagtgattatcttgggtagtagggggacagtaagatcttttttcttatctttttttaactttaaaaattgtgataaatggctgggcagtggctcacgcctgtaatcccagcactttggaagcccaaggcgggcagatcatgaggtcaggagtttgagaccagcctgaccaacatggtgaaacccgtctctactaaaatacaaaaaacagcctggcctggtggcgcgtgcctataaccccagctactcaggaggctgaggcaggagaattgcttgaacccaggaggcagaggttgcagtgagccgagatcgcgccattgcactccagcctgggtgacagagccagactccgtctcaaaaaaaaaaaaaaaaaaattgtgataaaataacagaaaatttaccatcttaattattagtttttctaaattgtggtaaaatgcacatgccataaagtgtaccatcttaaccattttgatgggtacagttcagtggcatattaaatatgttcacattattatgcaaccatcaccaccactgatccacctccagaactctctccatcttccaaaactgaaactctgtactaatcaataagttcccattccccctcctcccagcccctggcaaccactattctactttctgtttctaagaatttgactacttggctaggcctggtggctcatgcctgtaatcctagcactttgggaggcagaagcgggtggatcatttgaggtcaggagttcgagatcagcttggccaacaaggtgaaccccatctctactaaaaatacaaaaattagccgagcgtgttggtacacgcctgtaatcccagctaattgggtggctgaggcaggagaattgcttgaacctgggaggcagagattgcagcgagacacagactttaaaaaaaaaaaaaaaagaatttgactactctaggtacctcatgtaagtggaatcgtatatgtcattttgtgactgcttatttcactgtgcataatgtccttaaggtccatccatgttgtagcatgggtcagactctccttccttttgcaggttgaatagtgttttattgtctgtctataccgtgtttggttcatctattcatttgctgatggattgcttccaccttttgtgaataatgctgctatgattgtgggtgtacaaacatctcaagactctgctttcaattcttttgggtatatacccagaagtagaattgctggatcatgtggtgattttatttgtaagtgtttgaggatccatcatactgttttctttagctttcttatctacttttacaatttgcctaaggaaaagcaattttaagcatatatatacttttttttttttgagatggagtctcgctttgtagcccaggctggagtgaagtggcatgatctcggctcactgcaacctccgcctcctgggtcccggttcaagcaattctcctgcctcagcctcctgagtagctgggactacaggaacacaccaccatgcccagctaatttttgtattttcagtagagttggggtttcaccatgttggccaggctggtcttgaactcctgacctcatgatccacccgcctcagcctcccaaagtgctgagattaaaggagtgagccactgcgcctggccaattttaagcatattacaaaacaataccatctgcctttttttttttttgagtcagagtcttgctctgttgcccaggctggtgtgcagtggtgcaatctcaactcactgcggtctcaacctcctgggctccagcacttctcccacctcagcctcccaaggagctgggactacaggcacacaccaccagacctggctaatttctgtattttttttttagagacaggggtctcaccatgttggccagactggtcacaaacccctgagttcatgtaatccaccggcctcggcctctcaaagtgctaggattacaggtgtgagccaacgtacccgaccacaatctgactttttgataaacacatacaaaagaaaaacactggcataatatataccaaaagattaacagccttatttctgggtcataggcttacaggtaattttttttgtcttctcttgactggcttcattttctaatttttctacaatcattatgtatatgtgtagtaagtaattaaaataggttacacaaagtttttaaaaggttgagaaaataaacaataaaataacaagtaggcaaataccttggagtgctggctgggtgggcctctctgtgtaccaaggggacaaggactactgtcccgctgattaaagagcacagcctaattagggcacaagggaagttgaagtgctaagctcttacctataaaaagcaaggtgactgaatagggtgggctgcccactcggcctcaatgtgggaatgcaggagctgtgtcctggggagcaatcggatctacctgggtgggggcagggcagagggaaggagaattggaggcgggctatctgtgactcggtatcactgccccaaagttgccacagagctgggccccaacctgcaaagaaaaacctcctgctcaagtttcctcctagccatctggtcagtacgcagggagcagcttaccaagaaaaccatcctggtgggggtggggagtagcatccctgaaaggcccttgggagcagggaagatgagcatggcctggggctggatagcctggctctgcagctgactttgccctctctgggctccaggcctcagttttgtcacccggacctgagatgtgaacagtggagagggctctcctggaggggcagtcagtcatgctggcctctccacagagaaggctggagaaaagcgaaggggggtgaaactggaattgagccatcatggccatgcctgttccctctagggacaggcaatcccgaatctgtcttgtcttaactacccttccctgagggtggacaggtgggcagcaaactccaggtagctcttttcatgtttaataacaccatcacccagccctcccagacacaggggcctgtgagaaaacagctcctgcaagcaatgtcatccccatgctgcagacggggcctcaggcttgggttttgctctggtgttgaattacagagcctagggtcctgatgcgtgcagaggggtgcaggccagggctgtggggagccaggacgcctctcctcaagccctctcacctgcctggagcccctcattttccaaggggccagggatacccctgatatggtttggctgtgtccctacccaaatctcatcttgaattgtagttcccataatccctacgtgtcatgggagggacctggtgggaggtaattgaatcatgggggcagttaccccgaggctgttctcatgatagtgagttctcacgagatctgatggttttataaggggcttctccccctttgcccagcacttctctttcctgccgccatgtgaggaaggatgtgtttgcctccccttctgccatgattgtaagtttcctgaggcctccccagccatgtggagccatgaatcaattaaacctctttcctttataaattacccagtctcaggcagttctttatagcagcatgagaatggactaaaacaaccaccaaaggcccatcatattggatcggattcccggactggccttcaagctcctctctcctcttccccacacaggcaatcttgctgctgtcaatgagaccacgggaggatgggggtgggagtgggagcaggagaagctggcctgtgtctcacctctgctgctccccagcctggaatgttctccctcagccaatcctacctgtctttcacccacacactcttcatatggtcactggtggctaacaggtgccatgctccctgttagtcctgcctgatcacaagtctggtggggagctgggcccctgggtccaggaacccaaggagcccctaacaggctgttagagcagctgggatagcactagggtggcagggtgttgggggtgcttataaaggagatgattctggagttgggtctggaaggatgcatagcaatgctgtgggcagaggagaggcgaaggacactccagggagtggagatagccagtgcaaaggccgaggcaaggggcttttgttgccagaatgaaaatggccgtgggcctcagaagacaggcagcttgggcttggcatctacaaaggtagggaacccgaagctccctgtgaggctcaaatgaggctccatgccaagaactctgaaaggtaaaaggtgccacaagaatgccaggggtgacagctttgttattccaataccgagagccatcctgtcgaaatggggacctcacccctgacatctctcaagctacagggcaaatcccacttatcaaacactataccccagtgttgctgcctctcggcaatgctatgagggtaggtttcactatccctattatacagaagaaaactgaggctcagggaaggtcaaatggttgcccaaggccacagatgccaggtctactgatgccaggcctggaggctttgccccttgctcagactctctaaggtggtggaagtggggtatcccctgcccatgcaggtgacaggttggaatagcagcctgggtagagaggaaagccgagaggcactgcctgaatgagcagaatggttagggcagtgacaagctgcagcacagctctcttgggaagctgcaatgggctctggtcccagcctgaccatcgatctccagggcaagtgatcctgggactttgctggcttttagtgccacccaggcagaggggcctagtgaggcccgtggggcagttttcttggtattcagtgattcctgctcacccactggtcctggggttctgaggctgccgatcccctttatctttcccatccaggtccacccccacccccatcaacaccaaggagaagggctgtcctgggaagaagcagagccctgatgaatagctcaggggtggtggccatgccctcaacttttagacgtcctaggagtggaagaacatcaaagctagagccaaagggcccttagggacccctggtctaacagacagggactccctgctataccaggacccaggatgcagtgaaatagcaagggacctggagtcagaggctgggtcttgagtccctggctctgtgactttagccaagttgctaagctccatctgtcaaatggggataaatggattctcttgttacaaggtcacaatgaggattaaataagaatgtgccggaaactacccacctgaaagctcatagtaagtagatgttcattccccagcaggaggatctgggccctgggaggagtgggaagctctaactccatcctagcccagtggccgagtggggacctgaatgtggctcctgatacatgctgatgctctgcctcagccccaggagcacagccagcccatgtggggtgccccagcctcaccccggccccagtcccagtcccaacagggtgaacgagaagccacacttacttgaggatgtccttcttattgaagaaggtgcagtcctgttgagggaaaacacacaacacacagtcagtgtgcggctcccagactttcttcctcagaggcctcgatgccacagggctcacaggggatagctccggactggggacagaagagtcactactatccctttccaccttgccctcacccactggggacagctggctctagtaggtatagaaaatgcctcccaaaacctttatccatcctgggctaggcctaaggagcttagtgcatggtggggggctgtagcatgctttagggtacacatgtaggaggaagatgaatgctcacaggtatgcgtggctgatttgagtgccagtgggatacactgggggatgacagggaggtggctgggagacaactccgaatgaggacccacagggccacctcgtgtagctgcatggggtgccatcctcactgtagccctgagcatggtgctaggggggttgtgcagtcccaggctcagagactgagagttccaggcacatagactggggaagcatcagtatatacttggtgtctgaagccagaaagggatgaggtcacccagagaagggagtgaagaggccagggagatatgggagggagaaacgtgggcagggggaaccaggtagcatctggggtagaggtgagggtaggggctgctggggatccccaggtaagcattactccaggtggggggcagcacttggctcctagggccatccagatgacaaactcatctcggaggggtcctgtctttgtttagatgaactgcctctatccacagcttggcctgcccaaggtgagtatcaaccactgggagtcagtgacaatggccactatgccagcccttggtgaaaagtatagaggtgaagaggacccagcactttgtaaaatgcccaaccgtaaagggcttttgtgcacctcccctgctgtttagctcctccgcctttgtccactgttacagcatgaagcaagaaggcctcctaggtctgcagagcccagagcccatagggcctcctggggccataagctgaccagagccagctctgatgaggagtgaatggctgaaactcaggcctgcaaacagccaggcttgccctgaatgagacctgaagccgctggacatcagggcaattggattgcgtgttaagaggcccaaagagaggacgcctgcaggatgcacacaacatctggggtttccactgggtgccttcgggagagctgaaaaggggagagctggtgggaatttccaggccccatttggcccaacaagtctgtccttctaagctgctgctccctgggagttagactaaggatccatgctggcttcttggaaacacgaggggttctcctgggggtctcagctttgcttttgacagtggttcctctgtaggagcccagaaaggctcaggctggggaagcagtgccccctgctcctcacccaacacagacagaaaactccctacttagcaggcctcaggcacagacaggctggagacacagtgggctgatttatcagcaaactccagaaacatggtgcagaatgtggacttccctccaccccagggccgtttccatggtctaaggtgcccagtgagaagggccagggctctcccacctagcctggaggaggcagtcagcagaactggaaatggggagaggtcccaactcctgctctcttccccccgatctgtcctccttcccctcccctcttctctctcctatcccatgtgttggaaaggaactatccaggtcctgattcaagggttctcctgacaaaagatgcaaacacttcccctataaccctgctccctgtcacaattacttacacctccctacatcaatggtcctcacgctgtggctcctggaccagcagcatcagcctcactgggaacttggtgaaaatgtagattcttaggctccactccagatctcttgaatcagaaactctgtgggtggggtccagggatctgcactttaaaaaaccctcccaatgatgctgatgcatgttgaagtgtgaggaagtctgctctagagcagaatcacttgggggactgtttaggatacctgtgtcccccatccctcagcagaccccagacaaattgtagagaaatccccaaggatggatccaggcattggctgttttcaaagccactcaggtggtcccaacgtgcaacccaggctgaaaaccacatcacaaccagtacatgatgtaccatgcacctggcacctggggctctaaatatccaatttttcttaatccttatcattagccaatgggggtgggcattatctctctatcttaaagatgggcaacttgagactcagcaaagttgagtagcttgccttaagttgcacacacagcccaggagggctgggaatggaacttaggcctctgtgcttccctttcccctgccccccccccttttttttttgagacggagtcttgctctgtcacccaggctggagtacagtggcatgatctcagctcactgcaacctccgcctcctgggttcaagtgattctcctgtctcagccttccaagtagctgggattacaggcatgcgccaccatgcctggctaatttttgtattcttagtatagagatggggtttcaccatattggtcaggctggtctcgaactcctgacctcaggtgttcacccaactaggcttcccaaagtgccgggattataggcatgagctaccacgcatagccttctttttttctttttaatgggagtagaccttggggccctcactggcaaggaagcagaggcaagaaaagatcctctgtgcttcttggccactgcctatgactacaaacagagccatgaccactgtacaccagccactccatgtcctgcgtctgctgtgtattcctatacttatacacagcaggtgcttaatacaggcttgtgggatgagtgaccagacttttccatctatgccttccacagcagttacgttatttcagtggctgcagagtccctgcctagtcttaatctttcttctctttctgaacatttagtaacacctatttcttggttttaacatcactgacaaaactgccatgaacctgctcatcaactgatgtttcactttttcttctgttcacttgtttccctgggactcaccccaaggaggcagtgcacaggtagtgaatatggcaggtgttcttaaaagcttctcagggctcagggtggcctagaagtgtggcaggggaaaaggtttggtagtcagggtcaaattctagtctagcttcagacccttaggcaagtcattctcctttctgagcctcagtttctgcatctgtaaagtggaaataggcctctctgaaggggacagtgtgaagagcaaatgagataaggtacaggaagtctataggccccagctgataggaaagagtacaacagctccatccaccacccaggtcccaaaggcatctccccagagtcggtagctctgctgtctttcccttctctggagtcaccaaacaccctgcccaccactacaccctcagctgccctgggagctacagccctatgtctgaaggaaccctttcttacacttttggagagcaagtgccccatcactgcttggttcctgacagtacacagggacacagggacaggtcttccggcaaaggtcaggtctgggtcatgaggagtggaagggagggaaggagagagggggcctaacccaggagtgatgggctctcagaacattggcagcagaaaacaggacaggctgggcttttacagtagaagcccagacgttttcccagttaaggcttgagttctgcctccgagcctatattcaccctattccccaactggagtgccctctcctctttctccaggttgtccaaaccctttctccaaagctcaactcaagggtgacttgttccaggtaacccacctgcctcccatctcctacatgcctggtctgcctgtgccagctgtcaggagccgagccatgggccctcccagctctaatggaaatggctctccatccagctctgccagctcaggcctcagcactgcccaggggaccatcacacggctcaaggtcagtctccagtgatcttagttgatccccacaagaaccctgtgacatgagcacagctgggttagtagttcccattttagaggtggagacacttaggcccagaagggaacagtggcttgctaaggcccacagcatcaactacccagctgacttgaatctagggcttcagaatctttgtctagagttctttgctctcctggagccacgccttaacaaatatttgttcattcatttgacaacatcctccaaacatctcttttgtgcctggacagaggccatacaagaaggaagctggagtgtaaacagtgaggtgcccagtataaaccattctgtggccacacaagggactggggatgtatatgtgtcaggctccctgagtactcccagctgaatggattggtggagagagagtcagggagcccgtcccaaagaggtgaggcctggcctggacagaaagatgggccagactaggttagcaaaggagcagggagagcagcaggagaacaagggccagaggtgagggagggcttggctagaagcccttcagtgtgcctaaaactttgggtgcaaagggaaagggagtaagaaatgaggctggaggcccggcgcggtggctcacacctgtaatcccaacactctgggaggccaaggcaggtggatcacctgaggtcaggagtttgagaccagcctggccaacatggcaaaaccctgtttttactaaaaatacaaaaattagatgggcatggtggtgggtgcctgtaatcccagctacttgggaggctgaggcagggaaaattgcttgaacctgggaggcggagctgggatgcggaggttgcagtgagccgagatcacaccactgcactccagcctgggtgacagggcgagcgagactccgtctcaaaaaaaaaaaaaaggaagagaaagaaagagatgaaggaagagtgagagaactaagagggcgggtggctggagggggatgggcaggaggggcgcaggagggagcagtcagacctccagtttgcaggagactgagcaggcctagcccagggccctggctgtcgtgatggaggaggggacctccaggtgacccacaaaagaggctgagtcacaggccttgttcttaactgaaaacatgggctgagggagagcagagagttgaaatggctggaggagcagcagtgggtgttggagaggctgtgacccctgttttggagtttgaggggtctgggggatggccgtacaatgcagaggagtgttctggacagaagcttaaatgttgggaatcaccggcaccgggaaccaagagggtgcaccctgcccaggaaaggttagactaccaggctgggaggtcccaagaaaccctaggtgtcacttaggggagagggtgctgtaactcaggctcacccccactcagcccgggctggcaatggctggctggagagccagagggtaggagatgtggggctctcaggtttcacagctctcatttctcccaccccgcctggcagggtctagctaggctctggcaaagaatcagaacataacactgggactggctccgatgagtaacccaatgccaggctggttggagtgggaacctgggctccccacccccatgaagctactcctcacttctgagcatggcttgcctgcttgcccctgcccactcccaagcctttatccacgctgtcccctccacctggaatgcctcctctgggccccactgggcaaaacccgacctatcttcccaaggcctgctcaagtgctgtatcgtttctggactttgtcccccttccctgctggcctcccactgcccactagtgcccttccctagaacacactccaccacctgcctctatcacaagggccacacactggaggtgagagtctgtctctgagtgtctgagactgagtgccttgggaacaaaaagcacacatggcccagcccagcccactcccaactaaagaagtgagcctaggagtcaagattcgaaatcctgtgtgagccctgaatggctcctcagcctctgtttacacgtctgtaaaatgggctaataatccacctcactgtgatgatcaagtgagttgatgcgtagagggcatcaattactgtgcctggtacacagcaggtgctccataaatgcgtctcccctcttccttcccagggcctcacctggggagctgagaaatccattactgacaactagggcttctaggaggagaaggggcctttgttttaccttcacccacatcagaggacccacacttcacacctgctttccttcacagccaaagtaagcactgatgaaggcaacaagtgcctatggagaccctgttggtgttcctcctgcccagttacacaggccacaacacaatcctgccccctccgcctggggagtcaggggagaggcatcagatgtgggacttgaagggtgaaagagatcctctggaggggggaaaggcatccaggcccaggaaatggcatgggcagagggagagagggagggaggaatgagcctggtgagctggagcaactgcaaatggttttaaggcggctgccatgcagagggcagggaagggacctggggagactgaggctgcagagataagctgagcaattggccagggctccgggtaagccaaggggttgggcttcatcctgcaaccacagcgaagtttttacctgggtgggacggtattgggattccagatctggaaagctggctctggaggcaggaaaacctagaaaggtctaaggaggtggctactgagggcctaagggagctgggagaggtggccctggaaggctgctaccgggcttgcgttcttgctccagttatctccatgctggggtcagaaggagcgaaccccagccgataaacaagacagtcccaagggaagactgcatgtggggactgatgcaccccactcctagaccagacaggacgccagctctcatttctgctttacagagactcgctctcctgggctccttcctggggctggggggcagggagcggggagggcggtcctccgtccagcctagtttactgactccctctccgggccagatgggcgctggaatgggtggctggagaggggttcgggtcctgcctagggcgagagtagctggagagaggcgcgcctgagaggttcttccaactggaaagagctcttattccaccggtggggaaactgaggcacggcgaggggaagtcaccggcccaaggtcacgcgtcgagctgaaggcagaggcagggtttgaacctgggagagctggctctcgggaggcctcggccagcgaccgagaaaagggaggggcggcggggcggcggggcctgtgttgggggccgggcgcgccgagctcacctggtagttgtctagctgctcttcggtgaagatggtctgcttgttccccatggtggccgccgcgccgccgctcgcccgcccgggctccgactcccatcagcggccgccagacccggagccagcgccccgtgcccgcggccctcggcagccccgcggctggcagcggcccacggtggccggacccttcccgccccgcagctcgcctggaggaggcgcgcgggggtctcggaggcggggacgggaacccggagcggcagcgactccgccgccggcgggaagagggcggggcacccggctccgcggctgcagcgcgcccgggtcccggcaggaggcgacctggccccgggagacgctgcccggcacgaacccttg

SEQ ID NO: 1656 - DNA, 11318 bp, Homo sapiens
actcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtgagaaggctggcaggggagcccgggccagctggctgggtgccacctaaggggttctgaacaggagggagagggagagaggaataagaatggttgcttgggagaggatggcaatggcttcgtgggggctagcagccctctggagtcagtcctggaggagccccagggtcccaagctgaatgtctgtggggcacagaaaggacgagagcctcactgctctaaagagctcccctaccgggtagggagcatgtcctgcctgtcctccctgtccccactgttgagcagatgctgggaaaacctcactacaatggtcgaggcagaaggagcagctggttgtcagagacgtcatcggggcaggataataacaggcatgagggtggggcgcagtgaaattacccagagccagggactgccctcacggatcagtcaccctcgcttgcctccacgtccattcactctcaccccacatttctggaagcccaatctgtgcggactgctaaggataaactcagaacttaggtcagtatggcagggaggatgccctcaagtcgtcttccgggagatgagaatctatttgccaggggcggaggtgggggttggtttttgtgtttgttttttgtttttttttttttttgagacagggtctctctctgttgcccaggctggagtgtggtggtgcgaacatggctcactgtagccccaacctcctgggcccaagcagtcctcccacctcagcctccgagcagctggaaccacaggtgggcatcaccacacccagctaacttttaaatattttatttatttttattattattatttttttgagacggagtctcgctctgtcgcccaggctggagtgcagtggcgccatctccgttcactgcaacctctgtctcctgggtttaagcaattctcctgcctcagcctcctgagtagctgggattacggtcacgtgccaccacacccagctaatttttgcattttcagtagagacagggtttcgccacgttggctaggctggtctcgaactcctgacctcaggtgatccgcccccctcggcctcccaaagtgctgggattacagatgtgagccaccgccccagcttacattttttgtagagacggagtatctctgtgttgcccagactggtctcaaactcctggattcaagtgatcctcctgcctcagcctcccaaagtgctagaattatagatgtgagccaccacgcctggccaagactaggatctgtcagaagtggaggaaaaggagacacagatttccccaatttactaacccccatcttccaactctccacccattcagggaaactttgggatggtcaacctcgtttaatatcttcatgcgataaagacaaaagatctacccagcacagttccccacttctcaggacagttggctaatgacattctccaggggagagctccccttggtcccttttgctggtcacacctcgctggtcacacctctatttgctaaaagaggatacctctcctttaaccaacaatcccctcttactctctagtatcttttcttctactccctcctcctgcatggattcttggctgctgtactctactctatcgctctaaactcaactctctttgagagtcacactcctctcaggctgacacacttagccattgtcacggggtgctccctctgcaacctgaaccacccctgtctccccacactcctctgccccatctaaccagcttgcttcagcggagctccctgagtctgccttccccaaatatgcattcacagctgccttccctccacctctgtgcccagagtcactctcaagaagcaccacccggtgggcatggtggcttacgcctgtaatcccaacactttgggaggccgaggcgggccaatcacctgaggtcaggagttcaagaccagcctggccaacatggtgaaaccccgtctctacttaaagaaatatacaaaaattagccaggcatagtggcgggcgcctgtaatcccagctactcgggagactgaggcaggagaacccgggaggcagaggttgcagtgaggcgagattgcgccattgtgctccagcctgggcgacagagcaagactccatctcatacataaataaacaaataaataagcactgctgtatatcacagggacacagacaggttcctgctctccctgaagcttgtgttccctttggtaaggccaccagtctcacggaagcaaggctggaagtcccacgagagcaagcactgcctgctttgttggccactatgtacccagtgctagaccagcaccttgcactaaacagacacccaattaatagtcatggaatggcagcgtgtgcctgtagtcctagtttgggcccagaaatgaaagattgcagtgagctatgaccacgcgccactgcactccagcctgggcaacagagcaagaccttgtctcaagaaaataaaaaataaaaaagtcattgaatgaagtatagaactaggcaaggcaatttcagatagaagtaggtaccatcggccgggcgcagtggctcatgcctgtaatcccagcactttgggaggctgaggcaggcggatcaccgaggtcaggagttcacgaccagcctgaccaacatgcagaaatcctgtctctactaaaaatacaaaaattagccaggcgtggtggcgcatgcctgtagtcccagctactcaggaagctgaggcaggagaattgcttgaacccgagaggcggaggttgcagtgaaccaagattgcaccattgtactccagcctgggcaacaagagtgaaactctgtctcaaaagtaaaaaataaaaataaaatgaaatggtgctggcatgaagagctcctaggcaaagcagatgccactttttataggattttcagggacaggctctatgaggtgatgtctgaactgagacccaaatgacaagaagaaggtgtgagtgttgcagacactaggggctggtagtacaaagcctaaggtgggaacaagctctacacttctgaggatcagacaggtggccggtgaggtgagatgtaatgagatgaggtctgaggagggcagaggctaggcctggaacaccctgaaaagccacagtggagtcatttgaatttttattattataagtacaacagaaaactattgaaggacttttttttttttttgagacggaatctcactgtgtcgcccgggctgcagtgcagtggtgcgatctcggttcactacaagctccacctcttgggttcacgccattctcctgcctcagcctcccgagtagctgggactacaggcgcccgccaccacgcacagcaaattttttttttttgtatttttagtagagatggggtttcaccgtgttagccaggatggtctcgatctcctgaccttgtgatccacccgcctcggcctcctaaagtgctgggattacaggagtgagccaccgcgccatgccctattgaaggacttttggcactttgttttttgacggtttaaaactttttatttaagtcacacagacaagtacccagatccttagtacacagctcaacaaacttttacaaagtgagcacatctgagcccaggtcaagaaacagatcattaccagaagcccagacatgcttctcaccacacacggaaccccagaatcacttcaccaacaagcgtaaccactattctgtcttctaaccccatagacgagtttggcttattttgcactttacacaaatggaatgatagagtatgtgtctggcttttttttgagacggagctgttgcccaggctggagtgcagtggcgctatctcagctcactgcaacctccgcctcccaggttcaaatgattctcatgcctcagcctccagagtagctggggttacaggcatgagccaccacgcctggctaatttttgtatttactttagtagagatgggggtttcgccatgttggtcaggctggtctcgcactcccgacctcaggtgatccacccacctcggcctccccaagtgctgggattacgagcgtgagccaccgcgcctggcctgtgtctggcttctttagctccatattacgtttgtgagagccacccatattatcaggtgtagctgtagttttctttttttcttatacattctattatgtgactatacctcatttatacattctactgtttgtttgtttgtttttttgcttttttgcttttttgttttttttgaaacagagtctcgctctgtcacccaggctggagtacaatggcgccatctcggctcactgcaacctctgactcccaggttcacatgattctcctgcctcagcctcctgagtagctgggattacaggcatgtgccaccgtgcccagttaatttttgtatttttagtagagacggggtttcgcgatattggtcaggctggttttgaactcccaaccttaggtgatccgcctgcctcggcctcccagagtactgggattacaggcataagccactgtgcccggcccattctactgttgaaggagatctggatcattcccagtttggtttttttgcaaataatgctgctataaatattcttgtagatgtatttaggtacaaatacgtgtgcatttctattggataaaaacctagcagtaaaactgctgattcttaagacatgcaagtattcagcgctaatagatattgccagttttctgtagttcttagtgtgagaggtctggttgctccacacgccactggaatgaagaagactcctttgaccactgtgtggagaatgggtagtagaaggtctgcaatatatacagaaaaagaccaaactgagctgggcgtggggcctcaagcctgtaatcccagcacttttggaggccgaggccagcggatcatgaggtcaggagttcgagaccagcctgaccaacatggcgaaaccccgtctctactaaaaatacaaagttagcagggcatggtggtgcatgcctgtaatcccagctactcggaaggctgaggcaggagaatctcctgaacccagcagacagaggttacagtgagccgagatcatgccactgcaatccagcctgggtgacagagcaagactccatctcaaaaaaaaaaaaaaagaaaaagaaaagaccaaactgaggtcacggaagacatccaggagagatgagagtggcttggactaggccagtggctatggaaatggagaaatatgagctgattcaggctataagcacagtgttttcttcttcatttatgatgacacttttcactaagacaaaaagatggtgaagaatgagacagagaagcacatactacaaagggaagcaaacactttaatcaaaagagtaaaaatctcaaatagggccaggtgtggtggctcatgcctgtaaaatcccaacactttgggaggtggaggcaggagaatcgcttgagtcccagcattcaagaccagcctgggcaacatagtgagactctatctcaacaaaaattttaaaattagctgggtctggccaggtgcggtggctcacacctgtaatcccagcactttgggaggccgaagcaggctgatcagctgaggtcaggagtttgagaccagcctgaccaacatggagaaactttgtctctactaaaaatacaaagttagcagggcgtggtggcgcatgcatgtaatcccagctactcgggaggctgaggcaggagaatcacctgaacacgggaggcagaggttacagcgagccaagatcgcgccattgcactccagcctgggcaacaagagcaaaacttcgtctcaaaaaagaaaaaattagctgagtgtggtggtacaagcctgtaatcccagctactctaatgctaaggtgagaggatcacttgagcccaggaggtcgaggctgcagtgagccatgatcatgccactgcactccagtctgggcaacagtgtgagaccctctctcaaacaaaagcagaaacctcagacaagtagatcattcaaaattggtaaatccaaaaggcaattctaggtgtgtttggatccacaagcctccagtaagtgacctaaccagggaggtaaagtaaggtgtcagcatgggtcctggccctgccatgagacaggaagaagagagagcaggtgtttctctgaggttgctggggatgatataatagaactgaaactctcagccctttccctggagaagcacaaaatgctgccttggatggtatgtgccagataagacacatgaggagccaggcacagtggctcatgcctgtaatcccagcaatttgggaggctgaagcaggaggattgcttgagcccaggagttcgagatcagctaggcaacatggtaagacatgaactctccaaaaaaattagccaggcatgttgttccgcacctttagtcccagctactcgggaggccgaggtgagaagatcatttgagcccaggaggttgaggatgcagtgagccatgattgcaccactgcattccagcctggatgacagagtgagatcctgtctcaaaaagcaaacacacacacacacgaaagcaagaagcaagacagctgtggaattccagagataggagacaggcaaagaacctgacctggtgcaacgaagataaaggtaacggagccagatgaggaggcttaaatgccttacaagagttaggcgttcaagttacaagtcttggccaggcgcggtggctcacgcttgtaatcccagcactttgggaggctgaggcaggcggatcacgaggtcaggagatcaagaccattctggccaacatgatgaaaccccgtctctactaaaaatacaaaaaattagcccggcgtggtggcatgtgcatgtagtcccagctactcaggaggctgaggcaggagaatcacttgaacctgggaggtggaggttgcagtgagccaagatcacaccactgtactccaacctggtgacagagtgagactccgtctcaaaaaaaaaaaaaaaaaaagagttcagtcttgatgggcttctctgtgaagagaccctaaaggatttgagcagagaaaagaccagttgaaagctatgtttaggccagatgcagtgacttacacctgtaatcccagcaatttggtaggccagggcaggaggagcccaggagttcaagaccagcctgagcaaatagcaagaccccatgtctacaaaattttttttaattagctgggaatgatgacgcatgcctgcgataccagctactcaggaggctgaggcaggaggatcacttgagcccaggaggtcaaggctaaagtcagccacgatcaagccactgcattccagcctgggtggcagagtgagaccctgtttcaaaaagaaagaaagaaaaaaaaaagctatgtttaacctgatagaggatagagtgtagggtggcatggggcaagagctatgagagtgtaatagggaggctgagaacaccctcatgggaggtgatgagggattcaatgtggggaggaactcacagattcaggagccacttaagtaaaagttgagaaaatttgatgtctttctgggtgcaagattaaagctttccagcctggctgacctagtagatgttattttttccactgatggagacaagaaagtcaaagggagatgaatttgaggaatattgtgagatgagcgtgaggctggttgaatttgagctaaaaccaagatattcaagtgaacataggatctggaggcatcagttttggaggcaacttctggcagagtgaagagctgattccctgaaaggggatgggcattgttaggaaagccacagggagaaaaaaagaccaaggcttgaatcttggaaaatgctacactccatatcagaccatccactagcactcttccacactctactgtaatcccaattcaccagacactccaacacctctatcccttcctgctgctgagggaacttataaatattgagttactctgagctggtctttttttttttttttttttgagatggagtttcgctcttattgcccgggttggagtacagtggcacgatctcagctcaccacaacctccacctcccaggttcaagtaattctcctgcctcagccccccgagtagctgagattataggcatgcgccaccacgcccggctaattttgtatttttagcagagttggggtttctccatgttggtcaggctggtcttgaacttccgacctcaggtgatccaccagcctcagcctctcaacatgctgggatttcaggcgtgaaccaccgcgcccggcctctgagccagtcttaacacctagtcagcttgttctcccattaaatcctgagaacagacctgtgaggtagatcttccagacccattttatacaggcaaaactgagaccctgagagatgaatcaattcatagcatgtgaagtagtttccctgatttccattcagtagggcacctactatgtgccaagattggggaaaataatgatattgggccctaccctctagaggccacaatctggacagagataaggtaggcacgtaaataaggataaagtaaggtgaagcccagcagctccaggagacgtagagataaggtcttctacagtccaaagggctgaaggcatcacaggcagcttcctgaaggaggtaggcactgatgcaagtcaggcctggaggatctggggggacgtgctataacaatgactcttgtcccacaggtactgtgtccggggattgcagccgttcgggcagggggcaagggctgctgtggtgctgggtgctgtggaaaccgctgcagggtaagatccagattaagaaggaattcagggctgggggtggtgtctcatgcctgtaatcccaacactttagcaggctgaggtgggagtacggcttgagccaggagttctagaccagcccaggaaacatggcaagatccctatctctactaacaatacaaaaattagccgggcgtggtggcaagcacctgcaatctcggctacttgggaggctgaggtgggagggccgcttgagcccaggaggtccaggctgcagtaagcagtgatttaaaaaaaaaaaaaaaaaaaaaaaaagaagagaaaagatacagaaattagccaggcgtggtggcgggcacctgtaatcccagctactcaggaggctgaggcaggaaaatcacttgaaccctggaggcagaggttgcaatgggccgagatcacaccattgcactccagcctgggcaacaagagtgaaactctgtctcaaaaaaaagaaaagaaaagatacagaaattagcctggtgtggtggtgggcgcctgtaatcccagctactcaggaggctgaggcaggagattacggtgagccaagattgtgccattgcattccagcctgggcaacaagagcaaaactccgcctcaaaaaaaatgtatttttattttattttacatttatttatcttatttattttagacatagtcttggtctgtcacccaggctggagtacagtggcacgatcttggctcactgcagcttccgcctccctagttcaagccattcttgttcttccagcctcccaagtagctgggattacaggcgcctgccaccacacccagctaatttttatatttttagtagagacggggtttcactgttggccagagtggtctgaaactcctggcctcaggcgatctgccccccttggcctcccaaagtgctgggattacaggtgtgagatatcgtgcccagcctcgagtcaggtttaaaataaatttcccttcaaaccccgggcttgcagttaggctaacctgaaagccagcggccgccgagattcactggggttgtagttcccccctctccccttcacccgcctacccctcaggatcattgagatctgagatttgtgggtgccagggaagggtggggtggggcctgggagtccgcagaggagcttgtgtagctaggaattccatagagagtgctgtggttctgcaaggacaggtgcagaaacagagtccgaatttctaatttttttttttttttctttttgagacggggtctggctctgtcgcccaggctggagtgcagtggtgcgatctcggctcattgcaacctccgcctcccatgttcaagctattctcctgcctcagcctcgggcatgtgccaccacacccggctaatttttgtattttcagtaaagacaaggtttctccatgttggccaggctggtcttgaactctcgacctcaggagatccacccgcctcagcctcccaaagtgctgagattacaggggtgagccaccgcgcccggcattaaaaaatacattttaacaacccgactggagcagatttcgataatgcgtgggggctggcgctgagcgtcgtcacccacaggtggggagattgggccttacctccccttccacaccacatccagatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgtaaggtttagcctgtattcgtgtcctccattctctgcctcttccctcccgcccttcccccgtggactgggacacctgggcgggactcgacttcgagggcactcgctccacgtgggctacctgggccttagcaaatcccctgggacgtattcttgggggcggggtggcgcacgcgcacgctgccttctcccacgtggcctcacccctcccacaggggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggtgaaatggcttgcggtggagttgtagagggaacctgcctggtcctggctgcgttctcaccttctcttttccgcaggacacacctcactgaggctccactgaccgccgggttacacctgctccttcctggacgctcactcccttgctcgctagaataaactgctttgcgctctc

SEQ ID NO: 1657 - DNA, 22647 bp, Homo sapiens
atgaggctgctgcggcgctgggcgttcgcggctctgctgctgtcgctgctccccacgcccggtgagtgacccccgcccggccccggcgccccctccctgcccccgccccgggatgtgcggcgcttgctgctgcagccaccttttcctgcagtgctcggggtgacagccggtccggagcgcgggagggtaggggagcgggagaggagggaaggtgcgtccacccacctgtccccagctggccgggcccaccgcgtccctgcccctgccgccgaccggccagctctgcaggtctctgcgggtttgggcggatgggggggcagtcgtgacggttgggcgggagtgaagctcctggccccctccccgcgggctcttgcctctgcagggcagccagatcctcccacccggatcgccctagggctccaggggccacaccagagtgggggatgaggcatgcccaccccattcccaagtcttctgccccagggtgggcagctgcctgcagccatggccttgtttccccaggtcttgggacccaaggtcctgctggagctctgcgatgggggggcttaccccagctgggaggcccaggagcccctgaggtcacggaacccagccgtctggttagggagagctccgggggagaggtccgaaagcagcagctggacacaagggtccgccaggagccaccagggggcccggtgagtggggctgggtggtgaggccaggggctgaagcaggcctcagagccccaggaagcccacggggtaaccagggttggagtccccctcagcagctgccccgcagggtccccttctgtacagtgggctatccggtgggtgctggagcccactggtggggagcaccaggcctgcccagccccagggcccccttccattattgtagggtcccctgccctcagtgtacagggaccactaatgcctaggtctcaggtctgctttgggtcagccttccaatggccccctgctctgctctggccaaagctagttgttctgttcaaaacagggcttggatggggcaagttgggggcagggagaggcagcccagattccagtcagggattagggctctcaggttctcaccacagccaccttagtgggctttcttggaacaacttagtgcttgctcctgcctcagtttccacacagtgcccagataggcttgttgttcttcctgtcctggctgaaggtggggccttggaaaataacttgaggccccaagccagctctacctgcctgcccactgtccctttcagctgccaggcccctcctgcctcccagaggaaggttaggcatgaaggagattaattgcaattaataattaattaatatcatgtgaataataatcacccagatggaatattcattcagcacaccccagcgctccaagagctggagctgaaagtgagccaggccaacagggcagcagagggcaggttggctggcaaaggcccggcacaaacaggaggtataggggggagacccagaagaggggtacaactgaggcctgggaagttttggcagcggggagtggtgggaggtaaattgggctgggcagagggaggaaggagggaaacggaggctaacattacggacatctgtcagactggcatctggccctgcctaatgtacttggttaaaagcccttaagggaggggagcagagggggatgcggggtggtgcaggggtggagaatactgatgaaatggatggagcaggaagggagcatgcataatagatggaccatcactcagggccgtgcagaggggcagggggagggggctaatggtccaaggcccgcagtcactgggggtggggtggggggtggaagctgccttcagcaactgcccaggctccctgggaggtgtgcagtcctagggccggggatggggtgtcctggccgctgagtctggctgtcttgcctggtgtcactccctacctgtgaactgtgcaccccgtggttacactgtgggggaactgatggtctgcccgactgctgggactctggcttatgctttaagggatgtgcagattgagtcatggagggatgtcaccgcagggaaaggggacagagttgaggaaaagcctggagtcaggtagggatgaaaagtcaggtattccaactgggcaggttgctccttcagcctgaccctttccgaacagagacagaggtggcaaagggtaggaggttctgggctgtggtggtgtctgcagctgcgtgggaaggtcaggatgggtgcagttgaactgcttgggttgggggtctctgtgttgttctgcaggtgagtgagtgcatgtgaggtgtgtatgtgatccaccgattccagatacttctgaggggtgtctgagagcctgcggggagggaatggagttccatggatctgccgggcagtgattatctccaattttggggtctctctgagactgagacttcctagggccctcatggcgacctcctcaagggacttgtttggggccctctcttatctgtgcctcagtttcccctgaggtaccaaagctgtggacttctatgggccactctgccaagctttgtatgcactctacatcacttatttctcacaactctgtaaggcttgtaacttttgtgtgtttatgtgtgtgtgtgatggagttttgctcttgttgcccaggctggagtgcaatggcgtgatctctgctcaccctaacctccacctcccgggttcaagcaattctactgcctcagcctcccgagtagctgggattacagacgtgcgccaccatgcctggctaattttttgtatttttagtagagatggggtttctccatgttgctcaggctggtctcgaacttccgacctcaggtgatctgcccacctcggcctcccaaagtgctgggattacaagcgtgagccactgcgcctggcagcttgtaacttttgtcagccccattttacagatgagcaaactgaggctcagagggatgacgtaaattgcccaaagtcaatcagatcttaagcagtggaggtgggagttttctccacaccagggcacttcccagttctgcctccagggctctctggatttgggtccaggaggcagtctcccaactctgcccagagcaaggagacaaaaagacacatccagaatattttccccaacggtaaggagatatggcaaaccctcaatctcctgcctggcatttctccctggggttagagcgcttttggcctcagagccatggggtctgatggtggatccagtgtggacttgagcccgtgtgtgtcctagccagaagtaccccagctgggcattgcttggtttttgccttaacttactgccctggtttggaacttcaagcctagccggtgtggagctggcagcaagatctctggtcatgtgtcgagtccaggggcacatgctggctggcagggcctggggcgctgagctgctgtggctttgggcaggtcgtttgacttttctgagccccagtttcctgttccctaaaatcaggatggtaacatatctcagtcccacctactaccaggaggtggtgatgggaaagagctttacgtgctgaggattcctggcttgacaggggcaagggtgggggtgcgactgggacaggggaagagatatagcggccaagaaggaattagaagctggagaaattagactgggtgcattggctcacagtggccaaggtcaggggattgcttgagaccaggagtttgagactagcctgggcaccatagtgagactcccgtctctaccaaaaaaaaaaaaaaaaattacccaagcatggtgctgcgcacctgtagtcccagctacttgggaggctgaggctgcaggatcgcttgagtccaagagttcaaggctgcagtgagctatggttgcaccactgcactccaacctaggctacagagtgagatcctgtctcacacaatacaacaacaacaacaaaagaacaaggtagagaaattacaattatttactaggcctttttggggcaggcactcctttacgtggaattatttaatcttcatcacagctcccagaggtggggctgttattcccatctcgcagatggagaaacaggcacagagaggcaacgtaactgccccaagtgacacagcacttgagcacagagtcaagactgatcctcaaagcagggctctcacccagcacgctgccacctcttgctcagggctgaagggaaaagagacacagatgcacccttgccctctctttgctactgcactcaaccccctcacttctgtccagcctggaagcaggctaggcctgaggcccagagaagtgagggagcttctgggagtgcagaaacctgtggttccagggagcctgcagccgaggggtggtgcaggtcaggcaagactaccgtgtccagttgggctggttgttcactccactagggtgactgggcaagcagtaagtgagctgaatgcaatctgtgggcttatggggccacatgcgttctgacttgcagggggatcttgttttctttctttttttttttttaagacagagtctcactctgtcacccaggctggagtgcagcagcatgatctcggctcactgcagcctctgcctcccgggttcaagtgattcttgtgcctcagcctcccgagtagctgggattacaggcgtgcaccaccacttccagctaatttttgtatttttagtagagatggggtttcaccatgctggccaaactggtctcgaactcctgatctcaagtgatccacccgccttggcctcccaaagtgctggaattacaggtgtgagccacctcacccggtcttgggacccctttttctaatttgcaccaagctgctgtatgggttatgcctgcccctggggagacccagactccttgggaacaaggagagggcaggacatggggaggtgactagggtcaggggtgaggaggtcgcagacctggtacatagaagctcatctgagccagctaggggaggggtgcctcagtctctgggctaagctcttgtgagagatgcccaggccagcatttactggaagcaccaccccagaagccctccacggtgggtgtgtgctgcaacagtgtttgtgttttcgtcctgcagaaaggcggagggcagttgagtaaggctcacccccagctcttgaagatgggagtcatggacatggtgccacaggggggccagggtctgtgcctggggccctggtaccccactagagccaaggccatgctatagtctgtgtggctgaagttgcggctctctcctgggttggggcagatggctagaagccagggctaggattttgctgggcccagcttgttcccaggggtgaggtgggggcatgaactgagctctgccatgccagagagttcagcaggcttagttttggtgtgagaggctgcacgctgtggctttgaggtggcacagccttagtgcaggtcctgctcccctgcttctgactgtgtgacctgagccagtcatgcagccccctgaacaccaccttcctcattcataaaatggggatgctcatagtctccacctctcaggctgctgcgaggacttgagatgatgaatgtcaggtgtccagcccaagatctggcagaagagccgatggtcaacatctctgagtgtccggacagggtgctgggccctggtgctggcatgagggctgggtgtcagaaacaggagccaggatatttaggggttacttgtcaggctcggggtggggtccaggggagaaaccacatgagcaggactctggcctgtgggcttggcctcacccaagcaacctcctggctgcctagaggaacccagctgtccagagtctgtccccagagggactgatgaccctgtaaaaggaggtggctctgttctcaaaaatgtaggtcaaatcccatcattggaaatttgtctggctgttctcattgcctgggaatcccgctgccctcttgataaatggagcacccaacacattgccgggggtgggtggggggagctggcaggtgggtgggtgggtggggggtttctcccagctgggacatactcccaggtggagctcctgcctctctggctcctccccactctgcagccacctggcccacaaggtggtggtgtctccttgcgggaggggattccagaaagatgtcctcaggtgagacacctgacaggtaaatcacaccatccacccagatctggagcataaggctaccattctggcatgtccctgtcacagtaggtgatccaaaggagtcgtttatgcagttcctcaaagccctgttcagctggaacatttacacttccttctcgttattattattattgacccttatgataccacatttaaaagggcttttatttaatcctcacagcaatcctggtttttcttttcttttctctttttttttttttttttttttttgtagagacagagtgttttgctgtgttgcccaggctggagtgcagtggcacgatcttggctcactgcaacctccgcctcccgggttcaagcaattcccctgcctcagcctctcgagtaactgggattacaggcacatgccaccacacccggctaatttcttttttgtttgagtagagacagggtttcaccatgttacccaggctggtctcaaactcctgagctcaggcaatccgcccaccttggcctcctaggattacaggcgtaagccactgctcctggcccaacaattctgttttaccgaggggaaaactgaggccgggggcatgaagcagcttatctcaggccttgcgatacatttccattcaacgtgagtgttgagctcgtgggcagggaaaaaaagcaggcatcgcccttgctccagggaactaaaggtcgcccacctgaaaagccaaatcagtgatcaaagaagtgtatgtctactgtgtgcttaaaggcccagaggtggagggcgccagagccctgcatgggttggcaggtgcaggctgtgcagatgagggtggggaggagagggaggtccgggcaggagttccgggtcagcgtgtgaagggccgtgtctggaagtggtggggagcaatggtctcccttctcgaatttcctggagaatttgagaatcctaaggctccttagtctctcccttcctaagactgtgtgtctgtaggtctggggcagagcccaggcacctgtatttgtgcttctgggtctttggcagaatctttgcctttttctgtctgcaccccgcatctggtacagagaggacaaggcacagtcgctctgaagcagatgtctaggagagtgggtgggccagccagagaggagcctcgggtggaaggggtggtcacccctgccaggcagtcacagctgctgtggcgacacgaactccagccccagggtgagatccagccccacacctccccagccacccagccatgaccctgggccagtcacctccaggtgtctccctgagcctcatcctggcatttgtaaaatgaggaccagacagcctgggcacgttgagatcaaatgagctggagcatgtgagagcctgggcagccgggggagcaagagacaagtgcagggcacagggtcagctgagggctggcatgacctcaagaccaaaggcccctcccaccagggatggagggacaatgggatgaggtcagaggcagggcaggggcagaaagcagggccaggcagggagcacagtttggctttgatagagcactggcttaggctggacatggaggctcaagtctgtaatcctagcactttgggaggctgaggcgggaggatggtctgagcccaggagttcaagatcagcctgggcaacacagtgagatcccatctcttaaaaaattaattaattaattttaaaaaaagaacattcgctgggcatggtggctcacatttgcaatcccagcactttgggatgccaagggtggatcacaaggtcaggagttcaagacaagcctggccaagatggtgaaaccctgtctctactaaaaatacaaaaaaattagccgggcgtggtggtaggcacctacaatcccagctcctcgggaggctgaggcagagaattgcttgaactcaggaggcagaggttgcagtgagctgagattgcaccactgcactacagcctgggtgatagagtgagactccatctcaaaaaaaaaaaaaaaaaaaaaaagaacattggcctaatgctgggcgggcttggggcggtcttgggactctgtgccagcaggagtcccctccccactccccaggtgccagggccacagagattctggggactgagataggtttgtgtgacccatctcttccctcagaccagggacagggttgtgtccccgcatggggccaggccaggcaaacaccccttggtatgtggtctctttctttctcctaccgcctttgggggctctcccagccccctcctgggccacctccagccaggcccagcccccagccccagctgccccggcactgccccaggggcttatctggtctgagccctgtgtcctgctgggctcagctgcaccagatggggaagtggtgagagctcagcaggtggcaggaggtggtggacaaggaggctcttaaggtatctggccttcatcccccatcagctggggctttccccagagtggggactggcttggcctctgcagagaggaagcaggcttgatggggtggctcgcagacctcctgagtgagggagattctgttggtgccagggcagactctgctggaatctccaggcccaggatggtaccaatacgtagccaacctcctggcctcgcatctgggctcatctgaccattttcagtgggaaaatctgaggcacagagaggttgctgggtcatccctggggctgcacggtcagagagcagcattggggcaaggggtctggcaggctgctcctctaggcagctgtggagggggctggcataggggcttgttggtgggaggcagatagaacaagcaggaacagtcccaggggcaggggaaggccaggatggttcaggccatgggccgggaagaggatgtggcgactccttgtccttgactttctatttcgggctgatcaatgctctaggggctcaggatggaattgggagccttggtcagcctggaatagggtgagtcggtgtccttggggcgcaaaggtcagcccacccaggccctggccgttggtgccccccttgctcctctcccaggacctctcatggacactgggccctcttccattttactccacctttggggtgagacagccctagaagcagactccctagcttcaccactttttagctgtgtgaccttgggcaagttagtcagccccactgtgcctgtctcctttcagatgggaatggcagtaatctatcccatagggttgctgcgaagatcaaacagggcaatactcttagtgtttagaccagggcccggcacacaagaagtgctcggtaaagattagcagtgatgaggtggttgaggaggaagccgacaaggcacaggctatggatttcatgaccacaaccttggggctctcttccttcctgcaacctgccgtccccaccacaaaggccaggcagcgaacaaaagcctcccatttgcagggcagagtgggtgaccctcatgttggggtctggagtcagtcttctggaatgaacaaggggtgtggagaaggccccagccctgagtcctctcagcccttcctgggccctgcggttgctgtgatccaggcgtcctcaagcgcccaggcctggggggccgccatcttgctctggcgtggtgtgttgctgtggcaacctggagcctccagccccactgcactctgaaaaatttatcaggaaaacttccatgtttaaaaattaaccatgggattgaaatattaaagatgagctgctttgggtgaggcagagggcaatggatttgggggtagaggagccaagtccttactcccaacaggatggcacctgcccgtcgcccagtttccaggggcctagccatccattcccacccattcgcccctgtccgaggcctcctatgtagatggaggctggggccggggtagggggacaggcagcgagggtcctgcctcccatttcctgtttgtccctttcccatgatactcctggggccctcccgttactctgcctgatggtggggtgcccctcaccagccaggagggcataatgaggcagagggctggccgggctgcccctctccatcccagctgcacctgcagcccagccccagagaggatgcacaggtgcccgggcccagagggcagaaagggggctgtgcccagggctgagcactcctgcctctgcccactagtaaaggagcagggtcgtggaggaagaggagcttggacaaagcatcttgcccccaaatcaatggtcccctcagctgctagggctggccaccccttccccagggctactgttgctcccgggatccccccgactcccaccttcaggcctccctgggttgactccccctctgccctccccccacccagcctgtccatctggcccaggtgagtttcgtcatcccagccttcaactcaaacttcaccctggacctggagctgaaccagtgagtgtggccttgagcccaagaggaagggcagtggtggggcgggggagacatggctagggcctggctgctgggggtctgggggttgggcctgggcagaggggacctgggtcctgacctgaggcgagcctcaagcccgacctcacctcgcccgtgaccccccttcctgctgccccctctgtctcagccacctcctctcctcgcaatacgtggagcgccacttcagccgggaggggacaacccagcacagcaccgtgagtgccactgcaggggaccggggccggggatggaagggaggtgctgtttctgtggttctgtggtcacaggtgtagggacaggtggccactggagatggggtcctgggcctggcccctcagcaccttccctctctcccgacccaggaggctctgagggtggacagtgggcagcttgagtgcatagggccctgaagtcccctcacttggccccagagctctgacccccagccagcccacgtggggcctacagggacactcgttccgagcaggctgccaggaatccccctctccagactcttctgagagggacagctgaggaaaggcccttcttactcaatatcaaggccccgaaaatcccagctgcctgggacactagggtcccagccctgaaggctctagagcctgaaaatgaatgagtgtctataaatagcctgtctcccccccccccgcccccactgcctgttcagtaactggagcacaagtaattctgcaggaggcagagctggagcgggagggtgccactggtccccccagccccaacccatgagtctggccaggaggacacatgctgcccatcactcctcagccaaccacaggcccaggggtgtcctgggaggcagtgcatgaggttgtgtgtgatgttaggggcgagtacatgattaaatgaggtaatatatggttagtgccagagcagtgctgggtacatggtaggtgctaaataaatgttgcctgttattctcaaaggagtctgatcccttccccagccccagcaaatggctaagaacccttgctgtacgctgggctcctataatcccatcactgggaggctgaggtgggcggatcacgtgaggtcaggagtttgagatcagcctggccaacatggtgaaacaccatctctactaaaaatacaaaattaaccaggcatggtggtgcatgcctgtaatcccagctacttgggaggctgaggcagaagaattgtttgaacccgggaggcggaggttgcagtgagctgagatcatgccattgctctccagcctgggcaacaagagcgaaactccgtctcaaaaaataaataaataaataaatacaaaaattagctatgtgtggtggcacatgcctgtaatcccagctactcgggaggctgaggctaaggcatgagaatggcttgaacccaggaggcagagggtgcagtgagccaagatcacaccactgcactccagcttgagcgacagcaagaccctgtctcaaaaaaaaaaaaaaaaaaccattgctacagtccagcttcctcattttatagatgacgtgaaggaggcccagaggttcctaaccccagagggctaggaacttgcccagggtggcacggcaaattaggagcaccagccatctagaaacaggctccagagccccaggcatacccagggattgtggccacctgcacacagggcagcttcagtgtcccccaaaaagccttgaggcccattggctgcccccggcctcatgccagcgttctgctcactgttctgctccttcagggggctggagaccactgctactaccaggggaagctccgggggaacccgcactccttcgccgccctctccacctgccaggggctgcagtgagtatggggaggggccgggcagctgggagaagcctctggcccaggcctggggacggaggggagctgcgcctctctctccacagtggggtcttctctgatgggaacttgacttacatcgtggagccccaagaggtggctggaccttggggagcccctcaggtaagccccacacaaccccttgccatcctctctggtggccctgccaagcttgtcccaacagctgttgctgccacctcttcctcctccggctcctccctcagtaaccccagcctcactgccctcttcagtgaccccagctctggttccctccctcctgtgccccagctccccctgtgcccccagctccaatgtcccatctgtcccataagtgacctcccattgggctccaatgtcctttgcccctgtctctcagggtgcccccaggtcttgaccccggaatctgagcatctgggagatcagatccgacatgggagctgtggccagttctgggtcaccccagggtggggtggaggcgagggctggatctggcccccgccaagtgggcctggagcaggcccagttggcaccccaagaactaatttcccctcattgcagggaccccttccccacctcatttaccggacccctctcctcccagatcccctcggatgcagggaaccaggtaagggagggaagggggggtggggaggggccggctgtgcccccctcacctgcccctccccacaggctgcctgtttgctgtgcctgcccagtcggctcctccaaaccggccgaggctgagaaggaaaaggcaggtacgggggcccgcacagacctcgggctgcagagacctcgggctgcagagagacctcaggccgtggcccagagcaggagggcaccctcatctatggctggggcgaaggaaggctcagatggatgtggctgggggccagggaccgtgtctgggagaagcccccaccccttccctaatgctggcatctacagaggccccatcctgggcaaaccgaggctgcctgccctcattccaaagctgaggaaggacaggaccctctgccagtggggagctggcactgtccctggctggagtccagacccccccatccccaccgagtctgttcctggcttggccatgagatcagtcagacatggaagggactgattccaagtgcccacccaccccccaggtccgccggggccaccctacagtgcacagtgaaaccaagtatgtggagctaattgtgatcaacgaccaccagctggtgagtgccagggcagggacagggcgtgacactgggaggcccctgaggagcctggccctcctcccattcttctctctcccagttcgagcagatgcgacagtcggtggtcctcaccagcaactttgccaagtccgtggtgaacctggccgatgtggtaagcagctctccctccctcccttccctcctcctcatgccccccaccccaccacacacattagggggcactgtcagcccctggctcccacttcctggagagaacagacaggccctcctccagccctggccccaacacccactcccaccctccagccccctcatcttctccccagatatacaaggagcagctcaacactcgcatcgtcctggttgccatggaaacatgggcagatggggacaagatccaggtgcaggatgacctcctggagaccctggcccggctcatggtctaccgacgggagggtctgcctgagcccagtgatgccacccacctcttctcgtgagtcccccaccctgcacctcctgccagcctctgctagttgctacagtgcttgggattacttaacacctgccctgtgctggctgctcctctcagagtctggggactgggctcaccttgcacctgccacctacccccagccacatgcaacagctgggcatcatcccctgaatctgaggttgatgcccttgtcttagccctggtggtcctcttctgcctctcacctccccttagttctgtctttcccctttcaaactgtcccagcatcccttcctcagggacccagtgccctagtagggaaaaaaatctaataaaagggccttgcaactagagatggtctactgggagcctctcctttgccttatgggcaaaagaacccaaggaggggccaggcgtggtggctcatgcctgtaatctcagcactttgggaggccaaggcgggtagatcatttcaggttacgagtttaagaccagcctggccaacatggtgaaaccccatctcaaaatacaaaaattagccaggcgtggtggtgtgcacctgtagtcccagctactcgggaggctgaggcaggagaatcgtttgaacccaggaggtggagattgcagtgagctgagatggtgccactgcactccaacctggaccacaagagtgaaactctgtctcaaaagaaaaaagaaaaagaaagaaaaaaaagaacccaaggagggggggaagggtcttgcctggggtcaccaaggctgatgtaaagggccaggctcacctcctgaggaaggactctagtgtgaggggctccccaaggccccaccaccacccggggagccacaggggagggcaggaggccatcctgacagcgcactcccttccaggggcaggaccttccagagcacgagcagcggggcagcctacgtggggggcatatgctccctgtcccacggcgggggtgtgaacgaggtgagcagtggggggacatggctggggtggcggctgagggaaaggggcttcaggggcacgacgtgcctgttggaagatgtagacatctgtgccccatcttccccacccccagtacggcaacatgggggcgatggccgtgacccttgcccagacgctgggacagaacctgggcatgatgtggaacaaacaccggagctcggcaggtatcctcccccagaggcccccgtgtggcccacgcccagcagctctggaacgggagggtgacagtgggaggggtggtccttggcctccctcatatccgcctggctcacccctcaggggactgcaagtgtccagacatctggctgggctgcatcatggaggacactgggtgagttcttggggacaaaccgggggaaggtcttgggcgaggggagtcttagagcgagcattgtttggcagtctggaccagggggctcaagaggcccagctcacagaaccactcaggatcccaagaagcccagttttccgcaaacactgccccgggagacccagatttccctgctgggacaccaaaaccggccaggctgcagtgcgcatcgtggccactgggcgccgcccaagcctcgcatggagacaccttccctccagcgcggctgcgagtccccaggttcagcggaggggatgggagcgacagggacaggcgggaggattctggtgcaatcccggggcagatcctccgcctcctcgcgatggtgacgaagtcccccagtgtaccccctccccagccttgagaggggtgagggtgggttggaggggagcagccagcagcacctcccctcgccctatccaggttctacctgccccgcaagttctcgcgctgtagcatcgacgagtacaaccagtttctgcaggagggtggtggcagctgcctcttcaacaagcccctcaaggtaccagccccgcggcggggagcatgggagcgggccctgggcggggtccgggccagactcccgacctgtcctcccggtccagctcctggaccccccagagtgcgggaacggcttcgtggaggcaggggaggagtgcgactgcggctcggtgcaggtgagcggtggtgcgggcgccaggtggggaaccgggatgcgggggtgggcacgagggagcgtctgagtgggaggattagggctcgcccgcctccttcccctcctcccgcgtccctcaggagtgcagccgcgcaggtggcaactgctgcaagaaatgcaccctgactcacgacgccatgtgcagcgacgggctctgctgtcgccgctgcaaggtaagcaggaccggccgggaggcggggccaggacgcaggaggagcgattggaggccttcatataaggggtgggagctagggagggaagcggagccttcggggacgaaggcctctggggcagggcttgatgcgaagacagcgccaatggggagcaaggggcggggctgaaggatgttgaaggcggggctacgaggagcgggaagggaaggctgcccagaatcaaggaggggcgggaaggtgggcgggcttgggggcggtgctgagtgcgctgggagcgaggtggggagcgttcaagaggtggtgggagcagggaaataagaacaggcctgaaacggggccctggggagctggagggcccggggatgtgggggtccagagagcgaggggcctggggagggcagggccgaggcatccatcctgcctgactcgaggagcgcgtctcttccctagtacgaaccacggggtgtgtcctgccgagaggccgtgaacgagtgcgacatcgcggagacctgcaccggggactctagccaggtccgcccggccccgccgtcttgtggagccctgggcgaggcaacccctacccttgtcgatttggttttcccggacgagtgctcagcactcccctcctctccacagctggcatcgacctccactgatcagactgttttcttatctgagaaaggggttcttcatgctcctggccttgttccttcaatcattaaaccagaatgtatcgtctggctggtattcccagcgcctggcccggtgcctggtgtaggttagggatcagagtagacgataatattagttaacatctattacaacctaattacatgccaggcatttatctcccagccctacgagggagggaggctggagcggctctggggcttgcaaatccgtgtggtctgggtccagaaccagacagatcgcttgtcctaggcgtggaagagccctgtggcatgagcccccaatggggggcacttggtaccccagcattcctccctggggcagccctcagctccagtcctgggactgctccgctcaaccccacccctctctccacagtgcccgcctaacctgcacaagctggacggttactactgtgaccatgagcaggtatgatggctgccccctgagcctgggattcagggcagtctcttgtctccactctgaccactcagcatctccatcccttgcctcttaattcttggactctcagggccgctgctacggaggtcgctgcaaaacccgggaccggcagtgccaggttctttggggccatggtgagtctggctagggctgggagtggggactccggaggacccagagctgagaagctggggagagtgggttccagctgaacaggcccccaagtgtgtagctccccaggatctcagggacccaggcagagtgtgggagatgcaggcctgaggtcttggggtgggtcctggggcgcgtggggtcacttggcatcctctccccacagcggctgctgatcgcttctgctacgagaagctgaatgtggaggggacggagcgtgggagctgtgggcgcaagggatctggctgggtccagtgcagtaagcagtgagtactgaggctcccagagggcctctcagctccagggcaggtgtgagacttttcagagatggggcagcaggttctcccaggaggagcctgtcagtcccaatgggcgggcacgtggcaaatgaggtggcagggtgcagggtgagggcagattagagttcagtagttgagtctgaggtcaaacttggggctcactgtctctatatgccccaacagggacgtgctgtgtggcttcctcctctgtgtcaacatctctggagctcctcggctaggggacctggtgggagacatcagtagtgtcaccttctaccaccagggcaaggagctggactgcaggtgctggccaggaccaagactagggaggggaggttgcagctgtgctgggggttaggagacagggggctgaggctggctgtgtcacttccccaggggaggccacgtgcagctggcggacggctctgacctgagctatgtggaggatggcacagcctgcgggcctaacatgttgtgcctggaccatcgctgcctgccagcttctgccttcaacttcagcacctgccccggcagtggggagcgccggatttgctcccaccacggggtgactgcctggagcctgggatggcgggagaagcttacaagaggggacaggcccctgctcacctctcctggccctgccctgcctctaggtctgcagcaatgaagggaagtgcatctgtcagccagactggacaggcaaagactgcagtatccataaccccctgcccacgtccccacccacgggggagacggagagatataaaggtgaggctggagctggccgaggggggtctgtctgtcctgctctctatgcctgtccttgccagctaagccctgccatcctccccaggtcccagcggcaccaacatcatcattggctccattgctggggctgtcctggttgcagccatcgtcctgggcggcacgggctggggatttaagtaagagacacacacaccctgtgccccctggcatccttgaggggggatcagaatccctactggtggagctgagggggccctccctgaaagcccaactgaaccagagctcacacgtcataggtccaagtagcctgcagggcttaacatttagaaactaggagattttaggctagatgaggtggctcacgcctgtaatcccagcactttgggaggccaaggcaggcggatcacctgaggtcaggaattcaagaccagtctggccaacatggtgaaaccccgtctctattaaaaatacaaaaattagccagccatggtggtgcgcacctgtaatcccagctacttgcgaggctgaggcagagaattgcttgaaccggggaggtggaggttgcagtgagctgagatcgcaccattgcactccagcctgggtgacagagcaagactgcgtcaaaaaaaaaaaaaaaaaaaaaaaaagaaagaaagagagaaagaaaagaaaagagaaaagaaatcaggagattttacactagcaattcggatttccagctctggaaacatgaaaaggttgagccccagcgtgcctctaagcatccccaaatagccacagagtggagctgggcaggggccacccaagccaggcatgtgtcctccagtctccagtccccacccagcctataatgctttgtgcgtgtctaagtttggggtccttgtgctggtctaacccccttaatgtgcagaggaggaacccatggcccaaggtcacatgattgagttagtagcagagtcagagctggaaccgggacgcatttttgtgggtgccctgggtaattctccctggcccttacattagtgtccaggccccggggaccccggccccgctctggggcaaggggtcgcatggcagccaaaggcccctccctgagagaagcaaaaggtcagatgtctccttttcctctccccttccaccatcctccccctgcagaaacattcgccgaggaaggtacgacccgacccagcagggggcagtgtgatgccggccacgtcatccctcccgctgtccttgtctcctccatctcattcgtcaccccgcgttctgttgatggggagcgggggctgattcccccacccctgctgccaggctgtcccggcaggggtgggagagcctcgctcagggaagaaggtcccagctgccctcgccctcgcccgctcaggccacgtccttctcgactgccctgctgcggccaggccctcccctgccaccaggtggaactggagctgcgcccctggcagtccccatccccgggagggccctccctgtgcgtcccatctgttttgtcttccatatcaccactgtctgacctcccgcagatcccttccctggccagcctgtgacttgccgcctgcctccagggcccagcactgagctccggggccctgctggggggctctccccgtggcccctgctcacgtcctcccctgatgccccctctccgttccaggtccggaggggcctaagtgccaccctcctccctccaagcctggcacccaccgtctcggccctgaaccacgaggctgcccccatccagccacggagggaggcaccatgcaaatgtcttccaggtccaaacccttcaactcctggctccgcaggggtttgggtgggggctgtggccctgcccttggcaccaccagggtggaccaggcctggagggcacttcctccacagtcccccacccacctcctgcggctcagccttgcacacccactgccccgtgtgaatgtagcttccacctcatggattgccacagctcaactcgggggcgcctggagggatgcccccaggcagccaccagtggacctagcctggatggcccctccttgcaaccaggcagctgagaccagggtcttacctctctgggacctagggggacggggctgacatctacattttttaaaactgaatcttaatcgatgaatgtaaactcgggggtgctggggccagggcagatgtggggatgttttgacatttacaggagggcccggagaaactgaggtatggccatgccctagaccctccccaaggatgaccacacccgaagtcctgtcactgagcacagtcaggggctgggcatcccagcttgcccccgcttagccccgctgagcttggaggaagtatgagtgctgattcaaaccaaagctgcctgtgccatgcccaaggcctaggttatgggtacggcaaccacatgtcccagatcgtctccaattcgaaaacaaccgtcctgctgtccctgtcaggacacatggattttggcagggcggggggggttctagaaaatatagttcctataataaaatggcaccttccccctttcaagaagggtgattctggggccgactcagggtttaggtgccccctggtgtggcctagatgtccccacctgggccatctttctggggaggactctcccaggtagggaaggccagaggtggcccagtgcctggagggttagggtctctgcctgggatatgcaagaggaagtaggaaagggaggtctcatggatgatcctaggctgctagaagtccttaaggccccatctagtccattccactccctacccccattccagagccgagtagtaagtttacagatgtttcccccattacgtacccccacccatccctgctgcagcgagcctgagagccaggtagagccaggcacagctcctcagtcttctcacacagtcctgccggtggccttccctcatgacccttgcttgggagggtggagcactggctccttgaccctaaaaggtagctggcaggggcaagatgggggccagctacctaatggatgaaagccacaagtgaatacagttcttgtcaccagggttgccctgccctcactcggcagggagttctgacaccccagggcccgtgagctacctgcttgagcccctgtttctggggcaccttcgaggaggcgttgtggagggcatcgccccctgtttattcacaacaccctcaggggcaaacaggcctgggacccgctgacaccattttgggtagctggatgcacccgacagcagtggggtccacacactgagctccagctggcactgcccactcaagggctgagtggaggggcccctccggccagctctgctccaccagccctgcaagctgatgcagggcgggggaagggctgggtgttgcactattgctgcgctgccttaaggcatctgtcctctggtggtgcacccgtgcacacaggtacagtgcatctgggcacagcttttggatccacacctctgcacaagtgtgaatacctctgcacatatgggcgtatctgtgtgtgctcgtgtatatggggtggggaacatgagacttcctgtgaccagtccaccctggctcccagctgtctgtatcctcctgccccgccctggcgagtgcctaccctggcagaacccagggaggagtggaggctgcctctgcctgggcctccacacagcatcctgtacatacgccacctgggctgggggtggggaggcagggccaggagcatcgattaaagatcacatcctggggcttccagggagctcacaccaa

SEQ ID NO: 1658 - DNA, 21765 bp, Homo sapiens
aaggctgtggaccccagagaaggtggcaggtggcccccctaggagagctctgggcacattcgaatcttcccaaactccaataataaaaattcgaagactttggcagagagtgtgtgtgtgtgtgtatggttgttgggcgtaggacaggtttcggggatgcgcggtacgcggtaccacccctcggaggcccccacccccagacgcccaggccgcctccccactccccctcaagcagccccagccggggactttccgtcgcggggaaggggcggggaccctgagcgaaaggtgcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggtgagtgctggagggagctcgtgtcccgggcgctgccgctgcgctccccgcgaaggcgccagtgctccaggataagccacgcgtatgcagagcgaacggtagaggtgcaggcgccactcggctcctcccggggcagggacccggcgacactggggaatgggcggcagcgaggtcgaaccggagccccggggcggggtgggggagctctctgggtggttaacaggatgtggcgagcacagggaaagggggggtttgcacggagcccgggcaggggtgcctagcgcctcccttcctgctgctcatttccctaagcccccccaccttgcaattgtcagaagtccaagttctggggtgtgcaggcggaagggggggattcgaccccctttcctgagaccctctgactccctctccaggcagcgccgggccactgcagtgctacggagttggacccttgggcgacttgaactgctcgtgggagcctcttggggacctgggagccccctccgagttacacctccagagccaaaagtagtgagtacagggaggtgacgtggggaaacaggctttggaggtggccgctcaggccccaggctgctttggttgaaaggttccaggagtcaagcctggccaacatggtgaaaccctgtctatactaaaaatacaaaaaaaaaaaaaaaaaaaaaattacccaggggtggtggcgcgcgcctgtagtccctgatactcaggaggctgagacaggagaatcgcttgaacccgggaggcggaggttgcagtaagcccagatctcgccactgcactccagcctgggggacagagggagactctgtctcaaaaaaaaaaaaaaaaaaaaagaaaagaaaagaaaagaaagtcccaggagtctgcccccctcccccaatactcctccactccttcaattctagcttccctcgtttctttgctgtgtcaccctgggcaagtcactttccctctttgagtctccttttcatttctctattaaatagcaatcatagggccaggagaggtggtttgcacctgtcatcccagcattttgggaggccgaggcgggaggatcgcttgagcccaggaggagttcagagttttagagagcccgtcacttttttttttttttttttttgaaacggagtttcactcttgttgcccaggctggaatgcaatggtgtggtctcggctcactgcaacctccacctcctgggttcaagcgattctcctgcctcagcctccagagtagctgggattacaggcatgtgccaccatgcctggctaatttttgtatttttagtagaggggggaggtttcaccatgttggccaggctggtcttgaactcctgacctcaggtgatccacccgcctcagcctcccaaagttctgggattacaggtgtgagccaccgtgcctggccgagagcccgtctcttaaaaatataaaatataatataaataaagggaaataggccaggcgcagtggttcacacctataatcccagcactttgagaggccgaggtgggcagattacttgaggtcaggagttcaagaccagctgtagtaattccagctactcgggaggctgaggtgggaggatcacttgaacccaggaggcagaggttgcggtgagctaagatcgtgccattgcactccagcctgggtgacagagtgagactctgtctcaaaaaaattttaaaaaataaaagctggcgtggtggctcacgcctataatctcagcactttgggaggccgaggcgggcagatcacgaggtcaggagttcgagaccagcctgaccaacatggtgaaaccctgtctccactaaaaatacaaagattagccgatgtggtggtgcatgcctgtaatcccagttactcaggaggctgaggcaggagaattgcttgaacccaggaagtggaggttgcagtgagctgagatcgcaccactgcactccagcctggccgacagagcgagactccatctcaaaaacactaaaaataaaaaataaaaaagggaaataataacagaacctgcctccgaaggttaagtctgaggattcaaagagttaggtgcttggcaaggagaaagttgcttcataatgtgaacctggtttttattgctgtgtgacattaggcaagtcacttaacctctctgagcatgttaaaagattattcagtgtggtgctggggatgctgcagtgaaagaggtagacagaaagccctgcccacagtccaaggactccatgtgtttcttcatgatgaatcatacctggaaactcataatttcaaattgggctaagtgagggaagaggaaaagagtcaatgaaagataagaatgggagacagaggtcctggatttttttttctttttaatattaatggttaaaatacacacaacaggccctacacggtggctcacgcctgtaatcccagcactttgggaggccgagacaggcagatcacctgaggtcaggagttgcagaccagcctggccaacatggtgaaactccgtctctactaaaaatacaaaaattagccaggcgtggtggcacatgcctgtagccccagctatttgggagtctgaggcaggagaatcgctggaactcgggaggcagaggttggagtgagccaagatcgcgccactgtactccagcctgggtgacagagcaagactctgtctaaaaaaaaaaaaaggccgggcgcggtggctcaagcctgtaatcctagcactttgggaggccgaggcggtggatcatgaggtcaggagatcgagaccatcctggctaacacggtgaaaccccgtctctactaaaaatacaaaaaaattagctgggcgtggtggctggcgcctgtagtcccagctactcaggaggctgaggcaggagagtggcgtgaacccaggaggcagagcttgcaatgagccgagatcgcgccactgcactccagcctgggcaacagagcgagactccgtctcaaaaaaaaaaaaaattcatacaacataaaacttaacgatatttttaaaaatttgttttgggaacagggtcttactcctgttgcccaggctggagtgcagtggggcagtcagttcactgcagcgacttctcaggctcaggtgatcctcccacctcagcctcccaagtagctgggactacaggcatgcaacaccatgcccagctaattttttaaatatatatttttagtagacacagggttttaccatgttgcccagactgctttcgaactactggcctcaagagatccacctcctttgtcctcccaaagtgctgggactacaggcgtgagtcactgtgcctggccaaaatctacgatcttaaccatttttaagtgtccagttcagtggcattaagtacattcccatggtgctatcccggttaccattcacctccagaagggggcctagtttttttttatttgagatggagtttcgctcttgttgcccaggctggagtgcaatggcgcgatctcggctcactgcaacctccgcctcccgggttccagcaattctcctgcctcagcctccagagtagttgggattacaggcacacgccaccacgcatggctaattttgtatttttagtagagatggggtttctccatgttggtctggctggtctcgaactcccgacctcaggtgatccacccacctgggcctcccaaagtgctgggattacaggcagaagccactgagcctggcggggggcctagttttaattggtacagggagggggagtcagagaagccacatcttttctatttttattttagttttattgatttatgtattgattttatttattttgagaagaggtcttgctctgtcacccaggctagagtgcagcggtgcgatcatagctcactgcaacctcaaactcctgggctccagccattttccctcctcggccttcccagtagttggaattacaggaatgtgtcaccatgaccagctaatttttaaaaattttttgtagtggtagctcacgtctgtaatcccagcactttgggaggccgaggcagaaggatggcttgagcccaggggttggagaccagcctgggcaacgtagtgagacccgtctctattaaaaaaaaaaaaaagaaagaagaagaagaagaagaagaggaagaggagggaaaaaagtaagaataattttaaaagtaaataaataaataatttttttggtagagacagagtcttgctctgttgcctagggtagtctcaaactcctgagctcaagcgatcctcccatcttgccctcccaaaataatggaattacaggtgctactatgcccagcctgagattttgtactctttggccatcatcttctccccctagcctctgtagtcaccagtttactctgcctctaggaggagttcagatgttttagattccacgtatcaatgaaaacatgtggtgtttgtctttccgtgtcttatttcacgtaacataatgttcgccatttccatccacattgttacaaatgacaggatttcctttttttttttttttttgagacagaatctggctctgtcacccaggctggagtgcagtggcgcgatctcagctcactgcaacctctgcctccccggtccaagcgattctcgtgcctcagcctcccgagtagctgagattataggtgcgcatctccacatctggctaatttttgtatttttagtagagccgagtttcaccatgtcagccaggctgatctcaaactcttgatctcaagtaatccacccacctcggcctcccaaagtgctgggattacaggcgtgagccaccacgcacagtgtattttcttcttttttaaggttgaatagtattccatcgtgtatgtataccacatttttttttttttgagacaaagtctcgctctgtcgctcaggctggagtgcaatggcgtgatctcagctcactgcaacctctgcctccagggttcaagcgattctcctgctttagcctcctgagtagctgggatgacaggcatgcgccatcacacctggctaatttttgtatttttaatagagacggggtttcgccatgtttgtcaggctggtctcgaactcctgacccgaactctgcctgccttggcctcccaaagtgctgggattacaggcatgagccaccgtgcccggccccacatattcttgatccatacatctggtgatggacacattccatatattggctgttgtgaatagtgctgcattgggaagacacgtccgttggacaaactgatttcatttccttatttatatatttatttttactttttttttttttgagacagagtctcactctgttgcccaggctggagggcaatggagcaatctcagctcaatgcaacctccatctttcgggttcaagtgattctcctgcctcccaagtagctgggactacaagcgtctgccaggacacacggctaatttttgtatttttagtagagatggggtttcacgatgttgtccaggctggtctccaactcctggcttcaagtgatccgcctgcctcggcctcccaaagtgctgggattacaggcgtgagccaccacgcctggccccttcttactatttgttaaacacaccaggcacagtttggcctccaggtctttgcaccctgtgtttcctcttcctggaatgctgttcttctagctactgcatggttctgtcctcatctccttcaggcctttattcaaatgtctcctcaggctgggcgtgatgtccctgcacctgtaatcccaacactgggaggccaagggggatggtgcgggggattgcttgaggccaggagttcgagaccagtctggccaacagagtgagaccctctcgctctctctctctttttttttttttttgaaatggagtcttgctctgttgccaggctggagtgcagtggtgcgatctcggctcactgcaacctccaactccctggttcaagcgattctcctgcctcagccttccgagtagctgggattacaggcacgtgccaccacgtccagctaatttttgtatttttagtagagacgggggtttcaccgtgttggccaggatggtctcgatctcttgacttcgtgatccacctgcctcgggctcccaaagtgctaggattacaggcgtgagccactgcacctggcctgtctctctctttctatatatggtgcttttgttgctgtttttgagacagggtcttatcctgtcacccaggctggagtgcagtggcatgactgcaactcaacctcctgggctcaatcgatcctcccaccccagcctctcaagtagttggaaccacaagtgcgcgccactacccctggctaatttttaaaacattttttgtagacatgggggtctcagtatgtgactgcttgaggccaagagttagaggagaccagcctgggcaacatagcaagaccccatttctacaaaaaatttaaaaattagctgaacattgtgatgcacacctgttatcccagctactctggaggctgaggcaggaggattgcttgagcctaggagttcaaggttgcagtgatctatgatcgcactgctccagttacagagtgaggtcgtgtctctaaaaaaaaaaaaaaaaaaaaagagagagaggaaagggccgggcgcagtggctcacgcctgtaattccagtactttgggaggccgagacaggcggatcacctgaggtcgggagttcgagaccagcctgaccaacatggagaaaccctgtctctactaaaagtacaaaactagccgggagtggtggcgcatgcctgtaattccagccactagggaggctgaggcaggagaatcgcttgaacctgggaggcagaggttgcggtgagccaagatcgcaccattgcactccaagctgggcaacaagaacaaaaatctgtctcaaaagaaaaaaaaaagagagagagaaagcaaggaaggaagggagggagggaggaaagaagggagagggagaggaagggaaggaaagaaagaaaaagagagagagaaaagagcagttatgaccaggtatggtggctcatgcctgtaatcttagcaatttgggaggccgaggtgtgtgcatcacttgaggtcaggagttcgagaccagcctagccaacatggtgaaaccccatcgctactaaaaacacaaaaaaattggccaggtgtggtggcacacgcctataattctagctacttgggaggatgaggtgggaggatcacttgaacccaggaggcagaggttgcagtaagccaagatcacgacattatactccaacctaggtgactgtcttaaaaaaaaaaaagaaaaagagcagttacttttattaccctcattttgtagatgaggaaactgatgcacagagaagttaagtcacttactcaaggtcacacagctctgaagcagcagaggtgggatttgaacccaagcagagcaggctgcagccactctgttggcacaagggtggttatcagtggccctggctctagccgagtgtgcatctcatccccgcctctctcctcacagccgttccaacaaaacccagactgtggcagtggcagccggacggagctgggtggccattcctcgggaacagctcaccatgtctgacaaactccttgtctggggcactaaggcaggccagcctctctggccccccgtcttcgtgaacctagaaacccaaagtaacgtggcaggagggtgggcgctctatgcggggtgggtgctcttggagggcgtggctcactacaccctagtttccccttccccagtgaagccaaacgccccccggctgggccctgacgtggacttttccgaggatgaccccctggaggccactgtccattgggccccacctacatggccatctcataaagttctgatctgccagttccactaccgaagatgtcaggaggcggcctggaccctggtgagtgctggggtccttttctccccaccctattccgggcggggactgaggcaacatctcctaatctgagacccagcccaggactcattctgtgcctgcccctgagcctgtatgcctcccactcaaaatgcctgcatgtgcctcttgttcagctacaaattctcctcccatggctgggcacggtggttcacgcctgtaatcccagcactttgggaggctgagggggatggatcacttgaggtcaagagttcgagaccagcctggccaacatggtgaaatcccatctccactaaaaatacaaaaattacctaggcatggtggtgggcgcctgtaatcccagctactgaaagctgaagcaggggaatcactggaacccgagaggcagaggttgcagtgagctgagattgggccactgtgctccagcctgagctacagagtgagactcagtctcaaaaaaaaaaaattttttttctcctgccaaaataatctatcacccggtcacagtggctcatttctaaaatcccagcaccttgggaggctgaggcaggaagattgtttgaggtcaagagtttgagaccagcctgggcaggatagcaagactcgtctctaagaagttaaaaaataatctgaccaggtgcggtggctcacacctgtaatcccagcactgtgggaggccaaggagagtggatcacctgaggtcaggagttcgggaccagcctggccaacatggtgaaaccccatctctactaaaaatacaaaaaagtagctgggcgtgctggtgggtgcctgtagtcccagctaattgagaggctaaggcaggagagaatcacttgaacccaggaggtggaggttgcagtgagctgagatcgtgccactgcactccacactccagcctggcaacagagcaagactccgtctcaaaaaaaaaaagaagaagaagagttcagaattgtgattattcatgcaattcagagcaacactgagatgcagaatttttttttttttttttgagatggcgttttgctcttaattgcccaggctggagtgcaatggcatgatctcggctcactgtaacctccaccatctaggttcaagcgattctcctgcctcagcctcccgagtagctgggattacaggcatgtgccatcatgcccggctcattttgtattttcagtagagacggggtttctccatgttggtcaggctggtcttgaactcctgacctcaggtgatccacccacctgggcctcccaaagtgctgggattacaggcatgagccactgcacccggcccccttttttttttgagacggagtctcactgtgttgcccaggctggagtgcagtggtgccatctcaactcactgcaacctccacctctcaggttcaagtgattcccccacctcagcccctcaagtaggtgggattacaggcatgtgccaccatgcccagctaagtttttgtattttttttaatagagatggggtttcgctatttggccaggctggtctcgaactcctgacctcaggtgatccacccacctccacctcctaaagtgttgggattacaggcgtgagccacctcacccggctgagatgcagactttggaatctgactacctcagtgctcagctccagcacaccagctctgtgaccttgggctagtcactttccctctctgggcctcagttccctcgtctgtaaaacgagataataatagaagttaccacttcctgctatacctagcacatagagtgaccaccttttctctgtctgctcgggactgtggcaatttttttgacaggcccatgttctggaaacccccttggtcctgggcaaatacaaatggttgctcactctgctgatagataagttcaagtaccagctaggcgcagtagctctaatcccagcactttgggaggccgaggtgggcagatcacctaaggtcaggagttcaagaccagcctggccaagatggtgaaaccccgtctctactaaaaatacaaaaattggctgggcttggtggctcacacctgtaatcccagcactgtgggaggccgaggcgggcggatcacgaggtcaggagatcgagaccatcttggccaacatggtgaaactctgtctctactaaaatacaaaaaattagctgggcatggtggcgcgtgcctgtaatcccagctacttgggaggctgaggcaggggaatcgcttgaacccaggaggcagaggttgaagtgagctgagatcgtgccactgcactccagcctggcgacagagcaagactctgcctcaaaaaaaaaaaaaaaaaaattaaccaggtgtggtggtgggtgcctgtaatcccagctactcaggaggctgaggcaggagaattgcttgaacccaggagggagaggttgcagtgagccaagatcacaccactgcactctagcctgggccacaacgagactgtctcaaaacgaaaaacaaaggaaaaaaaaaaagataagttcaaatacccttgactcaggccctgggcccatcacgctcgcctgtctctcccccagctggaaccggagctgaagaccatacccctgacccctgttgagatccaagatttggagctagccactggctacaaagtgtatggccgctgccggatggagaaagaagaggatttgtggggcgagtggagccccattttgtccttccagacaccgccttctggtgaggatatctgggcttgccctcaatccacgcccctcccacccccagaagtctgtccaatcatgtcccactcatttgttccccgtttcctcatccttgccagctccaaaagatgtgtgggtatcagggaacctctgtgggacgcctggaggagaggaacctttgcttctatggaaggtgagcttcaggcaccagttacatttctctgcacgtgttaggaaacccctaaataacaatgacataaggccggatgcagtggctcacgcttgtaatcccaacactgctgtgggaggccgaggagggtggatcacttgaggtcagcagttggagaccagcctggccaacatggtgaaaccccatctctactaaaaatacaaaacttcacggggagtggtcgtgggcgcctgtaatcccagctactctggaggctgaggcagaagaatcacttgaacccaggaggtgaaggttgcagtgagccgagatcacaccactgcactccagcctgggcaacaagagtgaaactccgtctccaaaacaaaaaacaaacaaaacccaatgacataaacaagacagagtttaccatgctgcccccttgaggttgcttcgaagattcaaggatgggttgctaaagtggtcagcacagggtggggcatggagcaagtctccaccaatgtcagctgcttccgagaggtctgagccataaggatgggtgcagatattccgggcaggggcagcagatgcaaaaacctgacagcgagactggagctcagctccagaaaatataacacagtgtgctaagagtttatttattcatttatttattttgagatggagtctcgctctgttgcccaggctggagtgcagcagcgtcatctcatctcagctcactgcaacctccacctcccaggttcaagccattctctgcctcagcctcccaagtagctgggattacaggtgcccccccaccacgcccggctaatttttgtatttttagtagagatgggggtttcaccatcttggccaggggggccttgaactcctgacctcatgatccagccacctcggcctcccaaagtgctggaattacaggcgggagccaccgcgcctggcctgtgctaagagtttaaatgctagtatcaaaagggtattaataggctgggcatggtggctcatgcctgtaatcccagcactttgagaggctcaggtgggcagatcacttgaggtcaggagttcgagaccagcctggccaacatggtgaaaccccatctctactaaaaatacaaaaattagctgggcctggtggcaggcacctgtaatcccagctacttaggaggctgagacaggagaatcgcttgaacctgggaggtggaggttgcagtgagctgagctcgagccactgcactccagtctgggcaacaagagcaagactctgtctcacaaaaaaaaaaaaaaaaaaggtattataaaatggctgacaaggtgcaattatcctcactgattcaaatctgtgaagcacctgctatgtgccaggtggcattgcttgacccttgctctcagtaaataagcaaaggaacacgatgacaggtgtggttttccaccttcttagaccacacaatccagtatcttttatttatttatgtatttgagatggagtgtcactcttgttgcccaggctggagtgcaatggggcgatcttggctcaccgcaacctccgcctcctgggttcaagcgattctcctgcctcagcctcctgagtagctgtgattataggcgcccgccaccacacccggctaatttttgtatttttagtagagacgaggtttcaccatgttggccaggctggtctcgaactcctgaaatcaggtgatctgcccactcggcctcccaaagtgctgggattacaggtgtgagccaccgtgcctggccgatattttaaaaaattaaatcagcaaactagagttcaaggaccaactgcctgttttcagaaatacagtttgattggaaccaagaccagggttagggaggtgagcagggtagggtcacacaggtgcaggatcaaatcctgtttttactttaaaatcttgatattttggaccgagtgggtggctcatacctgtaatcccagcactttgagagtctgaggcaggaggaccacttgaggccaggagttcgagaccagcctgggcaacatagcaagctacccatctatacagagaataaaacattaccaggggccgggcacagtggctcagcctgtaatcccaacactttgggaggccgaggcgggtggatcataaggtcaggagttcaagaccagcctggccaagatggtgaaacccccatctctactaaaaatacacaaattagccgggcgtggtggcaggcacctgtaatcccagctacttaggaggctgaggcaggagaatctcctgaacccggggaggttgcagtgagctcagattgcgccactgcactccagcctgggtgacagaatgagactctgtctccaaaaaaaaaaaaaaaaattagcggggtgtggtggcatgcgtctatagtcccagctactggggaggctgaggtgggaggatcacttcagcctaggatgttgaggctgcagtgagctatgattgcaccaccgcacttcagcctgtacaatagtgagaacttatgtcaaaaagaaaaaaaaaaaaaagatggctgggcgtggtggctcacgcctgtaatcccagcactttgggaggccgagacgggcggattttttttttaagagacaaggtcaggagatcaagaccatcctggctaacatgtgaaaccccgtctctactaaaaatacaaaaaattagccggacgtggtggcaggcgcctgtagtcccaggtactggggaggctgaggcaggcgaatggcgtgaacccgggaggcagagcttgcagtgagccgagatggcgccactgcactccagcctgggcgacagagcgagactctgtctcaaaaaaaaaaaaaaagttgatattttgtttgtcatgggtttttaggcattaattttcatttattacaatactgcattaaaatattatttatctcacttattgggtttttggtatcccccactcccttttaaattttgcacctggccaggtttgctgactcacgcctgtaatcctagcactttgggaggctgaggcaggcagatcacttgaggtcaggagtttgagaccagcctggccaacatggtgaaaccccgtctctactaaaaatacaaaaattagccgggcgtgatggcaggcgcctgtaatcccagctactcaggaggctgaggcaggaacatcgcttgaacccgggaggtgaaggttgcagtgagccgagatcacgccacttcactccagtctgggtaacagaatgaagactccgtctcaaaaaacaaacaaacaaacaaacaaaaaatgcttcactgaccggtggtttatcaggtgacctcagggagacacatatatgtgcgtgattaatgggagacattaacccctttttcccttcatctctcaggccccagggccctgtgtgcaggtgagctacaaagtctggttctgggttggaggtcgtgagctgagtccagaaggaattacctgctgctgctccctaattcccagtggggcggagtgggccagggtgtccgctgtcaacgccacaagctgggagcctctcaccaacctctctttggtctgcttgggtaagagactgtgaccttcctcagctcggtgccctggaggggtgggaagtgacttcctgagtgggcagctgagacttctctccaccctccagattcagcctctgccccccgtagcgtggcagtcagcagcatcgctgggagcacggagctactggtgacctggcaaccggggcctggggaaccactggagcatgtagtggactgggctcgagatggggaccccctggagaaactcaactgggtccggcttccccctgggaacctcagtgctctgttaccaggtgaggccctgggacacctgggtctccatccccgctgttagagcagacggatgggtggacttgtaagagggagtgctatgattaaagtagcgtgatggccgggcttggtggctcatgcctgtaatctcagcactttgggaggccgaaaggggcggatcacctgaggtcaggagttggacaccagcctggccaacatagtgaaaccccgtctctactaaaaatacaaaaattagtggggcgtggtggcacatgcctgtagtcccagctactcgggaggctgaggcaggagaatcgcttgaacctgggaggtggaggttgcagtgagccgagattgcgccactgcactctagcctgggtgacagagtgagactcagtctcaaaaaataaataaataaataaataaatagcgtgaattcacacaagacttttttttttgctttttggaggcaagatcccactctgtggcccaggctagagtgcaatggtgccatctcagctcactgcaacttccatctcctgggttcaagtgattctcgtgactcagcttcccgagtagctgggactatgggagcgtaccaccacaatcggttaattttttttttttttttttaagtagagacggggtttcaccatgttggtttggctggtctccaactcctgacctcaagtgatctgcctgccttggcctcccaaagtgctgggattacaggcatgagccactatgcccagcctaacttttcttttttttttttttgagatggaggctggctctgtcacccaggctggagtgcaatggtgtgatctcagctcactgcagccttcacctcccgggttcaagcgattctcgtgcctcagcctctggggagtgactgggatcacaggcccccaccgccatgcccagctaatttttttatttttagtagagacggggtttcaccatgttggctaggctggtgtcaaactcctgacctcaagagatccacccgcattggcctcccaaaatgatgggatgacaggggtgagccaccatgcctggccctttttttttttttttttttggagtcttgctctgtcgcccaggctggagtgcagtggtgcgatatcggctcactgcaagctccacctcctgggttcacgccattctcctgcctcagcctcccgagcaactgggagtacaggcgcccgccaccacgcccggctaatttttttttttttttgtatttttagtaggaacggagtttcaccatattagccaggatggtctcgatctcttgacctcgtgatctgccctcctcagcctcccaaagtgctgggatttcaggcatgagccaccgcacccggcatttttttttttttaagagatgagtctcactctgtcagccaggctggagtgcagtggcgtgatctcagctcactgcagcgtcgacctccatggctcaagcaatcctcccacctcagcgccctgaggagctggtattacaggcatgcgccaccaagcccagccagtttttgtattttttgtagaggtggggtttctccatgttgcccaggctgttcttgaactcctgagctcaggcaatccacctgccttggcctcccaaagtgctgggatgacaggcatgagccacggtacctggcaagaaatctttataaataaataaataaataaataaattaattaattaatgaacttggaagaactgtgaagatgttgggtaagaaatttaggacacagtcccaagacccacaaggatatatgaaccaaagaagcgaaggcccaattatggaaaattcccagttggggaaggctatgtggatgtgatagggtttaggggagagagtgcagcaccctcagctaccatggtaggtgctgtcagttgcctgctcatatctgtttgaccacctcagaggttttaggcctctctcccagctgcccacacttgtttcctggcctaagggctttttctggtcactgaggcattttgcctgcctgagaagcaagatggaaatattgagaagagccctcaggaacagccctcagcatgactaatgaggcttggtggataaataccccagctccgtccccctgagctgggctgactctgcgatgcctgctctctgctggcccctagaggtcccccatgggactgcgtctcagttgtccacagtgagaacctgttccttccccatttcactcccctactgccctattggggttttctgggattacctcctagataaatgacttacagtcagatccttatctcagggtgtccttctggggaccccagtgaagacacctaggaaatgagcatgggaaggagagccaactctaactggtctttatttctttgtcactcagggaatttcactgtcggggtcccctatcgaatcactgtgaccgcagtctctgcttcaggcttggcctctgcatcctccgtctgggggttcagggaggaattaggtaagagtggggctggaggatgggggggcttctgtaacccaggccgaccttgacctactgccttcctccccagcacccctagtggggccaacgctttggcgactccaagatgcccctccagggacccccgccatagcgtggggagaggtcccaaggcaccagcttcgaggccacctcacccactacaccttgtgtgcacagagtggaaccagcccctccgtctgcatgaatggtgagcttccctgcctgctgacctgtcctcccagcccccacaagacccacccatcagtcagccccaccccttgtccccacgtgggcctctttggcccagggaccatacatggtgtcctcaattccctcttggctatcaatgtaacgagctttcattcggccattaaaaatgaggatgccaatctatatttattgacattgaaagatgcttgtcatattttattagtgaaaaagataaaaggatgttaaaattccgtggtatggttccattttttttttttttttttgagacagagtctcgctttgtcaccaggctggagtgcaatggcacgatctcagctcactgcaacctccgcctcccaggttcaagcaattctcctgcctcagcctcctgagtagctgggattacaggcgcatgccaccatgcccggctaatttttgtatttttagtagagacagtttcaccatgttggtcagactgatctcgaactcctgacctcgtgatccacccacctcagcctcccaaagtgcggggattataggtgtgagccactgcgcccggcctatatataattttaaaaatatatatagaaggcccggcatggtgggtcacgcctgtaatcccagcactttgggaggccaaggcaggcagatcacttgaggtcaggagttcgagaccagcctggccaacatggtgaaacctcatctctactaaaaatacaaaaattagccaggcatggtggcacagcctgtagtccagctactcagaaggtggctgaggcactagaattgcttgaatccgggaggtggaggttgcagtgagccaagatcatgcaaagacaaactaaataatatctaagcagtgtatgagatggtgataagtgctgagtagagaatgaagcaaggggctgggcaaggtggctcacacctataatcccagcacttttggaggccgaggtgggcagatcacctgaggtcaggagtttgagaccagtctgaccaatatggtgaaacccagtctctactaaaaatataaaaattagccagatgtggtggcgggcacctgtagtcccagctactcaggaggctaagacagcagaattgcttgaacccaggaggcagaggttgcagtgagctgagatcacatgactgcactccatcctgggcaacagagtgttacagagcgagacttcatgtcaaaaaaaaaaaaaaaaaaagagaatcaaacaaggaaggtgggtggtgaagggggtgcaatttcaaatagagcggggtcaaggaaagcctcacggaagaggtgacctttgagcaaagacctaaaagagatgaggagggagccatgtggatacctgggagagagtgttgcagacagcaggaagagcacatgcaaaggccctgtggtaggcttgaccacctccccaacttctttggttgtgttctccagtgagtggcaacacacagagtgtcaccctgcctgaccttccttggggtccctgtgagctgtgggtgacagcatctaccatcgctggacagggccctcctggtcccatcctccggcttcatctaccaggtaggggggttgggatgggattgccacagggaggggatgtactccacagtggggagaggtagcatctggagtcattacttggaagctaggtgcagtggctcacccctgtaatcctaacactctgggaggctgaggcaggtggatcacttgagcccaggagctcgagaccagcctgggcaacatagtgagacccccttctctacaaaaaataaaacaattagctggatgtggtagcatgcgcctgcggtcccagctcctggagaagctgaggctcgaggatcgcttgagcccaggagttggaggctgcagtacacggattacaccactgcgctccagcctgggcaacaaagcaagaccctgtctttaaaaaattaagaattgccaggcacagtggctcacgcctgtaatctcagcactttgggaggccgaggcgggtggatcagttgaggtcaggagttcgagaccagcctggccaatgtggtgaaaccccatctctactaaaaatacaaaaattagctgggcgtggtggcgtgcggctgtaatcccagctacttgggaggctgagagagaattgcttgaacccaggaggcggaggttgcagtgagctgaggtcgcaccactgcactccagcctgggtgacagggcaagactctgtctcaaaaataaaaataaaaaataaaataaaataaaaaattaagaatgatctcttccctaccctaccagataacaccctgaggtggaaagttctgccgggcatcctattcttgtggggcttgttcctgttggggtgtggcctgagcctggccacctctggaaggtgaggctgtcggatacatgcatctctacccacgtggggaaggcagctgggcattttgctgagcttccagggggcttgaagggaggcctcagggcgcagtcacattcatgaaccctgcaccctgggctggggcatctggccatctggatctgctgccctgactactcctgtcttgccaggtgctaccacctaaggcacaaagtgctgccccgctgggtctgggagaaagttcctgatcctgccaacagcagttcaggccagccccacatggaggtgagtcaaagggccggctagtcggagccctctgggggactggggagtcctggggcagtggggagggggtgaggtgtgggtcggggaggctggggcaggattacaggctcatctcttcccagcaagtacctgaggcccagccccttggggacttgcccatcctggaagtggaggagatggagcccccgccggttatggagtcctcccagcccgcccaggccaccgccccgcttgactctgggtatgagaagcacttcctgcccacacctgaggagctgggccttctggggccccccaggccacaggttctggcctgaaccacacgtctggctgggggctgccagccaggctagagggatgctcatgcaggttgcaccccagtcctggattagccctcttgatggatgaagacactgaggactcagagaggctgagtcacttacctgaggacacccagccaggcagagctgggattgaaggacccctatagagaagggcttggcccccatggggaagacacggatggaaggtggagcaaaggaaaatacatgaaattgagagtggcagctgcctgccaaaatctgttccgctgtaacagaactgaatttggaccccagcacagtggctcacgcctgtaatcccagcactttggcaggccaaggtggaaggatcacttagagctaggagtttgagaccagcctgggcaatatagcaagacccctcactacaaaaataaaacatcaaaaacaaaaacaattagctgggcatgatggcacacacctgtagtccgagccacttgggaggctgaggtgggaggatcggttgagcccaggagttcgaagctgcagggacctctgattgcaccactgcactccaggctgggtaacagaatgagaccttatctcaaaaataaacaaactaataaaaagcaaaaaaaaaaaaaaaagaaaagaaaaaacactgcatttgggcaccatctcagctcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccactaagaaaaataaacttttatatttttata

SEQ ID NO: 1659 - DNA, 2767 bp, Homo sapiens
atggccaggtacatgctgctgctgctcctggcggtatgggtgctgaccggggagctgtggccgggagctgaggcccgggcagcgccttacggggtcaggctttgcggccgagaattcatccgagcagtcatcttcacctgcgggggctcccggtggagacgatcagacatcctggcccacgaggctatgggtgaggctggggagagagtggatgtagaaggggaacaggtggctggatgggtcccaggagctaaggacagagataagaggaggttgctggaggaggagggtccctgtcctgccacattcagccagggacacctgcccagccttgaaacaagggctcaggagttagcagagctgcagagctgggatggggtgttgcaagccatccatgggggctggaagtctgaggacaggtgggggcggggagcgtgccatttgcaaagacaacaccgaagtgttttccaaccctttccagcaggtaatgtgaagggtgtggtatacacatagctgggtttgtcacctaatgcatgacctctccccagcaagttggtttttcttccgtctctgagtgtcttttttttggagatgtggtctcactccattgcccaggcttgaatgcagtggcccaatcactgctcattgcagcctcgacctcccaggctcaagtgattctcctgcctccgcctccagagtagttgagaccacaggcacctgacaccatgcctggctagttttaaattttttttttgtagaaacaggggtctcactatgttgcctaggctggtctcgaactcctgggctcaagtgatcctcccacctcggcctccctaagtgctgagattagagtctctgagtgtctttatcttcaaatgggagacacagttcctgaatcttgcaggattaagtggtatgattaaatcaaaacagattagggcagagtctcagcagggcagcggcacaatctgggatccatcaggagagtcagagggaacagaagacctagcttcatgaggggcagggacctggcaaatagatattcatgatggtgagaaggaggataggtatgagcgtggacatagaagacacaccacttggattcagatagtagctctacaatgtaatagttgtgtgttcatgtgctactattttttttttttttgagacagaatctcattctgttgcccaggctggagtgcagtggtgcaatcttggctcactgtaacctccatcacctgggttcaagcgattctcgtgcctccagcctcccaagtagctgggattacagatgtgtgccaccatacctcgctaatctttttatttttagtagagacagtttcaccatgttggccaggctggtctccaactcctgacctcaggtgatcctcccacctcagcctcccaaagtgctgggattacaggcatgagccaccgcgcccagccatgcaaattctttactgagtcctgcctcagtggtctcctctggaaaatacgggtgataactgcacccacctcaactggttatcactgagaagaataaagaagttaacctgctaaagcacttaaaacgttgtttgacacaaagtaagtgatcaataaattattattattattattattattattattattatttttgagacagggtcttgctctgttgcccagactggagtgcagtggtgtgatcacagctcactgcagcttcaacctcttgggctcaagcaattctcctgcctcagcctcctgagtagctgggactacaggcttgtgccaacatgtctaactttttattatttgtagagacagggtagtgctgtgttgtccaggctgttcttgaactcctggttctggtgatcctccagcatgtgcccctggaagtgctgggattacaggtgtgagacaccgtgcccggactcaatagtcatttttgagtgctcatcatgttccagacattgttctaagtttttttttttaatgaatattaactccttataaaacttgagaaggttggagtaattatttttttccactttgcagaaaagaacattgaggctccaagaagtaaatttacttgctcacgattagagaagctggattcatgctcagtcagcccagctcccaaatgtaccaggtcctcaattaataaagagtaaggagaaataaatgacagggctgggtgcggtggctcacgcctgtaatcccagcactttgggtggctgaggtgggcacatcacttgaggtcaggagtttgcgaccagcctgaacaacatggtgaaccccatctctataacaatacaaaaatcagccaggcctgctggcagacacctgtaatcccacctactctggcagagccagaatttgaacccaggactgggtggaataaaaactctgaactatgtctatgactgttgtcacaagatcagagctagactggccaggagccatgactgtgggtgcagcagcagctgagccctgatcactaactctgttcatcttttgcaggagataccttcccggatgcagatgctgatgaagacagtctggcaggcgagctggatgaggccatggggtccagcgagtggctggccctgaccaagtcaccccaggccttttacagggggcgacccagctggcaaggaacccctggggttcttcggggcagccgagatgtcctggctggcctttccagcagctgctgcaagtgggggtgtagcaaaagtgaaatcagtagcctttgctagtttgagggctgggcagccgtggg

SEQ ID NO: 1660 - DNA, 9656 bp, Homo sapiens
ctgctgaaaaagcagaaagagattaccagccacagacgggtcatgagcgcggtattactgctggccctcctggggttcatcctcccactgccaggtgagtgatgagcccagcctggaggagattccctggaggccgggcaagggaaccctgctgagatggatttgctcttgccactccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggtgagaaggccctggcgtgcagagaccccgccctgtcccctcagtcccttgatccctgtgcagggacccgggagccacccctccgggggatcgactcctagggtcccggtgatcccctttccagcctctcagcctacgccgtgtagcagcgtctccctccaggaccctggaggcctgacctccatcctcgcttgcctccctctttcggtccaggaccccaagtgagcctggtgctctccaagggctgcacggaggccaaggaccaggagccccgcgtcactgagcaccggatgggccccggcctctccctgatctcctacaccttcgtgtgccgccaggaggacttctgcaacaacctcgttaactccctcccgctttgggccccacagcccccagcaggtgcctgcgggagggtcgggaggagagggaggggctgctagaaggggatccgctgagcacagaggggctgttacggagtccctcccaccctcgctcgctatcccgaccctcgctggctccatccctcccctgactgctccctgaccatcgccccgccccgctccctttccatccctccccactcactcccgatccctcccaccgacctgccacccgggaatccccgcacccctcctcttctaagagcaaacaggacggatttctgatatgaaatcaccattaactgggttatcctgcattctttttttattctgttgcgtttggttcaagaagttctcctgcagggtttttgctatttcctcttcctaagggagactgaactgtaactttccactttccttgtctggtgttataaagagtctagggagatattttgcgcttcttttattggaacagcttgtgaacacagaagtctcctgttcttggaggtttagtagcgcttgcaggtgaaggcactggctcgttccagggcaccccctcattcccttgaccaatgagtctgcttctgtgtctcccctcggaaggccagactttgttgaaaggttcagacttgaccatgtctgagtctacatttggcctcagcaggcccctcctccaccctgcccaccccccacccccacttgccacccaagacacccccccttttcttttctttttttttttttttttttttttttctgagaaagcgtctcgctgtgtcgaccaggctggagtgcagtggcgcaatctcggctcactgcaacctccgactcccgggttcaagcgattctcctgcgtcagcctcccacgtagcagggactagaggagcctgccaccacgcccggctaatttttgtatttttagtagagacagggtttcactatgttgcccaggctggtcttgaactcctgacctcgtgatccacctgcctcagcctcccaaagtgctgggattacaggtgtgagtcaccacacccagccaagaccactttctgtacccagccctgggtgcctctacccagacctcctgttcattctcccttcctcttttatggattacacttctttattttcccacatccagatcccatgatgggagctgcagaaggcccctttgggaaggctgagcaggttgactcttgaggccagcaaaagtggggtgcagagaaggtatctgatcaaatccagtgccctctcagtgccccctcactctgtctgtcactttcctagacccaggatccttgaggtgcccagtctgcttgtctatggaaggctgtctggaggggacaacagaagagatctgccccaaggggaccacacactgttatgatggcctcctcaggctcaggggaggtaagcctgggacatcggggtccctgtggggactgaactggaaggtctggggactgagatcttaggctttggggagtgaggtgagctgaggcacggcatgagacccagaggagggtgggcctggcttcctggagctatgcctgcctctgagggttgggtggtcctggaggcagcatcactgactctccctcgctccccctttctgcaggaggcatcttctccaatctgagagtccagggatgcatgccccagccagtttgcaacctgctcaatgggacacaggaaattgggcccgtgggtatgactgagaactgcgatatgaaaggtgagtcctgcccctaggctgtgccctggactgcagcctcggggcacgatgacacatggggcatccagagccatcacaccaaagccagcaggaggaaggtcaagggtgcagggtgggttgcttggcatgtggctttaggcaacagtgagtgctggggcccctgctggctctcaagctgctgagagtgactggttgcttcaatttctgtgtctccacacccctggccttgggtaaccctaggtctcccacttccctaggccaccgtagcctctctcccacccgtatcagcccccgccccgctcatggtgctggagtgccccagcagccttgcctgcacaggagagaacatcagagagaaaatcaaggggactttgggtgtgacagagaaagcaagagttaaaggaggacactgagagggtccccacttacccatttaggtgctgccatggaagagagtgccagggaatgtctccataagaagggctccaaagcaacaggaagccatggtggggaggtgggggtcttataggaatcccagcttccctcctagaagcaaagtcttccctgcccctgcctcagtttccttgtctgcccacatcacgctaacccttagagcttagaagagagagttgtgtgagctctgcacacattcctctgtgtatttggctgtttctccctagctaggctgggagcctgaggctaggggcttggtaccactggcaccagggtttccagccttgggtagctcaggagacggctcaggaagggtaccaggaggtgtttgctcaagtgaggacatgcagggctcacttgagcaaagctccctcatgagtcagaccctgtttctacctgaagggcctccaggactaggagggggaggtgctacagacacagatggtcacagcttgaggtgatcagggctgtggcaaacggggatgtggggcctggggcagctcagaggaggaaaatactgatgttgttggggtagagagtcaaggagggctttacagaggaggtggcctgtgaaccgtgtgttaaagatgacctacagcttattggtagaagaggaagaggacattggtggcagagggaacagtgtgtagcagctgcataggcctggaggtgggagtgagcctgctgttttcaagaagagtccctcactccacctgagaaggactcatcaagatgagggggtacagctgggattgggggtgattcgaagttttccaggtggacaaggtgggtgtggggtcgaagagggagctgctccaagccaaaggcacagcaggtgtgaggctgaggaggaaatgaactggcatgccttcagaatggatactggtgggggaggaagagttaagtggggaacctggtggtcgctcaagtacctgaaaacccaggctgaggggtggaccctctcctgaaggcaggggagccatggaagattgtggagcagggagggcagggtctgagccatttatctttccttttgactgatgctgctgttaaggatctggccctggtctctgggaccagatgacactgataacccagaaggtatttcagaaacaaatcagacgcaacacatgccacacacacagcccacaataagcacagcagacacgaatgcgtcacaccatgacacatacacaccacacatcacataccacacacacactcccccatacccctgacataccacctatggaacacaaatcacacacagagcacacaatatgcacaacacacacaaatgcatcacacgagtgcacaattactacgtgtacatgtagtgtgtatgccacatactacacgtcaggtaccacacacactctccctctcaacatatcagacatgcaatacataccacacacaacacacaatacacacaacacatctggcatgccacacacaccacatgcaagcaaaacacagatacacagaacacacaccacaccaaacacacaaaacaaacacataccacatatatcacacacagtatgtctacacatgcacgcaccacacaaacataccatgaacacaccacacaccccatacaaccacaccccccacatgtatactacgcactcacacacagcacacatacctgcacacatcacgcatgtgcacacactacacaaacgcaccacataaaacacagcgactatgcaccaatcagtgctgttcatagagattcatctgctttcaacactggagccagatcttgcaggctgttttgcctccctggtgaagtgcagttcagcagtttagcagacagtgagcatcacaagaccaggcatcagaaactgggggaacaacaagacgttggggaccaagtgcaggagagaagaggcttcagggtgatggaaccgcttataagaagccgcagcagtgggagggctgggtgcaaggatgcaggttactaaaaggggccatggcagcagccccttgtgaagaaccaaggggcccgggcagataaggccctggctgcccctagaggagctgggcagcggtcccagtgagagagcagggaagagcccacgtctgaatcagggacacgtgggtcccaggcccagctctgccgccgaaacagctttccagcctcagcttcacacgaggatcaaaagtctccatatctcatggagcctctttccctggatttggggaagaggaggggatggttgcagacatgggacggaagcagatgcaaagaccatgatgtgggtgagtgcctgccagaaacacctgtgcggagcagagtgatggagggagcagggaggcggccgcgtcttatcaggcctcccgggccattggaagggcttagaattttattctccagaatggggacctcctggagtcttcggagcagaggagtgacatgaactgacttaggtttacctagcctccctctgcctgctgggtggagaatggagcgagaggaacagtgacaggcgggtgcagggattgccccaggagtcaggtgggagtgaagcggggggcttggaggcagcagaggtggtgacgtggggttgggttttgaagattttctgcagctcaagccagtaggattacttgaggaacacaatgtgggagagaaagagcgtggtcaaggacaacaccaatgtgttcagctagactggcagaaacgagccgccacgggtgtaagtaggggagatgggagtggggagagaagggtgggagaagggagcaggagccatgattttgattttgtcatctgtgaagtatgcaaatgagcagccctccagggtggcatcggttctgcaggtcgcatgtgttggtggaagctgggggctcagtctaagagtccctgcatcatgggaccgatcccccctgctctgtgatggccgtgaggggaggccaggggctgtggtttcacactagagccttgagggcctcggggccaaggtagccgaggatggtcttcagtacctgtctccctcctgctcccaaccccgaccctgagggtccagagtccctgggttcccagcctacctctgccactcacaagctgtgtggcatgggcagctactgagcaatcctgcctctgtttcccttgttgcaaatgagggtgttgattgtgatcacaccacctactgctggggtgctgtggggaaatgaggcatcccagataagctgtgttccctggaaccttagatgggtggatctgtgggaagcaatgaggtcagccaggtgcagaggcagtgctcagcggcagtgctcagcccaccctggcccttcgcatcttgtttggaacatagggctttgcaactgaaaggtatgagaaaggtctcaggctgccttccttattattgaaatgaggaccttaaagctcagatggggaagcagagatgggatgaggataaggaagagcttccattgctctcacagctaaagcaaggaacggccgttcccccagggctgtgagaggacgtccctgcgggtgttcaagcagaaacagggaacaatgggggtgggatttcgactcccaagtcccttctgaatccttggttaagggaatctgtggccaggtcacctggagtgtgactcaagagtgtgatcaccttccctagcccaggacgtggagggacagacatggtgggttcctggcttacacacaccctgggattcctctccccagattttctgacctgtcatcgggggaccaccattatgacacacggaaacttggctcaagaacccactgattggaccacatcgaataccgagatgtgcgaggtggggcaggtgtgtcaggagacgctgctgctcctagatgtaggtacgtggactgaggtagaagacgaacacctgtcccaagtccctggcagctccctccaccccactggattctttcccctgaatttcctgctcagctcccttcacatctgcaattttcaatccgactcttcttctctctgcatcttgggttccccttatgaaaactgggggtgaagcagtgggaatgacagtgtctgcctttctggggaggggtgaccacgtatgcggtaatccctgcccagggtggagaaccgtgccaacaccgaggactctcagtggcttcatacattctggaaatgtttatccagcatttgttttaggtgccgcagatccaatcccatctgtattcctgcagctttatatgccttgagaaacaggaaacaaacaaacaaaaagcagcaaagtatggggaatggagatcccagctctgcagagaaatctggcaaggaaaaggagataggaaaagtgaggggaaggctgcaattttaagctcagtgctcaggggagactcatggagaaggtgacctttgagcgagaactgggaggaggcagagcttcgggcaggacccaggccccagcctccgtctttgccccacactaaacatgacccagcagttgtgatcagggcattcaccctctgcctggggggtattgtgaagggcagggagtccagctctggagcccctgctgccctgggagctgcccagtccccagcccagctttccctctcaccctcaggactcacatcaaccctggtggcgacctaaagctgcagcgctgttggggctcaaaattcccagaagaccaccatccactcagcccctcctggggtgcttgtggcctcctatacccacttctgctcctcggacctgtgcaatagtgccagcagcagcagcgttctgctgaactccctccctcctcaaggtatgggatccagggccgtggagaaatgaggcccagacacacagagactctggcccaaggtggccagctgctctgagcacaaagtcatgtacccccaccttccctctgctccccagctgcccctgtcccaggagaccggcagtgtcctacctgtgtgcagccccttggaacctgttcaagtggctccccccgaatgacctgccccaggggcgccactcattgttatgatgggtacattcatctctcaggaggtgagtgctgcaagcagggccccaaggatgaaggcactggtggcctggactcctgggtctgagggaggaggggctgggggcctggactcctggtccgagggaggaggcgctgggggcctggactcctggtccgagggaggaggggctgggggcctggactcctggtctgagggaggaggcgctgggggcctgggctcctggtcccagggaggaggggctgggtgcctggactcctggtctgagggaggaggggctgggggccggggctcctgggtctgaggagctgaggctctggactcctgggtctgaggtaggagggactgggggcctggactcctgggtctgagggaggaggggctgggggcctggacccctgggtctgaggagctggagctgggggtctgggctcctcggtctgagggaggagggtctggggcctggactcctgggtttacaacttggctgggctgtactctgtgtcctttctgacttggtcttctccctctaggtgggctgtccaccaaaatgagcattcagggctgcgtggcccaaccttccagcttcttgttgaaccacaccagacaaatcgggatcttctctgcgcgtgagaagcgtgatgtgcagcctcctgcctctcagcatgagggaggtggggctgagggcctggagtctctcacttggggggtggggctggcactggccccagcgctgtggtggggagtggtttgcccttcctgctaactctattacccccacgattcttcaccgctgctgaccacccacactcaacctccctctgacctcataacctaatggccttggacaccagattctttcccattctgtccatgaatcatcttccccacacacaatcattcatatctactcacctaacagcaacactggggagagcctggagcatccggacttgccctatgggagaggggacgctggaggagtggctgcatgtatctgataatacagaccctgtcctttctcccagtgctgggatttctccatgtgagggggcagcaggacacccagggatctagcgtgggggaggagaggagcctaatgagaaaatgaccatctaaagcctgcccttcattggtctggttcacgtctccaaaccagcttggatggtagcagagacttcagggtgctccagccaaacgtatttgggcatcaccatgacctgggaggggaagatgcactgagacgtatgaggcttccagcctagcagccagggccctagcacaaacaggaggctcgccccatctgagcaactgcaggagaggttagtacagtcatgcattgcttaacgacagggacgtgtcgttagaaatgtgtcgttaggtgattttatgaccataggaacattgtagcgtgcacttacaccaacccagatggtacagcccaatacacacccaggatggacgctagagtcgactgctcctaggctacaagcctgcagtgcatgttatggtgtgaatactgcaggcaatcttaacaccacggcaagtatttgtgcatctacacacatctaaacatagaaaaggtacagcataaatacactattgtcatctcagcagaccaccgttctatacgcaattcgtcgctgacccaaacgttgctatgtagcatctgcgtatcgtgggataattgacatgagggcttgagagaactccagaaaaaaatgggttagcattttcccagagctgttatcattgggtctctcttaccaccata

SEQ ID NO: 1661 - DNA, 493 bp, Homo sapiens
gcttggcagatgaagagattggaagtgaaccactgagatgactgatgagcgtcctcagcaggctgtgttgcagggggaagagtgcaggttgtttataaggcctgggtcgtgcccctggccaccatttcctggctttgtgactccagctttacttctccttcccagggctcagttttcctctccttgaaggggatgagtggaaccagctctggacgctgagctgcctgggtgtaaaggcttcctgtaatgggcagaagagtggataggagggcagcaggggagctggaccaaaagcatcatgtgatttgccgtgatcacagaggattttctggaagtagcttgggcacaatgtgtgcaaggagacagaagggtctcgtggtggggaataggacattcacacagcctcctccatggcttacctcacacagcagttgttaattagccaagaatttgacaaacaggcattaaaggccttctgaatgtgacacacgac

SEQ ID NO: 1662 - DNA, 5723 bp, Homo sapiens
cacttgttcaatgatgtacccccagtgtcaggcgctttgcaaacacacgatacatacgggttgatgtttggtcaagagaggaattaagaccaggcagacagcaggctgggatcagagagaccccatttctgtctgaaatgtctgcagagaacctggtgcctgcctcagccctagctctggggaaatgaaagccaggctggggttcaaatgagggcagtttcccttcctgtgggctgctgatggaacaaccccatgacgagaaggacccagcctccaagcggccacaccctgtgtgtctctttgtcctgccggcactgaggactcatccatctgcacagctggggcccctgggaggagacgccatgatccccaccttcacggctctgctctgcctcggtgagatttaaagagggggaggggagacccgagtcttggaggaaatttgcctcacagccaggccctggttctttaggagactcaaaaatctcagggtagccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggggtggttgcaggcgcctgtggtcccagccactcgggaggctgaggcaggagaatggcgtgaacccgggaggcggagcttgcagtgagccaagatcgcaccaccgcactccagcctgggtgacagcgagactccgtctcaaaaaaaaaaaaaaaaaaaaaaaaaaatctcagggtaaagagaggacctgctcaggcttccggggcaaatccctcacagggaactctcttccagggctgagtctgggccccaggacccacatgcaggcaggtgagtctgtccccagctgtcccaggtccctcctcctcactgggacaaggggccacccatgggcagctgggggaggagacagcagttctgggtgactgatgaggatgacgggggggtcctggggctgagagctgggatctgagggctgaggaaggtcttgggatccagcctctgattttcttccagggcccctccccaaacccaccctctgggctgagccaggctctgtgatcagctgggggaactctgtgaccatctggtgtcaggggaccctggaggctcgggagtaccgtctggataaagaggaaagcccagcaccctgggacagacagaacccactggagcccaagaacaaggccagattctccatcccatccatgacagaggactatgcagggagataccgctgttactatcgcagccctgtaggctggtcacagcccagtgaccccctggagctggtgatgacaggtgagaggacactcaggggtcccagccccaggctctgccctcaggaagggggtcagctctcaggggcatctccctctcacagcccagccctggggatgatgtgggagccccatttaacacggtgcctccttctctcctaggagcctacagtaaacccaccctttcagccctgccgagtcctcttgtgacctcaggaaagagcgtgaccctgctgtgtcagtcacggagcccaatggacactttccttctgatcaaggagcgggcagcccatcccctactgcatctgagatcagagcacggagctcagcagcaccaggctgaattccccatgagtcctgtgacctcagtgcacggggggacctacaggtgcttcagctcacacggcttctcccactacctgctgtcacaccccagtgaccccctggagctcatagtctcaggtgaggctcctgaccctgtcctctctgagctcagtggctccgttcatgccctgctgccaggagagctctgggcagggatggagggagaggggctcagccagtgggggactcagccctcagaggggaggaggacaacaggggccctcccaggcatgcccatgctcttctccctcacctagggtccagaaggtgccaggtggacagagaaatggtccttgggaagctgcagggcagatatagggagaggttcaatttgatgtggagacccaagggcaaccccagactctcaccctcctcttgtccttctacccaggatccttggaggatcccaggccctcacccacaaggtccgtctcaacagctggtgagtctcagaggcctctgtccagagagtttccaaagcccgaggcctgtctcaagacatgctcagtggatctaagtcctcgttccaattctcagctgggcttgcttccacgggtgtgggagtcgggcagcgacttgggaggcaccacaggctcccaaggccctgaggctgggctggtgaggggtgagggggtcaaggctgaaggagatgttgcggggagaagccgagctgatgcggggagcagggcagccccagccctcacatccctgttctaacccagcaggccctgaggaccagcccctcatgcctacagggtcagtcccccacagtggtgagtgaggggctctgagtgggaggtgggcagggtctaggggagccaagggtgggttctgtcctaggttaaggctcctctggaggtggtgatgtggacaggcccctcccctgcatgggcctcagtttctccaagtgtaaaggagagaggcctgcgggtgggaaagttcctttcagctctgactcccagctgtgccctcctgggagaggaggcctcccagggaacctcccagacccgattccgcaggggcctgtccggtcccacctgcagcagagacggtgacctggggcaggggaggggagcagggcggtggttcaagacagtcaggctctttccctgcaactctggggcttggctctggtgcaggaacaagggctgcagctcagactcccgggtttccttcccagctctgccgcttcctggctggaggggtctggggcaggcgattcccctctctgagcctcagtttgtgcatctgtgaaatgggtggagagagggtggcaatctcaggttgcacaactgctgtgagggttggaggtaatgaaagaaagacccagcacacacagtaggtgcacacacagtaggtgtgcacatcaatgacatcatccccattcctgatgtcatcacgcccaaggtctgagaaggcactgggaggtactgatcggggtcttggtggtctccatcctgcttctctccctcctcctcttcctcctcctccaacactggcgtcagggaaaacacaggacattgggtaagtaggaaattgggggacccgtgggctgatggagggtgggctcagggcaccagccaaagggactccagataggagaggtcatcttagaaactctgctccagaaattcccagtgagaaaatctagaaagaagaaaatgaatgagggagtaatggaagtgctttattctttcggtttttctaaacttagaaagtatttaaaacatccttgcaagtgtattttcaggtttcctttcctcttgacttgcatgtgcaaggcaggtggttctaacgttcccagagctgagactctgtccatcttcccccagcccagagacaggctgatttccaacgtcctccaggggctgccgagccagagcccaaggacgggggcctacagaggaggtaattctgcccaaagacctcagactcccacccatcccaacagccacctcactgtccccttacactcccgtatcctcccccaggtccagcccagctgctgacgtccagggagaaaacttctgtgagtgagaggcagagaaggtgcacctggggtggagctgggggtcccaaaatttcaatagcaatgggggcaggagcacaggctaggattggtcagggactcagggagaagtggtctgaacccacattgtgggacctcggggacatcacagcccctccctgcgttgcagtggcactaatgggaacagggcagggaccagcaggaatgagaggtcccagggaaccttcccaggagatgaaccccttgctctaccccagcaggtgctgccgtgaagaacacacagcctgaggacggggtggaaatggacactcgggtgagaacccgcccctgtccccggcaccaaaggcctcctggtgccagatctaatcctgcaggacttctctgtcctccttcccccggctctcagcatcgtcacggtggacccctccttgtccagcacgctgcctcctgcctgctgggacctcactctctcctgctgtcctgggacctcatgggcctcctcccgggtccccttcctgctcctcatcctctgtttggccatctggttgttagagagctccccaggcctcaggaggatgacgaataaatgaaccactccagtcccctgggctccccttcattcattcatctagtgagtgttcccagggagctcactgtggatggggctccccatgggagctgcagacacagcagggagcaaagccgcccccgcctcctgagctcacctcgtggtgggagacaaaatgcaaataaatgcatcgtgtccaggagtgcaacgtgctgtaaggaacataaaccaggtaaagggcagagagtgtggggcagtggggccagtctgaatggaaagggagggctgtctgctcagctgtcatctgagaagcctggacggagagggccacgtgatcctctaatggacgagcccctgcaggcagaggaaacagccgtgcaaaggccccgaggcagcagcgagctcttgcaggaaggccgcgtgaggctgcagccaaatgggcaaggtcagagtgaggagcagaggccagaaccacagggagggagcggccagaccctccacggccttagggcgtccctgagattccgtcaggaaagggatgtaatcggatcaccctgggaacagtggggaaaattgactccagggagtcaggaggattcaaggacaccccccaccactgtctctctccagcagagcccacacgatgaagacccccaggcagtgacgtatgccaaggtgaaacactccagacctaggagagaaatggcctctcctccctccccactgtctggggaattcctggacacaaaggacagacaggcagaagaggacagacagatggacactgaggtgagtcctttcctctccaggcccccaggcctcccccacccccaccacgttccttccctctcactctcccccgctgcaggctgctgcatctgaagccccccaggatgtgacctacgcccagctgcacagctttaccctcagacagaaggcaactgagcctcctccatcccaggaaggggcctctccagctgagcccagtgtctatgccactctggccatccactaatccaggggggacccagaccccacaagccatggagactcaggaccccagaaggcatggaagctgcctccagtagacatcactgaaccccagccagcccagacccctgacacagaccactagaagattccgggaacgttgggagtcacctgattctgcaaagataaataatatccctgcattatcaaaataaagtagcagacctctcaattcacaatgagttaactgataaaacaaaacagaagtcagacaatgttttaaattgaatgatcatgtaaatattacacatcaaaccaatgacatgggaaaatgggagcttctaatgaggacaaacaaaaaatagagaaaaattaataaagtcaaaatgtttattcttgaa

SEQ ID NO: 1663 - DNA, 5723 bp, Homo sapiens; identical to SEQ ID NO: 1662

SEQ ID NO: 1664 - DNA, 13733 bp, Homo sapiens
ttctgtgaacacatctgagtttattctgccactgctacagggcccactgtcatttccagcccactgaggttgagggtatggccaggctgggattcacacaggcccaggatgaaagggacaccgagtgtgttggggtgggggtggctggctttgatccctaccccagtgggttggccaggtgatcagagcctccaggttccctcacacacagcctggtacatttctgccgtcaggggccggaaggactgggcccggttgtccagtacaaacagagggtcaaccacgatccccacattgaagccctcacgcaccaaccgggtcttcatcagtttgaacgtgctggtgacctccatggcgtcctgcagggcagtgaccatggtccaatcactgtgacatccacccgccccctggctatgatcttccacccacccaccaggccaccctgggctcacctggatgcggatgaaatggggggtagcgtaggcagggagccaagcgcgaacgtgctggtacaacttctccccgtcgaaagtctggccgggggctagctgcacagcagccatgcccaccttaccctcacaacctagagagcagtctggtcactctcggctgacccatctcgagggcccatagctgaccctccagcctcgcccagctctgctcactggctgtgagagccagcaagtctctaaacctctctgggccctagcacttccccacctgtaaaatcagaataacgacccctccacccacaaagctgttggaagtttaaaatgagaaccctccgcacctggcacgcacacgccatacacgttaacctgttgcaagaagtccacctgcgacaacacgccctccacctcgtgcgtggacacgttctcgcccttccatctgcaaggagggagccggcgcttgtgaccacgcccccgggaaggagaggccccgcctcttgcccccgccccgccccttttggggatcaggaggcccagtcagccccgccccctcgaaaatcgagaagccccgccttcgcgtgagaagtcctgactccaagttccgccctcttacgacaggaaagtcccgcctcttcagcctgactccctctaggatctgaaagcgtccgtggccccgcgccagccccgccccgagaaaccctgcctcggaccggaaggtgtccccgaggcggtcgcggaagtagaggaagccttcgcggtccatggccagtacgtccccggtgttgtagtaaacgtcgcccgattgccgcacgttgcgcaccagcttccgttccgacagctctcgggggccgcggtagcccacgaagggttgctggcttaccaccttggtcagcagcagccccggctcccctggggtaggagcaggaacaagaacccctggagcccaccagccaagccccctgctggaggttttcaacaacggtggactcttcatcacccagcaccctgccaaggacagacccaaagacacagacagggagatccagagatgagagagacattcagagaccttgagagactgcgacaagcgacacagaaaatgagagagaagtatagagaaggcggtatggggagcccatgagaaacaggaaaaggataacaagggatggaagacggacagacaaatggcagtgagaatagatatgaccaggaccttgcaaggccctgggagaagacactaacagaaggtacaggacaagggaccaatggctggaatgccgtcttccacagaaagctcaagagaacaaatcagatggacacccagagacccagtaaatcagagcaagagatcaaggcaggggagctggacagagccgagaagctgaggcggaggccccagatggtggtaaggcaggccactggctcagggtccagatgaaggctgcagacccctctagtgagcaccaacgtcaagcttttgagcagctcgttccagccaagcagaagactgagggtcgccacccctgccacccaggaaaggctcctcaacccccatacctagccctacagggatgcagaagccctgattgtccctcacaggctccgccgcctccatgtcgaactgcaccagctcaaagggggacagcatctggggtggagggtggagtgttgacataggtcctgtgggctcagcctcagggcagctgcacaccaggtacccgcacactcactcggaggaggcagctcatcttgcccagggccccgcagcgccccacatagttgactaagcccatgttgccttctgtggagccgtagacttcccagatccgaataggaccgaagcgctgctggaaggtctcccacacatcagcccgtagtccattgcccattgccaggcggactgtatgtgtccggtcctctggttgctacaggaatgtccccagaagggtgaggaggaggtgctcttggggcatgccttggaacctttacctagagggggtgttatcctgggtccttaccttgggagttacctggaaggtgatgggggacctctacctaagggatctacctgggttacttacatgagagtagttactggagtcttaaatagagggttacctgcaggggcgacctcagagctttgcctgggggacgttaccagaggtgactggaggcctcatctggggtctcacctaagagtagttacctagaactttaatttaatggaaatttaattttaattaattaatttttaatggaaattctcatgataggggtaggggctattatccctgttttccaaatgaggacactgaggctcaaggtagcacagctatcaaagaaaccattattggaagccttgtctgaaactcattatctggggttcttgcatgaggtgtattatctgagggacttgagttcagtacctgaatctttacctgagacctttacctgggatttcatacttgggtgttcaccatggagccctaatcttagagcctcacctggggaatgttacacaagtaccgcaggagctcgcccacatacaggatcactgtcacgccatgctgccgacagtcatcccagaagcaggaagtagagaacttgggggccagaacacaggtggctcctgggagatgacaggagagggggtttcaggtcatgcttccaaattgttgtaagaagctgcttttagcacctgtgctcacccacccccacaccctgaaatacaggacaatactgagttcatctttgtgtccttggcccagccaggactgctctcactagaagagcataggcaggcctgggttcaaatcctgtctccaggatgccgggaaagctccgtgcctgttataaagtgagcaatgctaaataagggctgtaaatattaaattttttatttttatttttgagacggagtctcgctctgttgcccaggctggagtgcagtggtgcaatctccgctcactgcaacctctccctcccgggttcaagcgattctcctgcctcagctttctgagttgctgggattacaagcacccgccaccacagctggctaatttttgtacttttttaagtacagacggggtttcaccatgttggccaggctggtcttgaactcctgacctttcaggtgatccacccgcctcggcctccaaagtgctgtgattacaggcatgagcctctgtgcccagccacatttttaatttttattttggcttgtcactgactcgaagctcaaatcactcttgattacgataaatgaatgcccagctaagcagatgggtgggcaggtggatggatatggtggatggatggaaagatgaatggatggacagttagagtagtgagtgagtagatgggtgggtggacagagtagtgagtgagtagatggatgggtgaacagttagagtagtgagtgagtagatggatgggtggacagttagagtagtgagtgagtagatggatgggtgacagagtagtgagtgagtagatggatgggtgaacagttagagtagtgagtgagaagatggatgggtgaacagttagagtagtgagtgagtggatggatgggtggacagttagagtagtgagtgagtagatggatgggtggacagagtagtgagtgagaagatggatgtgtggacagttagagtagtgagtgagaagatggatgggtgaacagagtagtgagtgagtagatggatgggtgaacagttacagtagtgagtgagaagatggatgggtgaacagttagagtagtgagtgagtggatggatgggtggacagttagagtagtgagtgagtagatggatgggtggacagagtagtgagtgagaagatggatgtgtggacagagtagtgagtgagaagatggatgggtgaacagttagagtagtgagtgagtagatggatgggtggacagttagagtagtgagtgagtagatggatgggtggacagttagagtagtgagtgagtagatggatgggtggacagttagagtagtgagtgagtagatggatggctggacagttagagtagtgagtgagtagatggatgggtggacagttagagtagtgagtgagtagatggatggctggacagtgacatgcagaggcaggggggtagaaagatggataggtggctgggtgaggatcgtcacgcctgtaatcccaggacttagggaggccgaggtgggcggatcacgaggtcaggagatcaagaccatcctggctaacacggtgaaacccgtctctactgaaaatacaaaaaattagctgggcgtggtagcgggcgcctgtagtcccagctactcgggaggctgaggcaggagaatggcgtgaacctgggaggcggagcttgcagtgagccgagatagcgccactgcactccagcctgggcgacagagtgagactctgtcttaaaaaaaaaaaaaaagaaaaagagaaagatggataggtgtaaggatggatagatgggtgggtggatgaatgaatgaatgagtgaggaagtaggtgagtaggtagatgggtgggttggtgaatgtttgtatggttgtattgacgtatggacacatggattaataagatatagggggctgggcgtggtggctcacacctgttatcccaacactttgggaggctgaggggggtggatcacctgaaagatcaggagtttgagaccagcctagccaacatggtgaaaccctatctctaccaaaaaatgcaaaaattagccaggcgtggtggcgcacacctgtagtcccagctactcgggaggctgaggtggaagaatcgcttgaacccaggagggggaggctgtagtgagccgagcttacaccactgcactccagcctgggtgacagagtgagaccctgtctcaaaagaaaaagaaaaaaactgaatctaacaacacctctagttaaagtttccaatttaacaagaaatgcagatgaaaggggaacagagacctacaagcaaatacaatggggagactgtttaattgttaaaaacaaacaaacaaacaaacaaacaaaaaaacagccaattggctgggcacagtagctcacacctgtaatctcagcactttgggaggccaacgtgttcagatcacttgaggccagaagttcaagaccagactggccaacagggcgaaaccctgtctttactaaaaatacaaaaaaattagctgggcatggtggtccacacctgtaatcacaactgctcaggaggatgaggcatgagaatcgtttgaacccaggaggcagaggttgtagtgagccaacatcacacaactgtactccagcctgggtgacaaagcaagactctgtctctaaaaacaaaaccaaaccaaaacagcccattggagaaatctgaacatagactggacatcatatgatattaaggggttacatcatatgatattaaggacatcatatgatattaatgttgttacgtgtaataatcactttggttacagtttcttcagtgcttatatgttagagatatgtactgcaatatttacaagcataaagatgcagtgtctaggatttgctctgatatattctggaaaaaaatagggaagtggctgggcacggtggctcacgcctgtaatcccagcactttgggaggccgaggcaggtggatcacctgaggtcaggagtttgagaccagcctggccaacatggcgaaaccctgtctctactaaaaatacaaaaattagccgcttgtggcggtgcgtgcctgtaatcccagctattcaggaggctgaggcagaaaactgattgaaccctggggggggggggggggcgggcggggcggagcttgcggtgacccaagatggtgccactgcactccagcctgggcgacagagcgagactctgtctcaaaaacaaacaaacaaacaaaaaagaaacagggaagtacatgtgaaattaaactggccctgggcgcggtggctcatgcctgtaatcccagcactttgggaggccgaggcgggcggatcacgaggtcaggagattgagaccatcctggtgaacaccgtgaaaccctgtctctactaaaaatacaaaaaaaatagccaggcgtggtggcggtcacttgtagtcccagctactccggagacttaggcaggagaatggcatgaacccaggaggcggagcttgccgtgagcagagattgcgccactgcactccagcctgggcgacagagcgagactccatctcaaagaaaaaaaaaaaaagaaattaaactggcagcatgttaacaattattgaagctgggtgaagatacctgagatgtcatcaaactattttcacttttttttttttttttttttgagacagagtctcgctttttgcacaggctggaatgcaatggctagatctcggctcactgcaacccctgcgccccgggttcaagcgattctcctgcctcagcctccctggtagctggaaatacaggcgcccaccaccatacccagctaattttgtattttcagtagagacagggtttcaccatgttggccaggctggtctcaaactcctgacttcaggtgttccgccggcctcagcctcccaaagtgctgggattacaggcgtgagccaccatgccccggtaatttttgtattttaggtagagacggattttgccatgttagccaggctgatcttgaactcctgacctcaggtgatccaccagactcatcctcccaaagtgctgggattacaggcgtaaaccactgggcacagcctaaacttttcataattaaaaaaacaatttggccgggcgcagtggctcacgcctgtaatcccagcactttgcgaggctgaggtgggcggatcacctgaggtcgggagtttgagacaagcctgaccaacatggagaaaccccatctctactaaaaacataaaaaaaaattagccggtcgtgagggcacatgcctgtaatcccagctacttgggatgctgaggcaggagaatcgcttgaacccaggaggcagaggttgcagtgagccgacatcgcgccattgcattccatcctgggcaacaatagtgaaaccccgactcaaaaaaaaaaaaaaaaacatttggccgggcacggtagttcacacctgtaatcccagcactttgggaggccgaggcgggcggatcacgaggtcaggagttcgagaccagcctggccaacatggttaaaccctgtctctactaaaaatacaaaagttagccaggcacggtggtgggagcctgtaataacagctactagggaggctgaggcaggagaatcgctcacaagtgctcaccaccatgcctggcttttttttttttttaacagatggactctcactatgttgcccaggctggtgttgaactcctgggctcaagtgatcctcctgccttggtaccccaaagtgcagggattataggcatgaggaaccacacctggccatgataaaagtttgaaaacaaacagacgccaggcgcggtggttcacgcctgtaatcccagcactttgggaggccgaggtaggtggatcacctgaggtcaggagttcgagaccagcctggccaacatggcaaaaccccgtctctactaagaatacaaacattagccaggtgtggaggcgcatgcctgtaatcccagctactcaggaggctcagcctcagcagagaattgcttgaacccgggaggcagaggttgtggtgatctgagatggtgccactgcactccagcctgggtgacagagcgagactgtgtctcaaaaacaaacaaaaaagaaacagagaagtatatgcgaaattaaactggcaacatgttaacaattattgatgctgggcgaagatacatgagatgtcatcaaactattttcactttttttttttttttgcaagggagtttcactctttttgcaacccccgcctcccaggttgaagcgattttcctgcctcagcctcccgagtagctggaaacacaggctcgcatcaccacgcccagctaattttgtattttcagtacagacagggttttaccatgttggccaggctggtctcaaactcctgatttcaggtgatccagtggcctcagcttcccaaagtgctgggattacaggcgtgagccaccatgactggctaatttttgtattttaagtagagacagatttcactatgttgaccaggcttgtcttgaactcctgacctcaggtgatccacccgcctcagcctcccaaagtgctgggattacaggcgtgaaccaccgggcacagctaaacttttcataattaaaaaaaaaagaaaaatttggccgggcgcggtggctcatgcctgtaatcccagcactttgggaggctgaggtgggtggatcatgaggtcaggtgttggagaccagcctggccaacatggtgagaccccacctatactaaaaattcaaaaattagccgggcatagtggtgggcacctgtaataacagctactcgggatgctgaggcagaagaatcgctcacaagtgctcaccactgttgcgggaagtcagggacccctaacagacggaccggctggagccacggcagaggaacataaattgtgaagataacatggacatttatcacttcccaaataatactcttataatttcttacgcctgtcttactttcatctcttaatcctgttatcttcataagctgaggatgtacgtcacctcaggaccctgtgataattgtgttaactgtacaaattgattgtaaaatgtgtgtttgaacaatgtgaaatcagcgcacattgaaaaagaacagaatgagagtgattttagggaacaagggaagacaaccctaaggtctgactgcctgcggggctgggcaaaaagagccatatttttcttcttgcagagagcctataagtggacgtgcaagtaggagagatattgctaaattattttcctagcaaggaatattaacattaagaccctgggaaaggaattcattcctggggggaggtctataaatggccgctctgggaatgtctgtcctatgcagttgagataaggactgagatgcaccctggtctcctgcagtaccctcaggcttactagggtggggaaaaaccccgccctggtaaatttgaggtcagaccagttctctgctcttgaaccctgttttctgttgtttaagatgtttatcaagacaatatgtgcaccactgaacatagacccttatcagttctgcttttgccctttgccttgtgatctttgttggaccctgatcagtagttccgttttttgccctttgaagcatgtgatctttgtacctattctcggttcttacacccccttcccttctgaaatccttaataaaacttgctggctttgagctcaggtgggcatcatggtcctaccgatatgtgatgtcacccccggaggcccagctgtcaaattcctctctttgtactctttctctttatttctcagctggccagcacttacggaaaatagaaagaacctacatcgaggccgggcacagtggctcacacctgtaatcccagcactttgggaggccgaggtgggaggatcatgaggtcaggagattgagaccatcctggctaaatgtgaaaccccatctctactaaaaatacaaaaaattagccgggcgcggtggcaggcgcctgtagtcccagctactggggaggctgaggcaggagaatggcatgaacccaggaggcagagcttgcagtgagctgagatcgcaccactgcactccagcctgggcgacagagcgagactccatctcaaaaaaaaaaaaaaaaagaacctacattgaaatattaggggcaggttcccccgataccaccatgcgtggctttttaaaatttttttttaacagatggcctcttactatgttgcccacgctggtgttgaactcctggactcaagtgatcctcctgccttggcacccaaagtgcagggattataggcatgagcaaccacacatggccatgataatagctggaaaacacaaaaaggccgggcgtggtgggtcacacctgtaatcccagcgctttgggaggcaaatgcccgcaaatgtgggcagatcacaaggtcaggagtttgagaccagcctgaccaacatggtgaaacctagtctctagtaaaaatacaaaaattagctgggcgtggtggtgcgtgcctgtaatcccagctactcaggaggctgaggcaggaaaatcgcttgaacctggaaggcggagcttgcagtgagccgagatcatgccaccgcactccagcctgggcgacagagcgagactctgtctcaaaaaaaaaaagagagagagagagaaaatagccaggtgcggtggctcacacctgtaatctcagcactttgggaggccaaggcaggtggatcacgaggtcaggagttcaagaccagcctggccaagatggtgaaatcccgtctctactaaaactacaaaaattagccgggcgtggtggtgggcgcctgtaatcccagttactcaggaggatgaggcaggagaattgcttgaacccaggaggcagaggttgcagtgagccaagatcatgcctctgcactccagcctgggtgacaaagcaagactctgtctcgaaaaaaaataaataaataaaaattaaaataaaaaaaaaagagagaaaacaaaaagaacaagctatggagaggtccccatctagactctgaatcaagagtccagagagacagccctgtggagtgcttgagagcactcctactccagctgcccttggggccatgtcacaaatctgggccagcatccccatcatctcctgagcaccacaccttccttggatgcctgtgaccatcactcgtatcaggtcttgtcacctcctgaccaaagcatggccatcagggactgtgtgggtgtccaagcttctgtccatgcggccctggtagtcattggtgggtgtcccttctcaaaagtgagaacacagggtgctgggtaacctatggtgtctttttgccttgacagccccacgccgacacttactcccgtggtcctgtagactggagggatcctcagaagtgggcttaccgagatctaagcagccgaggatcccaacgacaagtcccatcacgtggtacagaggcaggaccgtgtaaaccacatcatcagctgtggccccagataaggacagcatcttgctcatctgcagtacccgctcatgcgtgaggatggctggcttcgggaggccttgggatgaaggcatggcaagggcagggtggtgacatgacagcacagagaggggcctgaccagagggatagatctccaacagccaggcctacattggggtttgaggctctcagagaacagtcaagtatagggatttgtggttgggttcacaggctgaatttggactgaaagtaatatgtcaagatcaaaggtttcagtggctgtttactggacacaggaagaattctggcattgacctctcaaattacattgggggtcagagttcaggccaaatatcaaaatcaagtctgggagcagtggctcacgcctgtaatcccagcattttgagaggctgagttgggcaggtcccctgaggtcaggggttagagaccagcctggctaacttggggaaaccctgtctctaccaaaaatacaaaaattagctgggcatagtggtgtgtgcctgtaatcccagctactcaggaggctgaggcaagagaattgcttgaacccaggaggtggaggttgcagtgagccgagattgcaccactgcagtccagcctaggcgacagagcgagactctgcctcgaaaaaaaaaacagccaaacaaaaaacaaatgtcaaaatcagagggtaaagtggtttcagaggtcaacactgagtcacaagtcaagtgtggggtcaggtcagcctgagagttcagaggctggtgctagggctaatgggcaccctcaccagtggtccccgaggtatagatgaagagggcagggcttctccatgtgatcccagcacgcaggtcagcaggcactgggtgggagggcgctgcatccagggcagcccccagagcccccacccctggtgtaggggaggtatggctgaggtagaagcagcggatgttctcagcctgcagcttgggaaggatctcctccaggctctcccggaggtctgcagagatgggtcagaggagaaacagaggcaaggctcacctttgaggttgcgaggcgggatctgagacccacagatgcaggcagaggagcagctagtagagaaaagcatccatgttgtttggtaaagaatcccatcattagtatttttggtcaaattgtgggaaaattaaactctgatgacctgagaactactttctgctcataagtcttgattataattgcctgtgaaagtaggcaggtggggaccaagggcctctgccagtcccagcagaacccctgtcctatagtccctgcccttgcccccttccattctccactggctccaaggccctcacctgggtccaccaccagcacccgggccccagagctcagcacagagtgcgccaggggcatcccccggccatgcgggttgatccaggctgttgggcagcccagcttggccagccccagccacatacacagggctggaacggcctgggaagccagcacaaggagggcagtaggctccccggcacacaggctcgcagggtcacccagctcagccttcagggcccatgccgcctggcaggcccgggcatccagctcaccaaaggtgactgagccggccccaggccccgtccacaccaagagtgccctgccaggctgcgctcgtgctcgccgctcgaaggcatctacaaaggtgtcaggcggctgccggctcaagcatcccctgatcttcaggcccaggtggaggatcttggccaagaagatcacatcagccggcagccagcgtagtcctgggggcagccgtgctggcaggagggttagtgccagggccgcagctgccaggctcagcccatggggcacccaggggccgagccagggccgtgctaacatggccagcccaagtagcacgcaacatgtgggatcccccaggagccagcgcagggtcaaggccacagcgactggccacactggctgccccaggccccagagcaggagcagcagcagcagcagcaaggccaactgttgcctgacacccatggtaccagctcctccctaggagcagcagctgtggagtgttcaggctcacctctggcccctcaagagtagcccaatggctcctccccaggggtggtggccctggcactgct

SEQ ID NO: 1665 - DNA, 22739 bp, Homo sapiens
cttctttcacttttttattttatttttgagacaggggcctgctctgtggtccaggctatagtgcagtggttccatcagagctcactgcagcttctaactcctgggctcaagcaatcctcccacctcagcccccagagctgctgagataacaggcgcatatcaccacacctggctagttttttaaatttattttttgtagagacggggtcttgctatgtgacccaggctggtctcgaattcctgagctcaagtgatcctcctgcctcagcctcttaaagtgctgggattacaggcatgagccatgcacccctacttctttagtgggagtctgtgccacagctgtggacacaggtgtccctagttattaaattagactttgtggtattttccccatcaggatgttcacacttccatgtggctaaagctattgatcttttctgttctggctcctgagctgagattttcttaaactctttctggatgaaatctttatttcatcaggctggtggcgtccacggcctcaactttacctccgtgatggaagagggggatctgaggctcccaggtgggccggcgccgccctacaggaaaggaggggtccctgggaggggctgttgccctggtggggttcacaggcccctcactgcaggggacccggagcaagggatgccccctggaatggccccgtgaccagaaagcgagcctgcccagcttccccaggaggagcctgcagtccacactcgcgtagccactccgggtggtggcagggtctctccctgctcccttccatagtcccgccacagcccacagccctgaggaagcctgggggtggagggtgccccggccagggtctctgtgactcacactcagggtgggccaggcgtccacaggctgggggcgggctggaggacagtggcagccccaggtggccacacagcatggtggtggtggtggtggtggtgcacggcaggcagccttggcctggcagctcgtgggaccctcgggggcacatgtggcgggtcctgccacagacgcacctgctgcttaggacgcagcccaggctgctccccacctccactcccgccctgttcctaactggggctggatcccatgtgataggcaggatggcagggtctaagcatcctcccagaggaggctcctcccccgccccaaattgtgcaacccattcctcatctgggctgggactcgatggggatgggggcttcacagccagactgtagacctgagccaggaatgccctttcagagctacacagatgcagaaatttccagaagaaaaaccacccaggccctgtttccttggcctagggttctgctgggggctaagcctacctgcagggctgggggcagggccttgagcatccagttctgcaggaccaactggtgcacctgtgcgttctgcagcagcagcagctccaccatgtctgcagggaagaagcagggggaccctgaataaagtttccgtttttcctatttgttaaagtgatagagcattataggaccagagaacaggtgtgtctgtacactgtgcaggtccccggggcaggctctgagtccgtctgcacacggtgcgggtccccggggcgcgccctgagcccgtctgcacacggtgcgggtccccggggcgcgccctgagcccgtctgcacacggtgcgggtccccggggcgcgccctgagcccgtctgcacacggtgcgggtccccggggcgcgccctgagcccgtctgcacacggtgcgggtccccggggcgcgccctgagcccgtctgcacacggtgcgggtccccggggcgcgccctgagcccgtctgtacacggtgcgggtccccggggcgcgccctgagtctctactaaaaatacaaaaattagccaggcgtggtggttcaagcctgtaatcccagctccttgggaggctgaggcatgagaatcgcttgaactcaagaggcagagcttgcggtgagccaagatcgtgccactgtactccagcctgggcaaccagggcgaaactccgtctcaagaaaaaaaaaaaattaaaacatctaagccagttgtagtggtgcatgcctgtagtcccagctactcaggaggctgaggcaggaggatcacttgagcccaggagttcgaggctgtagtgagccatgatcatgcccctgcactctagcctgggtaacagagcaagatactatctccccagaaaataaataataaaatatctgttcatctacagacaccatgaagagagtgaaaaggcaaccacaagaaggatggaacactcaaaatgcacatatcaaaaaagggctcattacagaaattataaagaatccctagaaaccaataagggaggcaggcaacctgaaagaaaaatgggcaaattacttaaatggacactttacaaaaaaggatattcaagtagccaataaggccaggcacggtggctcatgcctgtgatgctcgcactttgggagaccgagacaggagaagtccttgagaccaggagctgacaccagtcatagcaagacctcatctctacacacacacacacacacacacacacacaaaatatatatatatatatatatatatatatatatatatatttttttttttttttttttttttggagacagagtcttgctctgtcgccgaggctggagtgcagtggtgcgatctcgactcactgcaagctccgcctcctgggttcacgccattctcctgcctcagcctcctgagtagctgggactacaggtgcccgccactgcgcccggctaattttttgtattttttgtagagatggggtttcaccgtgttagccaggatggtctcgatctcctgacctcatgatccacctgccttggcttcccaaagtgctggttttttttttttttttttttttttgagacggagtctcactgtgtcacccaggctggagtgcagtggtgcaatcttggctcactgcaagctctgcctcccaggttcatgccattctcccaccttagcctcctgagtagctgggactacaagcacccgccaccacgcccggctaattttgtttttgtatttttagtagagatggggtttcactgtgttagccaggatggtctggaactcctgacctcatgatctgcccgcctcggcctcccaaagtgatgggattacaggcgtgagccactgcgcctgccctacacaaaatttttcaaattagttgactgtgcctgtagtcccagctacttgggaggctgaggtgggaggagtgcttgagcccagaagttgaggctgcagcgaggtatgattgcaccactgcactccagcctgggcaatggagtgagaccctgtctcttagaaaaaaaaaaacctcaaaaaacaaaaacaaatggccaataaatatatgaaaaagtgaaatgcaaattaaaccagaatgaacttccataagatgcccaccacgctggcaaaaatgaaaagtgtgaaaatgccaagtgttggtgaagtgctctggcgactgaaattctcattcatgtatgtggagtgtaaatgggcacaaaccttttgagagactgtgtggctgtatttcctgacacagccatttctgtcctaggcatgcgttccattagagggcaaaaaggactgtgcagatgtaagcctggaatcttgagcggggacggaagcaacccaagtgtacatcagtagatagataaatggaggcagaaatgtggtctatccatacaatggactgttactcatctgtgacctgctgcaatgtgggtgatccttgaggacatcacactaagcgaaataagccagtcacacaaagacaaatactgtgtggctccactcacaggacacagcgaacacagtcagactcatagaaacagaacacaggacggtggttgccaggcactggcaggtggggatgatgtagtcacacaaagacagatactgtacggctccattcatctgacacatcgaacacagtcaaactcgtagaaacagaacagaggaaggtggttgccaggcactgacgggagggggtgacgtagtccgacgggtggagtctgagatttgcaagataaaaatgttctgcggcacagcagtgactacagttaacgctactgaactttgcacttaagtggtcacaatggtaaagttacatggttttttttttttttaatcacaaattaatcttttttttttttttttttttgagacagggtctcactctgttgcccaagctgggacgccttggtgtgaacacagctcactgcagcatggacctcctgggctcaagggatccccccatctcatcctcccaagtagctgggaccacaggcacatgccaccatacccaactaattttgatatgttttgtagagaagaggtctcaatatgttgcccaggctggtcttgaactcctaggctcaagtgatcctcccatatcagtctcccaaagtgctgggattacagatatgagccactgtgccatgctgtaaattaacttttaaaaaaagaatcttggccgggcgcggtggctcacgcctgtaatcccagaactttgggaggctgaggtgggcggatcatgaggttagaagatcgagaccatcctggctaacacggtgaaaccccgtctctactaaaaatacaaaaaaaaattagccgggcctggtggcgggcacatgtagacccagctactcggaaggctgaggcaggagaatggcgtgaacctggggggcagagcttgcagtgagctgagattgcgccactgcactccagcctggcagacagcgagactccgtctcaaaaaaaaaaagaaaagaatcttgagtgctgggtgctataatcccagctacttgggaggctgaggtgggaggatcgcttgaggccaggagttttggacctgccttaggtgatatagcaacactgtgactcaaaaaaaaaaaaaaaagactcatgagatgggaatataatcctggattatctgggcaagcccagtgcaatcacagggtccttagaaagtggtgagataaaatgactgtcaatctagatttgaatatgcagcaaaacttgcatttaaaaataaaggtagggccgggcatggtggctcacgcctgtaatcccagcactttgggaggctgaggagggtggatcatgaggttcaagaccatctggccaacatggtgaaaccccgtctcaactaaaaatacaaaaattagctgggcatggtggcacacgcctgtagtcccagctacttgggaggctgaggtaggagaatcgcttcaacctaggaggcggaggttgcattgagctgagatcatgccactgcactccagcctggcaacagagcgacactcccatctcgaaaaaaaaaatcttttatgaattcctttagaacagttatacaaactccctcagtatctactttcctgcaaatgttttttatttccatttatttatgtatttatttagagacagggtttcactctcttgcccagactgcagtacagtggcacagtcacagctcactgcagcctccacctcctgggttcaagtgatccttccacctcagcctcccaagtagctaggaccacaggcatgcacctaacacttggcaaatttttgtatttttttgtagagatggagtttccccatgttgcccaggctggtctggaactcctgagctcaagcaatcctcccacctcggcctcccaaaatgctgggattacaggtgtgagccgctgtgcccggcctccccttatttttatttattttttttaagacagagtcttggtctgtcacccaggctggagtgcagtggcgtgatctcagctcactgcagcctccgcctcccaggctcaagcaattctcctgcctcaacctcccaagtaactgggattacaggcgcccaccaccacacctggctgatttttgtatttttagtagacacgggatttcaccatgttggccaggctggtctcgaactcctgacctcaggtgatccagcctctttagcctcccaaagtgctgggattacaggtgtgagccgctgcgcccagccaagattgcatcttgctatgttgcccaggctggtctcaagctcctaggctcaagcgatcttcctgcttcagcctcccaaagtgctgggatgacaggcatgagccactgtgctggccgttaaccactgattttaaatgctgcattttctctcatatggcatacaagcataggcacacactcacccattcacacacacccctacctcggtatgctttttagaacctatggcatacaagcataggcacacacacacccacacacacacccctacctcagtgtgctttttagcacctgacagactatcactaaacttcatctggaaaaatcgacaggtaataaggaaagacaggactacccttctttatgatggcacaagctatgctctctgccactccaggggctcctcatatggatcacaataggaaaggtatcccctggatgtgggttacatggccgtcctgggccagatctggcttggattgcaatatatgatagagctacagtaattaaccaagtcagcacaggggttgggataggcaggtcactgggacagatttgaggacagctgtcaggtgattcagccattctacacacgtctgcccctagactaccaattccattagtcattagggcaatgcaaatcaaagccacaatcaaccaccactgcatcctgttaaaatggataaaatgagaaagactgaccataccacatgttgccaaggttgtaaataactagaactcacaaacattactagtgagaatattaaatgctgcagacactagataacagtttggcagtttcttttttttcttttttgagacagagtctcgctctgtcacccaggctggagtacaaaggcacgatttctgctcactgcagcctccacctcctgggttcaagtgattctcctacctcagcctcccgagcagctgggactacaggcatgtgccaccgcacctgctgatttaacttttaagaaactgctgcccaggcgcggtggctcacgcccataatcccagcactttgggaggccgaagggggcagatcacgaggtcaggagttcgagaccagcctggccaacatggagaaaccccgtctctactaaaaatacaaaaatcagccgggcgtggtggcacatgcctgtaatcccagctgctcgggaggctgaggcaggagaattgtttgaacccgggaggcagaggccgcggtgagccgggatcacgacactgcactccagcctgggcaaaagagtgagactccatctcaaaaaaaaagagttaaatctcatatgattcagacatttcacttctaggtatttacccaagagaaatgaaagcatacatccacagaaagactgaggcaggaatgtccacgacagctttgttggccataagcgaaaacaagaagcaacccaaatgttcattactgtggttggaacttaatcctcaatgtggcagtattgagaggtggggcctctcattgctatggttggaacttaatcctcaatgtggcagtattgagaggtggggcctgtaaggggtacttggatcatgagggctctgcctttatgaatggattaatgcatacatgagataatggattaatgatttcatgggttaatgtgttatcatgggaggagaaatggtggctttataataagaggaagagtgacctgagctagccatcagcacactcagcccccttgccacgtgatgcctccagactctgcagagtccccaacagcaagaaggctctcaccagatgtgcccccgaaccttgcactccccagtctctataactgtaagaaatgaatttcttttctctataaattacccagatttggccaggcgcagtggctcacgcctgtaatcctagtactttgggaggctgaggtgggtggatcacctgaggtcaggagttcgagaccagtctggccaacatggcgaaatcccgtctctactaaaaatgcaaaaattaaccgaaggccaggcctggtggctcacgcctgtaatcccaatactttaggaggccgaggcaggcagatcatctgaggtcaggaatttgataccagcctggtcaacatggtgaaaccccgtctctactaaaaaccacaaaaattagccaggcatggtggcaggcgcctgtaatcccagctacttgggaggctgaggcaggagaatcgcttgaacccggtgggcagaggttgaagtgagccgagattgcgccacttcactcaagcctgggcaaaagagcaagactccgtctcaaaaaaaaaaaaaaaaattactcagtttcagatattctgagcaacagaaaatggactaagacatccaccaacaggtgaatgcataacaaactgatatattcacacaatgcaatactactcagcaattagaaggaaccatttattgatacacccaacgacagtgatgaatcttaaaacagtcatgctgagagaagccatacaaaaaaagagtacatactgtgtagaccatttctacaaaaatctagaaaatgcaggccaggcatggtggcccacgcctataatcccagcactttgggaggctgaggtgggtggatcatgaggtcaggagttcaagaccagcctggccaagatggtgaaaccccgtctctattaaaaatacaaaaaattagcagggcgtggtggcgggtacctgtaatccccagctactccagaggctgaggcagagaattgcttaaacctggaggggcagaggttgcagtgagccgagatcacgccactgcactccagcctaggcgacaggcaagactctgtctcaaaaataaaataaaataaaataaaataatctagaaaattcaaactactacatagtgacggaaagctgctcagcagttgcatgggggtgtaggaggagggattaaaaagaaacacgaggaaactttggaggtgatggatatgctcagtcttgattgtagtgatataagtatatgttatatgtatatgttaaaacttgtcaagccaggtgtggtggctcacacctgtaatcccagcactttgggaggccaaggcgggtggattgcctgaggtcaggagttcgagaccagcctggccaacatagtgaaacccctgtctctaccaaaaatacaacaaaatagctgggcatggtggtgggcaccagtaatcccagctactcgagaggctgaggcaggagaattgcttgaacccaggaggtggaggttgcagtgagccaagatggcgccattgcactcctatctgtgcaacaagagcgagactgtctcagaacaaaaaaaataaaaataaaaaaaaaaaacaaaacttgtcaaattgggccgggcacagtggcaaacgcctataatcccagcactttgagaggctgaggtgggcggatcacctgaggttgggagttcaagaccagcctggccaaaatggcgaaaacccacctctactgaaaatacaaaaattagcaaagcatggtggtgcaggcctacagttccagccacttgggaggctgaggcaggagaagtcgcttgaacccaggaggcagaggttgcaatgagctgagatcatgccattgtattccagcctgggcaacaaagtaagacactctctctctctctctctaaataaataaataaataaattttaaaaatcaagtatttaaaagctattattattattattatttttgagacagagtctcactctgtcgcccaggatggagtaaagttgtgcattcttggctcacactgcaacctccgcctcccaggttcaagcaatttctcctgcctcagcctcccaagtagctgggattacaggcatccatcaccatggtgagctggtttttgtatttttagtagagatggggtttcaccctgtgggccaggctggtctcgaactcttgacctcaggtaatccacccgcctcagcctcccagtgttgggattacaagcgtgagccaccgagccgggccctaaaaattattttaaaagaagcatcttaataatggtttttgaatggatgatgattggatgagttggaattggagcccaattattttacctcctagttatctttcttatacctcttgtttccttccctgtgagatatcatttatataaggatttcttaaagttaaaattattttcatgttgaacagccaaaagctggccctaagtgactgtcctgcttccaggaacattttccctttcagtagataatttcctcaacccacaacaatatgaatatggaacacttaccttccttaatacttcctgaccgttgagtagggaaggcctggggaggaggaatctgtgctatgagtggctgctgagggagctgctgaatgatggtggcaggaggctgggggacctaggaacagccaggtgattagctatctgcatatgtccttgaagaaagtgtctccagtatctaccacccatccatccacccacccatccaaccaaccaaccaaccaaccatccacccatccatccaaccaaccaaccaaccaaccaaccatccacccatccatccaaccaaccatccacccactcatccatccacccatccatccacccacccatccatccaaccagccaaccaaccattcatccacccacccatccacccatccaaccaaccacccacccatctatccacctacccatccatccaaccagccaaccatccaaccagccaaccaaccattcatccacccacccatccatccaaccaaccaaccatccacccacccatccatccacccacccacccacccatccatccacccatccacccatccacccacccatccatccacccatccacccatccacctacccaaccaaccaaccaaccaaccacccacccatccatccacccacccatccatccaaccagccaaccatctacctacacatccattcatccatccaaggagaactttaaatgattaaccccagacactgaataaatggttgaatggaaaggtacttcagtctagatatcacttaggatgtagtatttttaatgtttcccacatttcctgtctttagcggggtgggctgaggcctggttccaccaattctgctttaataggagcaaccaacacttggtatggtgtttttgtttttttttgagacaaagtcttgctcttgtcgcccaggctggagtgcaatggtacaacctcagctcactgcaacctccgcctcccaggttctagcgattctcatgcctcagcctcccgagtagctgggattacaggcgcctgccaccacgcccggctaatttttgtgtttttagtatagacggggtttcaccacgttggccaggctggtctcgaactcctgacctcaggagagccacccatccaaccaaccaacagtgtccaggcaggggaaatgcagtagcggttggccaccttggcctcccaaagtgctgggattacaggcatgagccaccatgcccggcctggtcagtctttttaattgtagccactttaatagagatgcagtggtggctcacagtggctttaatttgcatttccctaatgacggatggtgttgagcatctggggcagacccgtgggtaggatggccgcatcccaacaggcgttctcaattctgtcccagtgacctctctatcccagcccccataacaacttggttaattactgtcctccatcatatactgtagtacatatatagaacacgtcatgaaaatgaactttggtttctcctctgagtgaaaataaattatagccaaatattcgagcatgaaaggccttctgttttatcctcttctagctgtgtgaggctgcctggccttgtcccttcttcctcagttcacagaaaggacggcagagaccaagagttggcaaacttttgccaagagctacatcgtaaacagcttccaaagcaggacacaccgtcagctcttgagttggccattgcagcatgaaagcagctacggacaatgtggaaacaaatgggcctggcccaataaaactttatttatgaacactaaaattagcatttcatataattttcatatgttgcaaaatattattattgtattggcttttccccaaacatgtaaaaatgtaaaaccattcttggcttgcaggttgtgtgagaataggaggcaggccagctccggtctgaagctgtggtttgcccacccctggcacagacccatgaggctttcttagagctgccgtgcccgtcctggctgatgggacctcctacctcaggggctctgagtccagctgccaggaagctcatcttagtgacccacagcccctgctcacccacctggtgtcactggggctgagagtgaaacctgcaggcataactggccctgatggatacacagtaagcatagatgtgtttgggatgaggaagatggggggtccacagcaatgaccccccgtactcccttctgtcctgggaggaggtttctggtgctggaagacaggaaggcacaggctgggaatatccagaacctggtgaaggccacccatctgcagaggagggtctggggcaggtccttcggaggctccccttccctctgtaccctccaccatgtgctgctgccagggtcccctcccaaagggcaaaagccttccaggtcatagactctgctgccctgtctagaaattcccacctcagcctcttctcttccaccttccctgcaccccagtcacacgaatcccaccaaagccttgacctccgggcccccagcttccatcccacctctgggtgcctggtttccctctgatccattttttgcttcagaaagtcagagttgttttctgctgcctgccacccagaaggctgaacagctgtaggaagctctcagaagtggagcactatttacctttaacattctgcccttgacattggggccttaagcatctcctgggcatgataaagttttttttttgagatggagtcttgtaatctcctctttctgggctcaagcgattctcctgcctcagcctcctgagtagctgggactacaggcatgcaccaccacgcccagctaatttttgtatttttagtagagacaggatttcaccaagttgcccaggctggtctcaaactcctgacctcaggtgatccgcccgcctcggcctcccaaagtgctgggagtagagatgtgagccaccgcacccggccagtgataaagttctgaggagttgacacacttccccaaattcagggccgcccgctgagctctcctgatacttctgcccctaatgcaacatttaaggccagggctggggtttgggagacagagctgggccccagccttcctctgtgatgaggggtaagcagtccggggaggcccaggcagtgcccaggcaggcagctggcccccttcaagggtgggccttgggaggatgggggtgacgaggcaacctcgctgcaggcacagcgcctcctgccttctgtaaaatcttaattccgcacccgcctcccactctcagatgtgctcctcgacttcgccctcttaccgtaggcaggatgatccttggcgggtctggggccagcggggatggggaggcagtgggtaggatgcccgtggggggcagctctgggggcagggctgacccgagggctcctctgcttggcccgctccaggcctgggcccgagagagctcgtccaggaggtgttgttcctgcaaggccgatgcagagctgctgcacacggggacggggagccccaacgccacagaggcacccccagcatcaggctcaggccagcctgggccaggtacaggcgcctctccgggcaggatggccatgactggaagacccttccagggttatgtgcatgagggtggcctcctgaaattgacccaagcgtgtcagctagtttccagttgttttctttttccagccccagggtctgttctctctttcaagccagttccaggcctacttttttctaggtctccccctagaaaagcggccccacctcccctgcatctctgccactcggatgcatctttggtgagtgccgtgggagcaaacctccaggcatcccagaatttcaggtcctcctggaattgggcccttactcaacatttccagtcctgatggaaacctgcacccaggcaggtctctaagctaacagtgtccttgctggggcctggccctgagagtctggaaaggtcttccctaatactccccgacctggtgccttaaggctgagcagctatctctgctacagtgagctcagccaggttcgctcagagggtgcagggcctacccggagtctctgcagaaggtccctccttctcttcagagcagtctgcagggcatcgtccggccggtcctcatttcctggagggaagaacctgcttgcttaccaaggaacgcgtagaggctgtcgctgcaagcactcggactggatggtactgcacccatgtcggaaggccctgcctcacccacactcccaggatgggggaggcctgggaggatcctggtcttaggttatcccagataaagagggaccagtgttgggtaaggagggcaaggggcagcatcaggggaggggtaatccagggaactcagtgctggaggatggtcatctcattcctggaagggaggctgaaatgacgcgaccaggttcctcctgagtgcatttcatacagagtgccctgggctccaggaggtcaagggctctacagggctggctgcagcctgaccttggccacctggagccaccctctggccccaagtggtctagagtctggtctgatccccaagtatctgcacatccctcaagtctgccccctagtccgggcgtggtggctcatgcctgtcatctcaacagtgggaggttgcactgggaggattgcttgatcccaggaggtcgggggtgcagtgaattgtgatcaggccactgcactccatcctgggcaacagagcgagaccaaccctgtctcaggaataaaaaaaaaaaatctggccaggtgcagtgagtcacacctataatctcagcactttaggaggccgaggtgggtggattacttcaggccgggagtttgagacgagcctggcgaacatggcaaaaccccttctctactaaaaatacaaaagttggccaggcatggtggagcgcacctgtaatctcagctactcgggaggctgaggcacaagaattgtttgaacctcagaggcggaggttgcagtgatctgagattgcaccactgcactccagcctgggcaatagagtgagactccatctcaaaaaaaagaaaaagtctacattccttgggggagggtctacactcaagagaaggctccggaaggtggggggcagggttctggcctcctttcccttaggcacaggggtcctgcccctcacccagcatcacactggagaggggccgttgggaaccctagccagcccttgggggggtccccaaaccctctgccccaggcactggtagccattctattccctcgcactggctctgcagtcaggggacctggtttgggattttctctctgtatttgagactgggctctgcccttggcagctgagcccccacagctcacagcttgccccacgttccaaagaacaagaaatgctcctctggcctcctcagcttctccctggacgtccccgggtaacagtgaggacagcagctcctccccaaccaatggacaagctcagggtctggaaccagagcaactgggtctgatctgggtgcgaccactgccagggtgagcaacctctctgcctccattttctcatctgcaaaatgggaacaatgaaggtgcccctttttggggtttgcagactaaaggtgataaggaatgggggtgtcttcaactctgaatgtaaaggaaaagcgttgaggacaatctcgccggtaccaggagtgggggtgattcccagagttgctgtccccacctccccctggaggtggctccccctggagtggctacacttgcgtctgtctgtgctggttccaagcagcccaggggctctcacctggctcgaggtggaggccctcaggtcccccttccacgttctgccgttcttgctccagcttctgtgaggaagagagaccgtgacagagacggtggctccacgcaaaggccctgtgtgctccaggaatgactaagaggctttctgagtgaaaagaatggtacgtcaggagtaacccagcctctccagggccaacaggcgggagtcaagcccctccgaggatctccctgagctgcctctgtaagcctgacctctagcaaattcatgtgttccatccacaagtctaggggcggatgctctgagtggtcccttcaggcagatttctgaagagcaaccctgggagacacctcactggtgaggcctccaggcttcccagccagtgcatgcctagatcaccccccacctgaaccctgagctgagcagctacctgctgggtgtgtccaggggtgagtccctctcatggcggcctgtgggccaggatgcagggctggcgaaaggtgggcagcaggtccctcaggcagcaggagagggaacaatgcaggcagggggtgcagaggtgcccccaggcaccgaggctccccagaccctgtgctcagtggcctgcgaggacaggcaggtcggtcatgggccacccagaccctcagagaatgtgaagactaagtctgaggatgggtccgctgggctgccagccccaggcctagcccttggggccctgcattctgcacctgcagggctgtctcgaagagtccctccaacgccacagcctgcgagttgttaaaaacaggagcatcccgggctctgcctcacctgtcccaagagcttcagcgtcagtcgggtcacttgctctgctgctgatgagtccagcatggtgggagctgcaggagacgactgtaggggcaggggaggccacagcccacctccctccctggttctgttactcgcaggaaagaactgctcagcaggagcccaagcaccggtgttgcctgcagggcgggccttacctcctggagaccagcctgagggaagagaagagccctgtgggaagatagccacaccctccctggactgcagtgccccagaagccagcgctgggcgccgcgtgacagttgccaggctgccagacacagggaggccccaggttgccaggtttccactgtgcgtcctcaggctaccggtaaacactcatccccaggtgtggccagctgggcttcatgggaaggcaaaaaagtgggcagcagctgaggcagaggggcagaaccctcagacctgggggaagggcagtcgtgaccccctatgcaccaccagcctcaggacccagtccagaagaacctgtgtgtcaggggagggcgccccacctgtgtactgcctccagggtgttaatacctccctcctagggaccctcagagcaagcagggaagacagggtggggagacactgggaggacagggtgaggagactgcctaccaaggagttcaggaaattgcaggcagcagaaggggtaggacagaggaggggttgtgacctgcagaggggctgggctttagcaggaccagagggggtgcccaggggatatgtcccaccttggggctgggggcactgggcagggagtcaagtttgcaggaagcttcgcagagggtgacgcaaaacaggagcgtggtctgcacttggttgggcattaaactccacgttgatgagttagtcaatcccactagcaggcagactgacatgtgggggatgtcagcagcaggggcccagacctgtggacccgaggggcagaggtcagcaccctcctcggtgcagctaacccaggaacttgcctcagtggccaaaattgctctcttgccctcagttctgtaaatggcccatgtccatcagtatctatggttgtgtgcctgtcctgtcttccaacccacatccatgtagggaccctgaagctggaccagtgagtgattgggtgaaggctggctagcccgtaggaggtcaggctcacagaggcagctcatggagatccttggaggggcgcaccttactcctgctggccctggaggggctggattactcctgacgtagagttcaactcaccttaccctggaggccatccaaccagaaatgaagtcagcatgaaaccaggccttaccctccctccagatctgtggagggtgtgggctagggtcacatgacctgcctggtgccacacattcccagatggcagtcaggggtcctcgctggtgctgctggacatgagcagactctggccccatgtttaagatcccagtgccattgggcgttggctcacgcctgtaatctcagtgctttgggaggccaaggcagaaggatcacttgagtccacgagttggagaccagccggcacaacacaacaagaccccatctctataaaaaataataaaaaagggccaggtgcggtggctcatgcctgtaatcccagcacttagggaggctgaggcaggcagatcacgaggtcaggaggtcgagacaacctggccaacatggtgaaaccccgtctctactaaaaatacaaaaaattagccaggcgtcgtggtaggcgcctgtaatcccagctactcgggaggctgaggcaggagaattgcttgaaatcggaaggcagagtttgcagtgacccaagattgcgccacagcactccagcctgggcaacaagagcaaaacctccgtctggaaaaaaaataaaaaaaataaaaaaataaataaacaagataataaaagaacctggctcttgtccacagtcattaacagtgacagtcttgggagacatttaaacagctctgagtgtgcacagaacaaaaaccaggttaatttagttaagcaactgtatagagcacccttgatataagtgacctcatctgagaaaaggactccatcttatgtatttttttttgagatggagttttgctcgttgcccaggctggagtgcagaggtggagccatctcagctcactgcaacctccgcctcccgggttcaagtgattctcctgcctcagcctcccgagtagctgggagtacaggtgcacgccaccacgcccagttaatctttgtatttttggtagagatggggtttcaccatgttggccagactggtctcgaactcctgacctcaagtgatctgccgtcttggcctcccaaagtgctaggattagaggtgtgagccatagcacctggcccctgatgccttttaaattataagatagggccaggcaggcggaagttgcagtgagccaaggtggcaccactactgcactccatcctgggcaacaagagtgtaactccacctcaaaaaaaaaaaaaaaaaaaaaaaaagggtatcaggccaacagggaccagatgtttcctcatcagtagatactgcacccacccagataaagacataaacaagacactcttactatcagtccttaccagagtactctatggccatgaaaagagcagaacaccaccaggtcaaagtggccgttttacagacagtcttgctgtcacttgtgagaagccctccacatctgctgctgcaggctctgcccacatcagagatgcttccttgccagattctccttttcgttgaactggttaactttttttcctctcctctttctcttgatgtggaatgtttataacatttatgcagtggtcaagtatactattatgtatggtttgtaatactgactgacttaaggagagacttgagcctgtgtgcccacagctgtgactgccaagtgaatgggaagcactaagaattgcctcctcgggatctctagtagtatacataacatgctccagagggcatggatttgtcagactttttttttaaatagggtttttaagaacagttttagatttagagtaattgagaagatagtacatggagatcccacataccacatgtgtggcttcccctcttattaacatcttaccttagtgtgctacatatgttatatatatatatattttttttgagacagagtctcgctgcgacgcccaggctagagtgcaatggtgcaatcttggctcactgcaacctctgcttcccagtttcaagcgattcttctgcctcagcctctcgagtagctgggactacaggtacgtgccatcatgcccagctaatttttgagtgaaagccagtgcacctggcccatttgttatgattaatgaaccaatattgagacacaagtaactgaagtccacactttgacagtttccttaggtttgcctcatgtccctaatgtggtatccatcagaacaccccattacattgagttatgtgtctttaggctccttctcagactttcctcgtttttgatgaccttgacagtttcgaagagtactgggcagatattttgaagaatgtccctcaattaaaatgtgtctattatctcctggttagactgggactgcaggttacagaaaggaagcatctaggggtgaagtgccactgtcaccccatcacatcagggacacacactgtcacctcgactataactgtgaggctgacctgcgtcacttggctgaggtggagtctgccagttttctccacaataaagtggctctttccctccttttctttattgcactctttgggaggaagtggctatgtgtggtctacacttaaggagaggggagttacgtttccctccttgagggtgagtatctacaaaatttatctgggcagcttttttttttttttttttttgagttagggtctcagtctgtcacccaggttggagtgcagtggttgcctggccttgacagctttttaatagtttaaaatgaattgaggctgggcgaggttgctcatgcctgtaactccagcactttgagaggccaaggcaggtggatcacttgagcccaggagttcaagaccagcctgggcaacacagtgagaccctgtgtctactaaaaatacaaaaattagctgggcatggtggtgtgcctgtaattccagctgctcaggaggctgacatggagaatcacctgagcccggggaagttgaggctgcaatgagcggtggtctcaccactgcactctagcctgtgtgacagactgagaccctgcctataaaaaagaaaagaaaaaagaactgaaataagacccaagtccaacattagcagaacctctctaggatgtccacagaaacgactctggggttctgaggaacacagtctaggcaaacctgggcacatcccctcagtcccacagttgtaaatgtattgtaacacgtaacagttgtgagattcaggcgcggtctgggtctctgttcctggaaagtgtgatcctgtgggtgcagcccctgctcgcttggctgtgttgcctgcctggcccctgctctaatgagcccactgcccagagtttgctcaaaccacccaattccgagtctgggaaccaggagaccgctggacaccccgctcaccacacagaagactgtggcctgagtcaggagaaggaagtttctggcggtcgagcttccacggcttcctgagggaggttgcagggagccgagatcgcgccattgcgctatagcctgggcgtcgcagcgagactgtctcaaaaaaagaaaaaaaattctgagcgagattccagggcttcctgagggcgcgtttaagttgcagttgctgaggaggctgcaaggtgagcttgcgtcagcgaggagccactccagcacgctcgggaagggcatcgttactgctgcaaacaagcacacggccctccacgacgaaccttttgcaagtgaaggcgcacgaacaggcccggaggactacaaagaaacccagaaaccagacttggacacatgaaataaaggggttagctgaaggaatactccacagttaaggacggcctgcgcgaggtcaccggccctgtcttggttttttgccacttcgctccagttagtttcccaagttccacctacgcgcgcgccagctgagaaaacgcccaccccggcggtcccgccacaggtcacaggcggtgcggaccccgggactgtgtccgggcttcggtgtccagagagctccaagacacccaaaccttccgtggtttccacctctgcaagcttatgttccgctgagctcaagctgagggacgacgacctcatgcgacgtcagtttccccctgggaccacgaacccacggccccatttctcttctgtctactaaaaaccttttcttttcttttttttttgagacctaagacatcagtgagacacacgagcagacacgggctcggtcgggaaaggcgggagctccaagcggcggggcctgcaggtccaggcggttcgcgggctttctgaccgcattcggccgagttcttctctgaagacccaggacccccggccgagggggcgcattcggcgggctggtggcgtaggattttgtttcgggttcccagggtcccggcaagggtgagggagcccttgcggatcccctgagatccacctcagcagcctcctccgtggtaggcctcaacttcccgcggcggcccacagccaacgactaatgcctgagcgggagaaaacggcctggccctgtccgggtggttgctgagcaccgttcggcgccgcccgcgcctgcagggagcccggcccgctgtcctggtggacacaaagcccaggggccgcccgcgcgggaccagcagcgcgaactttttg

SEQ ID NO: 1666 - DNA, 121647 bp, Homo sapiens
gcggggggagggcgagcccaagcgcgggggagggagtgtaaatagagcgaaggctgctctgtgtcagccccgtcaccgccgggcggcccgcgcggagtctgagggagatggaagttgagcaagagcagcggcgcagaaaggtggaggccgggaggacgaaggtaaacattaggggcttcttctctagctgctctggcgtgaagtcctaagggcggctccggtgcccgccaccgccccctgccaggagaggacgcggtccggcggaagccgccgcggaggtctcgctttttcccgccggctccgctggaagccgcctcctggccgccgccatcttgaatccgccgctctccgccaggtcccgcccccgccgcggccacagccaatcagcggccgggacgcgcggcgcctctcgggcgggccggggcggggctgcgcctgcgtcggggggggtggggcgcgggctgggcgcggtgcacgccggggcggggtgtggctgcagggcggggctacaggggcgtggcgtggctgcacggagggggtggggcgcggcaggcgctggaccccaggctggatcttccagtggctcccgcgtcctccgggaccgggtggcctggggcgggcggccggtattcgggtggctgcttggtctagggccagtttcctgcgcggccggggccgggggcgtggcgcgggtggcctgcagcgcctccccagggtgcgccttcgcctcgtccgtcggagatgctttccccgcgcgtttctcgcggcgttgcagtccttactgtgtgaaaggcccccgcggcgctcccggccgccgtcttcttcccgcgcccttgggctcgcgtcctgcccgtccgggcctggcgtacgctgccgggaacccacgcggcgctggcgccgggcgccttcaagggacgcgctcccgtctttctcccgccccgggtttctccgtgaaaaagcgctcggtttgatggccactgtcctaggtttcgtgggaataaagcgcgcagagcccatgactcgggggcaggagaaagggagtcccgaaagcgcgaggcggaaccgcgggagcaggccggcctctgcgaggtgcgcgccgctcccccccaggatgttctggctggggtgctggggaagagcggggctcccgggcacggcggacaggggacgcggggctaggccggggaagggctgaggcgggcaggaggggaaggggagcccggagcctgcagggagctgcgaacaggagcagagctcccaggagggtggaggggggagggagggacaagacgccgcctgtagggcgacgcaggccgcagaccaggtctgtgctatatcccgacatggataggtgtggtggaggaggacatgaaaataaacgacatgaggttgactttgaaggaaatatttccttgagagaccattttcttgtgtaaatggccttgtgtaatttttctgggtccatgagcttgtgtacttgtgttatcatttacacaaatgtgtgttccatgcgtttgtttttgtggccacagttgtcttttgagggaacagatgtctccccgtgaaaggctgatgtgggatcgatcgcatacctcttgagtaagacgttagcgggagatgaggctcgcacatagtctcaaactctcggatttgaggactgagcagagctaggctgtgccttctgatgggcgatgctctgtggatgtccctggtgctttggtgagctgtgtcatgaaaaatagaacatctgattccataaaggaagatgtgagattgacctggcttaattaattttttgctatttctgtatcttgtctcagaatctatggctaggaagttttggctgggctatatatttcttcagttgggggaaaattggggcaagaagggagagatttagcttttatatcattttaaaacttaaatatgccttgattaagctatcaatcttttatacaaattttttttaaagttttatttttctgtaaactgccaagggctaggaaagctattctgccaatcagccgtatggttttctttaccaggcataattagcagtcctcattgttagaccccttggatatagatattgatgaaggcagtgtttgtggagagccatctgttggccaggtgtggcagagtagactgggtcagccctcgggcctcatggtccccaccagtctgttgactttgtggttctgttatttttttctcacttacctttgcctttactacttatctacatttttgcgcagcttgctcacttccgacagagaaaaacaaaaggtgacagttcgcattcggagaaaaagacggcgaagaggaagggctcggctgtcgatgcgtctgtccaggaggagagtccggtaaccaaggaggacagcgcactctgtggaggaggggacatttgcaaaagcacatcatgtgacgacacccctgatggggcaggaggggcctttgcagctcaggtagatttgctcaatgttgtatttgaacatttcgcttatcttctagtgatttctagtgtgatttactaaagatggtctttggtctgtttttgcctttcaaaagtgaggaaagagggtgttattttagtttataaaaagtgagggccgggtgcagtggcttacgcctgtaatccccgcactttgggaggccgaggcaggcggatcacctgaggtcaggagttccagaccagcctggccaacatggagaaaccctgtctatactaaaaatacaaaaattagccggacatctggcgcacacctgtaatcccagctactcgggaggttgagggaggagaatagcttcaacttgtgaggcagaggttgcattgagccgagatcacgccaatgcactccagactgggtgacagagcgagactctctctcaaaaaaaaaaaaacagtgagtaaatttttatggttttattctttttattttattttttatttttttgagatggattctcgctctgtctcccaggctggagtgcagtggcgcgatctcggctcactgcaagctccgcctcccgggttcatgccattctcctgcctcagcctcccaagtagctgggactacaggcgcccgccaccacgcccggctagtttttgtatttttaatagaggtggggtttcactgtgttagccaggatggtctcaatctcctgacctcgtgatctgcccgcctcggcctcccaaagtgctgggattataggcatgagccaccgtgcccggcctatggttttattcttaataaatttgggttttctttttctttttttttcttttgtttgttccagacagtgttttgctgtgttgcccagcctggagtgcagtggtgtgatcacaggtcactgcagcctcaaacccctgggctcaagtgatcctccctcctcagcctcttaaagtgttgggattataggcatgagccactgcgcctggccctgttttatctttattatgtaattttgagaagttttggattaactacttgaagacaagtgtcagttgtttgctttgtaatggaagactgggagttcttcgtgtgtggtcgtgtcagcccctttgatgggtgtttcttgggacatttaaaacataatattccttcacatagttgtaaatgcacctgcttgtcacatttgtcttttacctttttactaaacgtgagatgaagagggaaggggtgaaggtgttgcagacatggtgtgttgctggaggagactgggtctgctgcttgaggccttgtgagctgcaggggcacccccatgggcaggtgtggcaggtgagtgcacactgagtcctgaaggggctggccttccgggctccttgggggcctacaaacctgcctggaggcgggctgtccttgggccttttgtatgaattatgaacgagggccttaggtgttgagtgtccctgctgctgcagcagaatgggtgcaggctttgatgtttgctaggatttgctggaaaactggtggccaaaggcagaatctggctcaaggtcataatgtatgtatcctgctttacttaaaaaattgagttgttggcaacagttaaaatttgtgttattctacctacaaatcctgaattttgctttttatctcttgagtgtttttggttgttgggttggtgtgttttttttttttttcccgttttctttttaagatacagtctctctgttgcccaggctggagcgcagtgacgcgaactctgctcagtgcaacctctgcctcccaggctgaagcgatcttcctgcctcaggctcccaaagtgccaggattacaggatttctgccaccttgctgggcagaaagttacttttgatatattctggttgcatatgttttttggttttttttgaaatggagtctcactcttttgcccaggctggagtgcagtggtgcagtcctggctcactgtaacctctgcctcctgggttcaagcgattttcctgcgtcagcctcccgtgtagctgggattgcaggcgcctgccaccaaacccagctaatttttgtatttttagtagagacagggtttcaccatgttggtcaggctggtcttcaactcctgacctcaagcaatccacccaccttggcctcccaaagtgctgggattacaggcgtgagccactgcacccggccctctggttgcacatactttttttttttctttaaggcgaagtctcactctgtcatccaggctggagtgcagcggcacgccctctgcttcctgcaacctctgcctcccgatttcaagcgtttctcctgcatcagcctcccgagtagctgggattacaagtgggcaccaccatggccggctaatttttgtatttgtttggttgagatggggtttcaccacattggccaggctggtctcgaactcctgacctcgtgatccacctgcctcggcctcccaaagtgtggggattacaggcgtgagccactgtgcctggcctgcatagacgttttaaaagtagtaagctgataaatatatgtgggaatctcaggatcctatcagaaaaccattccaaacttagcacattttgtggtaaattgtatttggagactgatgggtcgttaacattagaaggcatggtatagactcctgattaaacactcatactttgctgtttcatcaggtagagactctcttagtttctaactctgctatttgatgcatgccttcattcaggaagatgatctgatgaaaagcattttgatttttgttttcaaaaccagaagggcatataccagaaaattaacagtggtggtcagaaaggaatagagttgttggttttttcgttgttatggtttttggtatttcctacaataaacacattaggttacttatataacattttttttcattttagaattaactataccactaataaaacatgtattttggacatcttaaagcaatctataaataacaggcccattactggtccccttgacttagagatgcacacgcacactcactgcacttgctgcattttgtgtcacctcctcgtgaccacagtggacaggacacttcaccctcaagcgtggggtggtgtggcagatgtgaggagaggtctgctttcacaaaacttggtgaaacaatggcaagatggccaaggtaaagcattctgttacttataactgttgctgtgagtagtaacttaactgtttaaagcagtattttaaaaaccaaaagctggtaaaatgtaaggatactttctctaggaaaagtatgtgctcctgcagccaggattcttcatggaatgaaggcatggcagggcctgactgattttcatctcacatcgtcatcctgaactcctctgcacagttacagcttgacatcagcagagacatacctcctcttcctgtccattggctctaaaatggtgggcaaaggtcaggtaccagtcagctttttccacagaattcctgacattttaataagctaaacatgcagtcatcaggtattaacccctattggatcttggacatcagctttttcccccttttttttgagatagggtcttgttttcttgaccaggctggagtgcagtggcgcaatcatggctcattccagccttgacctcctggcctcaagtgaccctcctgcctcagcctccctagtacctgggactacaggcatgtgccaccatacctggctaacttaaaaaaaaatttgtagagacagtgttacactgtgttgtcagggctggtctcaaactcctgtgctcaagtaattctcccacctcggcctcccaaagtgctggaattataggtgtgagccatcccacctggctaaaatttattttctttatacatgtataggtaaactaagtagtatgtgtagaatagagccattgtctttctgctgtacactaagttaggaatcaaatttcttaagccattttgtcaattatgtatataaaaaccattggtgctttagaagcagatatttcattaacttttttctgattatatcattgtacatcatcagttcagtctaaaaaggagtttttttcatatgtattataaaatatttcatgatatttgagtttagtatgcctttaatccagttgtagatgttaaaataggagtaattttgtgttcaaaataatgatcttctgaaaagtgaaattctaggaaagagtccactgtttaaagctagcagctggtggccgtgtggccgaataatgtcccaggccagggcactcccctctcagatggttggtcatgctgcgtcggagatcaggaatcctcaaggaacctttatgttatagttgtaccagtgctttaaacataatgaaaggtgcatttgttttattttacccatctataaattgtgagaggtttggctatggagagtctagtgagcttattgaacagcataagaagataagtgtgtgtgtttgtgtgtgtgtgagagtgtgtgtatgtgtgtgtgagggggagggagaagttattgtgctttccaacatataataaattgcttactttgatcactaactgttaggtaaatactgatgatttctagcataagtcttttttcttttttttggagacaggtcctccctctggcgcccaggctggagtgcagtggcccaatcagcttacttcagccttgacctccctgactcaggtgatcctcccacctcggcctcccaaagtgctgggattacaggcataagccgctgtgcccagctgatataagacatatttttaaccaactttaagatcttagttttttttcaggatggttataagcgaaggtagaattgcagaaagactttgtggtaaatattcaggattcggctctgttgccttacaatttgttaagtgcatgatggaaaaatagttgaaacaatgcaacagctgtctcagttctgaaagttaactcagaaatggcagaaagcaaggtcaggcatggtggctccgagcactttgggaggccaacgtgggaggatggttgaaactctgtctctatgaaaaatataaaaattagctgggcatgacagtgcacacgtgtagtcccagttactcaggaggctgagttgggaggatcacctgcgcccaggagtttgaggctacagtgagctatggtggcaccactgcacgccagcctgggcggcagagcaaggccttgtctcaaaaaaaaaaaaatcataaaaataaagcaatggtagaaagcagaatttgacctttcagttacagatgaggaacaaagtgaggagaggccattttttggtaaaagaaccatctggcgggacgcattggctcatgcctgtaatcccagcactttgggaggccaaggcaggaagatcacctgaggtcaggagttcgagaccagcctggccaacgtggtgaaaccccatctctactaaaaatacaaaaattagccgggtctcatggcaggcgcctgtaatcccaggtactcgggaggctgaggcaggagaatcacttgaacccgggaggcagaggttgcactgagccgagatcgcgccattgcactccagcctggaggacaagagcgagactttatctccaaaaaaaagagaaccatccaaaaattgctcagaggtcaagaatttcagaagaaaatacaaaaactttggctgaagaagatttaactagtgctatagaaggcttaagaagtgtggttctagcacttttccaactcatatttgtatcaaataccaggaaaaatagttatcaccatttatcatctagatttctgggccgttttactgttttgtcattttaagttgttttacacgtaatttacagaagtaagaataaagcaataatttaaaacaactttataagaaatttgatccaacctctttgtatcaagtaagttttgacacacaaacattagaagtgtcctcttaaggaagtggatggtccaggttcctttgaagtgtgatcattcatgtgagcgggcagctgattgagactactgtgtccccttttcgtccctcacttcctcttgattctgagaagattgatctagggtattgtcaaatgaagacttgtctgagattttattttcacgtcagttttgccatcatcattggccatgggtgctctctctctgcattcatcttgtgactcatctaatgatcccgaaaagtcgacactgtcatgtttctttgctattttgggaagaaattgaaatgttcttagtgaatcatcttgttaaagcaagctaatctgggcactgtggctcatgcctgtattgccagcattttgggatgctgaggtgggaggattgcttgagcccaggattttgaggccagctttggaacataatgaacagagaccctgtctctacaaaaaaataaaaaataagctgggcacagtggcgcatgccagtagttccagctactcaggtggctgaggcaggaggatcacttgagcccaggaggttaaggttgcagtgagctgggattgcaccactgcacgccagcctgggtgacagagcaagaccttgtctcaaaaaattaattaaatttcttttttaaagtagaattcatggccgggcgcagtgactcacacctgtaatcccagcactttgggaggccgagttgggcagatcacaaggtcaagagattgagaccatcctggtcaacatggtgaaaccccgattctactaaaaatacaaaaattagctgggcatggtggcacgcgcctgtagtcccagctactcaggaggctgaggcaggagaatggcgtgaacccgggaggcagagcttacagtgagctgagattgtgccactgcactccagcctgggtgacagagtgagacttcgtctcaaaaaagacaaaaaagaaaaaaaaaattagccgggcgtggtggcatgcgcctgtagtcccagctactcgggaggctgaggcaggagaattgtttgaacccggaggcggaggttgcagtgagccgaggtcatgccaccagcctgggcgacggagtgaaactttgtctcaaaaaaaaaaaaaaattacaggctgggcacggttactcacacctgtaatcccagcacttggggaggccgaggcgggtggatcacctgaggtcaggagttcaagaccagtctggccaacatggtgaaacccccgggaggttgagacaggagaatcacttgaacccaggaggtggaggtttcagtgagccgagttcgtgcaactgcattgcagcctggcaacagagcaagactccgtctcaaaaaaaaaaaaaaaagtagaattcattaagaagaggggcaggaacatcattagggaaattacttgcattataaaaatgtttagagctggccaggtgtggtggctcatgcctgtaatcccagcactttgggaggccaaggcgggcggatcacgaggtcaggagatcaagaccatcttggctaacatggtgaaaccctgtctctactaaaaatacaaaaattagctgggcgtggtggcgggcacccatagtcccagctactagggaggctgaggcaggggaatggcgtgaacccaggaggcggagattgcagtgagctgagattgtgccactgcactccagcctgggcgacagagcaagactccgtctcaaaaaaaaaaaaaaaaatgtttagagcttgggaattgttaatgcggaaggtgcacgttctgaacaggtggaagtgagctctacttgttaaatgaagtcagcacaggcctgcagatagaggagctgggaagggcctgaggctgcagccctagaccttgctttaaatgcttctttctggtcctccccttcttagccggaggactgtgatggagagaagagagaggacttggaacagctgcagcagaagcaagtcaatgaccatcctccagagcagtgtgggatgttcacagtcagtgaccacccaccagaacagcatgggatgttcacagtcggtgaccacccaccagaacagcgtgggatgttcacagtcagtgaccacccaccagaacagcatgggatgttcacagtcagtgaccacccaccagaacagcgtgggatgttcacaatcagtgaccaccaaccggaacagcgtgggatgttcacagtcagtgaccacacaccagaacagcgtgggatcttcacaatcagtgaccacccagcagaacagcgtgggatgttcacaaaggtattctttaagttctctgttaaggtgtattctttgtcaaaagatttctttatgttgtagaaatccaaaccagtgagaggaccttccatctctgcagggcctctctttagaagtggaaactggaagcatagagagctggaggcagaggctcaccctgtaggccccacgtgctgccgcctgcacgttcttagtgttgcctgtgaatgggaagcctctcttcatacccttctccctgagctcaaatctgcctcccttgtgatcttccttttttgtttttcccatgggacattgaagagaagccacccttcataagtttgaggaatgtcatgaattccctttattctagttgcccttgtcgattgactcacctgtctgttcagcctgtttcttaggcctggtacctcgtttctcacatcatcagtttgtgactggaagtcctgtgccagttgagagcctggcagggcagggaggctgtggtcagtctgcatgtccctggtttctgccacgttcctggtgggatgaattccatacgtgttgagttgattacctttattttattgacatgttttttgttagcatgtggaggaaaacattaagtttggaattgactacttttgaagtgttatgttaaaagcatatattttaggctgggcacggtggctcacgcctgtaatcccagcactttgggaggccgaggtgggcggatcacgaggtcaggaattttagaccagcctggccaatatggtgaaacccctctctactaaaaatacaaaattagctgggtgccactgcacttcagcctgggagacagaccgagattccatctcacaaaaaaaaaagcctctattttagccatttgattctagctagactcagttcacactgctttaggcaagtttggttgttttttggtttttggggttttttttttttttttaaatagagacggagtcttgctctattgcccaggctggtggtgcgatcttggcttactgtaacctccgcctcctgggttcaagcgattctcctgcctcagcctcccaagtagctgtgattataagcacccaccaccatgcctggctaattattgtatttttagtagagacagggtttcctcatgttggtcaggctggtgctgacctcaagtgatctgctcgtctcagcctcctgaagtgttgggattacaggcgtaagccactgcacttggccggcaaattgtttgttttttgagatggagttttgctcttgcccaggctggagtgcagtggcgcgatctcggctcactgcaacctccgcctcccaggttcaagtggttcttctgcctcagcctcccaagtagctgggattacaggagcatgccaccacgcctggctaatttttatatttttagtagagaaggggtttcatcatattggtcagactggtctcgaactcctgacctcaggtgatcctcctgccttggcctccccaagtgctgggattacaggcgtgagccactatgcaggccaagtttagtttttaatctgcattattgcaggaaagatctaactcctaggtgaggcctggaagcacagtctctggtgggttctataaaacccactcttcatttatttattgacttcttgggaccgggtctcattctgtcccctgggctggagtatggtggtgccatcacagcttagtgtagcctcaacattttgattcttaagttgttgcagctctgtccgtggggagccccttcaggtggctcctgtgtcatgtgtttgaagcacatcctggcttgtgacactgcaagttggtgccgcaggctcatcgtgtaggccctgtctccgttctgagtccgctgtttctccaaggagtcttggtgccttttactagattatggtgttgagaccaagacctgggctctaggtgtgctcactcctgctgggatgttgctgctgcttctgggctctctccgtggacagagtgaggaagggtgtgcctgggagctagtctgtgtgtacactcatagctgtatttatgttcatttgtatttatagacatatatgttaaataggaatacatactgatacctcagagcctaatccagcaccacagagttcattctgccctcccccccaggtttatttgcagtttccttctcggatagtgagaagcctggctctcacttctgccatttatttactttaaaaaaaaaaattagaaggttgttttttttgtttgtttgtttgtttgtttgtttttttgagacagtctcgctctgttgcccaggctggagtgcagtggcaggatctcggcttgctgcagcctctgcctcctgggctcaagtgattctcctgcctcagcctctctagtagctgcgattacaagtgctgccaccatgcctggctaattggggtttcaccatgttggtcaggctggtctccaactcctgacctcagatgatccacccgcctcaaccccccaaagtgctgggattacaggtgtgggccaccacgcccggccccatttatttacttatttgttcaactctcctgtaagtgtataatagtttcagaattagcaacccacatcatataagaaacaaatttaccaagtggatttaagtgtttgtttacagctcctttgtctccattttcagtttccagtcacaactgttttccaaggttactcaggtcactcctctcttccccagcccttcactaaggttgtgtcttcactggtgagtatgtagtcaggttcattggtcactggctacttcctatcctgggatcccacaacatcctggtcaattttttaaagttgcatactgttttgttttgttttttgagatggagtttcgctcttgttgcccaggctggagtgcagtggcgcgatctcggctctccgcaatctccgcttcccggattcaagcgattctcctacctcagcctcccgagttgctgggattacaggcatgcgccaccacgcctggctagttttgtatttttagtagagatggggtttcaccatgttggtcaggctgatcttgaactcccaacctcaggtgatccgcccccacctcggcctcccaaagtgctaggattacaggcatgagccaccgcgcagactgttttttttgagacagtgtcttgctctgttgtccaggctgtagtgcagcggtacaatcttggctcactacagccttgaactcctaggcttaggcagtcctcccacctcagcctcccaagtagctgggattacaggcacgttccaccacacctggctaagttttgtttttatttttttgtagagacagggtctcactgtgttgacaggactggtcttgaactcttgggctcaagtgatcctcctgcctcggcctccaaaatgctgggattacaggtgtgagccacctcgcccaccctaaaatttgcatgcttctaagttcattctttgtgatgcacaattgtgtagagtcatattcaccacccagttaccctcgagaacaaccccagcccccaagagggcccgtgtcctctttctaaccagccgctctctccttccccagcctctggcaaccagtggtctgttttttgttctatggttttgccttttccagaatgttctacagatggaattctataatatgtaggcttttgggtccaggtttttaaatcacttagcaaaatgagttgaagattcatccaagctttagattgatcagtagctcattcctttttgatgctggttagtacttcattgtgtgcatggtacacagtttgtttatccactcacctggtgagggacatctttcttctagcttttttgtgaatatgaataatgaatgtgtctttttttttttttttttgagacggagttttgctcttgcactcttgtcgcccaggctggagcggtgatctcggctcactataacctctgcctcctgggctcaagcgattctcctgcttcagcctcccgagtagctgggattacaggtgtgcaccaccatgcctggctaatttttgtatttatttatttatttattttgagacagggtctctcactcgcccagcctagagtgcagtggcccattctcagctcactgcaacctctgcctcccaggctcaaggggttctcccgcctcagcctcccgagtacctgggattacaggtgcatgccactatcacttggctaatttttgtatttctagtagagacggggtttcaccatgttggccaggctggtctcgaactcctgacctcaaatgatccacccgcctcggcctcccaaagtgctgggattacaggcgtgagccaccgcacccggcctaatttttgtatttttagtagggatagttttaccatgttggccaggctgatctcgaactcatgatctcaggtgatctgctcacctcggcctcccaaagtgctgggattactggtgtgaacaactgtgcctggcctgtttttatttcccttcttgaaagcctggctggcgtagacatatagttggcagttggtgtcttgcttgccggtggtttcgctctgcccctctctagcttgtgttcactgccgtggccaccctgaaggcttttgtctttggtgttctgcagttttgattttatgtgttctttagagggacagaactaaaaggatagatagacatataaaggggagtttattaaggagcatcgagtcacataatcacaaggtgaggtcccacagtaagccatctgcaggctgaggagcaaggaagccagtctgagtccgaaagctgaagaacttggagtctgatgtttgagggcaggaagcatccagcatgggagaaagatggaggccagagggctaaccagtctagtctagtccttccacgctcttctgcctggttttattttggccacactggcagctgattagatggtggcaacccagattgagggtggatctgcctttcccagtccattgactcaaattttaatctcctttggcaacaccctcacagacacattcagggacaatactttgtatccttcaatccaatcaagttgacaatgttaactatcacaccaggtatggctttttatgatgtctttgattctgcttgggatctagggttttcttcaatgtgtggatgatgcttttctcatctgttgcctcaaatcctaaccagtatctccatcataccttctacctgttctttctctccattaagttttagagttctcttgcataccgtatttgtccattctcatgctgctaataaaggcatacccaagactgggtaattaaggaagagaggtttaatggactcacagttccacgtggctggggaggcctcacagtcatggtggaaggcaaggaggaccaagtcacatcttaggtggatggtggaaggcaaagagagagaacttgtgcagaggaactcctctttataaaaccatcggatctagtgagacttattcactctcaggagacaagcacgggaaagacccgcccccatgattcagttacctcccactgggcccctcccatgacacgtgggaattgtgggagctacaagtcaagatgagatttgggtggggacacagcccaatcatatcacatacgtatagctcagcccacttttgtgcttgccttctttttgctcttggccgtaggctggatcgttttatctgtgttatctcccatttttctaaacctctgttcatctgtatataatctgctgttaaatacgtccagagttgttaattttgttcttgctgtttttagttctatttggattctttaaaattggttgttattctgcataattttttgtttcctagagatattttcaaacttattttaactgtacatctttttttgtgagtgaattggtctccactttggcctggtatttggaggtgcagtgagcctatccactttgttttttattgagatggagtctttctctgttgcccagactggagtgtaatggtgtgatctcggctcactgcaaccttcacctcccaggttcaagtgattctcctacctcagcctcccaagtagctgggattacaggtgcccgccaccatgctgggctaatttttgtatttttttttagtagagacggggttttgccatgttggccaggctggtctcgaactcttgagacgaagtctcactctgtagcccaggctggagtgcagtggtgccatctcagctcactgcaacctctgcctcccaggttcaagagattctcatgcctcagcctcctgagtagctggaattacagacgtgtgccaccatatccggctgatttttgtatttttagtagagatgggtttccccatgttggccaggctggtcttgagctcctgacctcaagtgatctgcccaccttggcctcccaaagtgagggggttacaggcatgagtcaccgcgcctggccagcccatccactttgaatggaatgtgttgctcgggttgatttggatcactattattttgggtctgccgtgggtgccacttctcaggatctttttttggttccttgaatgttttctgttttccatatgtccgttattccgcttggagtagcacattgtctggtcttttttagtgaggtgtttgtgttacttttgtgagaagtctgtgttatggctcgtgggagtcccttcaagttcagtgccacattttcatctgatcagtcttccaaaaatatccctttccctagacacgttttaatataatttttattttttattttattttttctcacgtctagtaaggcagggaatatttttaaatttttttgtagagatgggatctcactatattgaccagggtaggctctaactgctggtctcaagccattctcctgcctcggcctcccaaagtgctgggattataggtatgagcctccacacctggcctcctggacgtgttttgttttgttttttaattttgagacggggtcttaccctgttgcccatgctgcagtaagtggcacaatcgtagcttactgcactctccacccctgggctcaagcagtctttctactcagcctcctgagtagctgggaacacaggcatgcaccaccatgcctggcaaatttttaaatattttgtagagatggagtcttgttacattcactaggctggtctcaaacttctggcctcaagtgatgctcctgctttacatgctttttacttatttttttttttttgagatggagtcccgctctgttgcccagcctcgagtgtggtgatgcaaattcggctcattgcaacctctgcctcccaggttcaagtgattctcatgcctcagcctcctgaggagctgggattataggcatgcaccgccatgcctgactaattttttatttttagtagagatggggttttgccatgttggccaggctggagtgcaatggtgcaatcttggctcactgcaacctctgcctcctaggcttaagtgattctcctgcctcagcctcctaagtagctgggattacaggcgtgcacaactgcggccagctaatttttgtatttttagtagagacagggtttcaccatgtcgcccaggctggtcttgaactcctgacctcaggtgatctgcccccctcgccctcccaaagtgctgtgattacaggcgtgagccactgtgcctggtctccatactgtatttttatagtgattgtactagtttacgttcccaccagcagtgcaaaggttttctgttttcactgcatccataccaacctggatgtgttttttatctgtttgtgtcatcaattctttcttttttttttttcttttttttttgagacggagttttgctcttgttgcccaggctggaatgcaatggcatgatctcggctcactgcaacctccgcctcccgggttcaagtgattcttctacctcagcttccagagtagttgggaatacaggcatgtgccaccacgcccagctaatttttgtatttttagtagagacggagtttcagcagatggtctcaatctcttgacctcgtgatccgcctgcctcggcctcccaaagtgctgggattgcaggtgtgagccaccgtgcgcagccagcgatttctttcagcagtgttttgtggtttcccttgtagagatttttcgcctccttggttaggaatattcctaagtattttattttattttttgcagccatcgtaaaaggtgttgagttcttcatttggttctcagcttggtcacttttggggtatagcagtgctactgatttgtgtatgttgatttcgtgtcctgaaactttactgaattcatcgatcagatgtaggagctttctggatgagtctccagggttttgtaggtaaacgatcctgtcatcagcagacagggactgtttttcctctttactgatttggatgccctctatttcttctcttgtctgattgctctggctaggactccagagcagtggtgaaagtgagcatccttgtctttttccagttctaaaatgccttcaacttctcccttttcagtataatgttggctgtgggtttgtcatgaatggcttttattgtcccttctatgccgattttgctgagggttttaatcgtaaagggatcctggattttgtcaaatgcttcttctgcatctattgagatgatcatatgatttttctttttaatgctgtttatggggtatatcacatttgttaacttgtgtgtgttgaaccttcatccctggtatgaaacccaagtgtattatcttttttatgtgctgttggattccgttagctagtattttgttgaagatttttgcatctatgttcatcagggatattggtctgtagttttctttttttgttatgtcctttcctggttttggtattagggtgatactgacttcatagaatgatttaggaaggattctttctttctctatcttttggaatagtttcagtaggattagtaccaattcttctttgaatgtctgatagaattcagctgtgaatccctctggtcctggacaatttttgttggcaatttttaaattactgtttcagtcttgctgcttgttactggtctgttcagaatttctgtttcttcctggtctaatctcgaagggatgtatatttccaggaatttatccatcgcctccaggttttctagtttgtgcacataaaggtgttcatagtggccttgagtgatctttggtatttctgtggtattggttgtaatgtctcccatttagtttccaattgagcttatttggatcttctctcttcctttcctggttaatctcactaatgatctatcagttttgtttatcttttcttttcttttctttttttttttttgagatggagtatcgctctgtcacccaggctggagtgcagtggcgcgatctctgttcactgcaagctctgccgggtctgcctcccgggttcatgccattctcctgcctcagcctcccgagtagctgggactacaggcgcctgccaccacgcccagctaatttttttgtatttttggtagagagagggtttcaccatgttggccaggatgttctcaatctcctgacctcatgatccacctgcctcagcctcccaaagtgctgggattccaggtgtgaaccaccgcgcccggcccgagctcctgacattgaagggagatgttgctgcactcatgtggccgcccaccctggggacgagtccccgcacaggcagcccttgtggagcccaccatgccgcccttccctgtccagttcctccgggggcctttctagcttttgcaactgtatcaagcctgtatctctccatccctagccagttccccagttggggcagaaaaatttagtttgggtcattttttaatcggaagtactctgtgagcaagtgggtcacctggagcccagaaaggtgcctggctgatgcaggggaagccagagaatggtcgcttccacaggcaggggatacgtcccaggcgccagtcgaggggcaggagcctgcagggagggccacagtgacggtgggctcaggatccgtgccgacgggccccctgcagcttttcttttccctttgggttattgctgctgaaaaggtttccagaggtgggaatgttgagacagggaaaggctttctgtggctcgacctgtgttgccaaaatggctgctgagaaaaaagttgaagcaactgattctgatgttggtagcatttgggtgcatttgtttcttgtgactgtggtggcactgaggattcgtaatattcttcccaacttttgctgatttagtggccatacaaggatctttaaagtttgtgtctctagattggtttacctttcatcggtacccactttttccaggcattttatgcacattttctctctgtaggcgtcatttccgcctttttcctgagagcaggttgtttgttcctcccgtggcagcactgctgtggcgtggggagagtccacagcttctgtttctgggactttattttgtttatttatttttttgaggtggagtctcgctctgttgcccaggatggagtgcagtggtgtgatctcagctcactgcaacctctgccttccaggttcaagtgatcctcctgcctcagcctcccaagtagctgggactacaggtgcccgccaccacgcctggctaatttttgtatttttagtagagatggggtttcaccatgttggccaggctggtctcgaactcctgacctcaggtaatctgcctgcctcggcctcccaaattctgggattataggcgtgagccaccatgcctggcctgtttctgggactttgactttacattgtgatttaagcgagtttaatatttttccttcttctttttttaatgagatacaattaacaagcatacgattcaccattttaaagtacagacctcagtggcacttagtacactcacagcatgtgtgagcaccatctccagtggctccagacatcatcatcaccccagaaggaagcccggtgctcgcggcagccaccccgctctcctccctcagctcctcgcagcctccaggctgctccatgtctacggatttgcagatcctgaacacttgatgtaaacggaacctcaccatacgtggccttctgtgtctgctctgtcactcagcctcacgtcttcagggctcctctgtgttgcagcctgagttggggcttcgttccttcttgtggctgaatggcagcccacgtttgttcaaccattcatccctcaggaggcatttgggttgctcccaccttctggccgttgcgagtggtgctgctgtgaacagctgcgaacggggttttgtgaggacgtgcgtcgtcagttcttgagcacatcactgtggcttctcatgtgaattctggacctacattctttgccttttttccccaggagtgtgaacaagaatgtgaacttgccattactgacctggagagcggccgtgaagatgaggctggcctgcatcagagtcaggtgacccggcggggcctgcacaggctcacagcatgggctctgttatccccacagggcacagtgggcatccgggtgggggtggggtgggcgctgccatctcctttctctgagttgtctgtttccacgttctgtgtgtggggccatcagcagggccggtggaggagacacacgtggatgctgggggtcagggggcttggtcaggtgcaggccacatgaatgacacactgacctcaggccggttgctctccctgtcagctgcgaagccccctccaggtacacacagtgccgtcatacagcgagggaattcggggtgctggtgctcagggcagtgatgcgctgtggggtcactggcagaggagctgggtggcatctcagtggcatccgggcctctgtgtcctgcccctgcttccacgggatgtctgctgtttcattttctgtgtcttccttactcattctcattcatgcttctgtgtctccctgatgcgccctggttctgaccatgggcccttatcagaggccttttctccgccgcaggccgtgcatggccttgagctggaggcgctgcgcctgagtctgagcaacatgcacacggcgcagctggagctgacacaggccaacctccagaaggagaaggagacggcattgacggagctgcgggagatgctcaacagccggcgtgcccaggagctggccctgctacagagcaggcagcagcacgagctggagctcctcagggagcagcacgcacgggagaaggaggaggtggtgctcaggtgtggacaggaagcaggtactgcatggctaggcgggcacgggcagcgtgtgggctcggtgtgggcattctagtgcctgttccctcttggggttgggagctggggcgccctagcaccgtctccccatctctgttctcagcaccttgcctggtgtctggcaccatgagaggggtgaacaaagggggcccttgggtttttgtggccaggagattattagagcaggtttccaggtggtctgtgataggtgcgacccagggctgaccttcacctcctctcttagatcgtcctgtgtgtctggaagtcacggtgtcctcagtttgttattaaagccaagcatcatcacagacacatcctgctagcccgtgaatgctggcacgtgtccagtgggtgccagagcctggtcgtttcctgggcagttgggtcactgaaaaggttgagatggagtggcctgagctgctttttgtttttcttgcagctgagctgaaggagaagttacaatcagaaatggagaaaaacgcccagatagtaaaggtacccgggatcgattctaaaatgcacgcctctgtgtatgttgtttttcctttctcgccaggtcccatgagaacgctcctcaccttgattcagacagaagccagtcgaggctttattagaatatgctggttgaaagtgtattgcgttctttgtttatttatatcatttgtatttgtcagaaaacttgttttgttgtttcacattgacttgcataacacaaaggcactgctcggcccctccatgctgtcttctgagtggcccccatggcctgcccctgagctgtgttctgggacacagcctctgccctcgtggatgtggcagttccctgcagtgcatggggtgtgggtgctggggtgccggggagaataccacacagggaggaggttttgggtggggtgggttgcacctgctgtgggtggcctcactggggaccacaggtagcagtgccccgtcattgccaggccctccgctagagggctgagctgtcagccatgctgagtgtggaggcccttcctgagtcaggcatctgggcagctctcaggcccttggcagacgatgggtgttagtccaggcttggggttgtgttccggtcacctgctcctctgacgcaggcagtgagacccatttctcagaacacttgggacagagcccagcccttgggtggaggttggcaaagttgccattggcccctgggacttatagggagatgtattactaacgctttgagggtgactgtgtggattaggccttgcgtgcagaggctcgtctgtttcggggtgggtggtccttgtgcagaggctggtctgtttcagggtaggtggtcctctcgctttgtgcagatgcaggtctgttttggggtggatggtccctgtgcagaggctggtctgtttcagggtgggttgtccctgtgcagaggctggtctgtttcagggtgggtggtcctcgtgtgcagatggcagtctgttttgtggtgggtggtccttgctcacttttcctcaactgcttgcctcctggatgcttctgcttttctgtcctgccagcattcaggggagagactgggtgtaaggcctgtcaggacagtttagttgggggccatgactgcccattcttttttttctttgagacagggtctcattctgcctcccaggctggagtgcagtggcacaatcacagctcactgcagtcttgacctcctgggctcaattgatcctcctgcctcagcctcccgagtagctgggactatagttgcatgccaccacatcccactaatttttgtatttttttttttgtagagatggggtctcactatgttgcccgggctggtctgtaaccctaactcctgggctcaggcgatctgcctgcctcagcctctcaaagtgctgggattagaggcatgagccacgttgcctggcctgctcagaggttttgactgtgtgatttaaatttctttagcacagataatcaactattgagtttaatttttttttcttttaaattagaccctgaaggaagattgggaatctgaaaaagatttatgtttagaaaatctacgcaaagaactgtctgcaaagcatcaatcagaaatggaggatttacaaaaccagtttcagaaagaattggcagaacagagagctgagttggagaagatttttcaagacaaaaaccaggctgaacgtaagtaatgaaaatgagcaagtttggagtgggactgaattttcctaggtagtactggaaggaatgtcgttcatgtcaccatgcgtcattgcgcacgtttcctaccttctaaatgctggatggccccatgcacgtgtgacacgctggtggccgtcatgggtcacaggtctctcagggtccttaaaccttcctgatctttgtttcagagatttttcttggcatgttcagttgctaaattattacaaagcagcagctttgtggttgttcacttttcatactccagggttgtgtgttccagcttgaccctcatggtgggtggcatgggtaggcgatgtcccctggtgctatcaggcatgtgaggctcaaacgaggggcccgggggcgcccaggatggggctctgggtggcagcgctctgggtgcaccattattgtcactgaggtcgctgttgaggagagtgatgtcttgtaaaccaagtgccattgctttacctttctaggggcccttaggaacctggagagtcatcatcaagcagccattgagaagttacgtgaagacctgcagtccgagcacggccggtgtttagaagacttggagttcaagttcaaagagagcgagaaagaaaaacagctggaggtgggcagcagcttcgttatttaattacttggtatattagggaagttttaacagattttggaattgggctatttcgtattgtgttatttgctaaaacttaagttctaaatttaaagagactggctgggaacagtggttcacgcctgtaactctatcactttgggaggccaaggtgggcagatcatgagctcaggagtttgagacaaaaattagccaggcatggtggtgggcatctgtaatcccagctactcgggaggctgaggcacgagaatcgcttgaacctaggaggtggaggttgcagtgagctgagatctcaccactgcactccatcctgggcaacagcgagcctccgtctcaaaagcaaataaataaaataaaatgaaataaaaaaataaatagagtgttagtggtgaataaaagtgtaaggatatagtctctgagactgatttaataattacgttcaatcttgtacttaggaatgcatgttctttgcaggcgtccctgagacagttacacaaatcgcagacactaggtaggagtgtaaggccacatcctctaaccgtgatccagtacacacgagattcctaggaaaagttaacaagcatttctttctgctgtgtgtattcaagatgcttctctaatgaagcactacaatcaaaatgttgatgtggccaggtcctcattggaggcctgacaaacctgagactcaaactgagtatcccaagaatcagttgaagaaattaaagcataaatcagagatagggttaatcgtggtgtgtgaaagatttacaaacatgagaatatggaagtagttggggtctagggtcttagggaggcctgtcctgggccccttgtgtctcccagcgggactctggtgcccacacaccctcctctcctgcagagagtccaggccggggctcactccacacccccagtctctccctggtcccttccaggctctccctccgagatgggaaagagggggctggtagcatcttctggtcctgatgcccatgattgggaaaggtaggaggagccgtttccatgaggaggacaggccagccccaggtgcagcgttgcccaggaggaaatcacgccatgctgcgctgggctgggctcttgctgattgtacagaaaagtttagtgtcacggtgtaagaggtacctgcttccttaatgtagaagtattgaaactgagagacctcctatttgggagtcttgggtactgtgggctagtaagactccctaaattccattcagcagtctgtatgtatgaccctaaaccgaagcagggaggtgcacaagatgaaactgcaccgctgcggccggcatggaacctggccgtgccacctcctcagctgagacagacctggaagttcctgagattctgaaagtgcctggccttgtggggtcagcgctgaccgatccctcttgtcacggacagagctctctcggtctctgctgtggctggctttctccgagctgcaggtttgggatgtgagcttttacccttaggatcgcagtggcagggataaaaccgcacacgtcactgctggggtgggggccttgagctcattagggtttcacctggacactttgctttttccagttagagaatcttcaagcatcatatgaagacctgaaggcacaatcacaagaagagatcaggcgcttgtggtcccagcttgattctgccaggaccagtagacaggaattgagtggtgaggaattgtattggaaaattcagatcctcaaaagctgaagctgtgtgtttttcattgttgtaacaccaagccagaatttaacaattctagcaaacacaaaaaagtggatttacctgtttgacatcctgaaggttgaggtgtctggtttgaaagtggaggtttgctttgtgggagagagccctggttttatgctaagcaagtcagtgcagcagtgacgtgcacctgtgtgtccctcaaggccaagagcaacacttgcagggggtgccttcatgtctaaggaaagcttaccagtggtgctgagcgtttgcctcggaaggacggttgagtgctgtccaagtgcgggctcacctggtgtctggggtcacagggcagtgccccacatcctgctgccaggctcctgtggccccagctctccaggccacttgctgaaggcagctctgctccaggtgtccccttatagctgagcacctctggagaccccgaccccaggccccccattccgtgtcagagaggtctttgtgcagcaggcttggatggtgcctgagggcaggggctggccaagcccaattcaggcaccggcgcccaggtccacaggacaggagggtgagccactgcgtgtctcctggcattcatgtgccgacagagccttttggcccaacttgtccttgtgggtggtgggatttgaagcaaagagcacttaggagaaagaactggagacactgccactgtcaccagggcaccaggcctggctccgcctcccagccctgcgccctgccgggaccaggtgcagctgagagcatgtcgatttatcttcctctgggggtctgtctgtcgctggaggctggagaagagagaagctgagggggccacaggcacagctgctccccgcgggctccggctctggcttggtcctctgcttgtctctgtcctgcctctcgggacccatgcagagaaccccgatttgccctctctggggtgcccgttgctggctgtcagctgctgtagagcagcgggctgtattctgaccatagtagccatggagacaagttcttttagggtccgtgttgcttctctgctgctgtgtaacaaattatcacaaacttggtggcctaaaacaacacagttgtcagcttacagaaagtccaagatggtacagctgggttttctgtccagggtcccccatagcccacatccaggtgtcagctgtcgtgtgccaacctgatgagcctgcttctgggctcgaggttggtctggatccagtttcctggggctgcaggaccatcgtctgtctccttgctggctgtgccccccacatccctgccacttcgagtgctgcttttgctcccagccctgtggctcttgccaccgcttggagagagctctccacattcaggggcgtacgagagtctaagccgtaggggtccctcatccctctccggttctgggatgggcccttttccgagttctgcccccaccacaggtaaccaggctcttgcctctcgcctggcttgttgtgggtgtcccattttaagacgattgcctgactccgttatgttgcagagctacatgagcaactcctggcgcgcacctctcgtgtggaagatttagaacagctgaagcagcgagaaaaaacccagcatgagtccgaactggagcaactgaggatttattttgaaaagaagttaagggatgctgagaaaacttaccaagaagacctaaccctgttacagcagaggctgcagggggcgagggaagatgctcttctggactctgtggaagttgggtaagcaaagcagttccagcctcagtgagtttctgccatacaggggccaggctctgagttcaggggtagttttgttggtgatttcatgctagtaggcaccaatggccttttatacaaacacattttatggtccagatttaaaagatgacacaggcacgggcacccgagagtggcctgcatgtgtgtgtgcgagccattggtggccacactctgtccaggcctgcgtgcacatgttggtggtggacacgctcgtgtaggccagcatgtgtgtgtgtgtgcatgagtcagtgggcacgctcttgtccaggcctgcgtgtgtgtgtgttggtggcaggggcgctctcctccaggcatgtgtgtgtgttggtggcaggggcactctcctccaggtgtgtgtgtgtgtgtgtgtgtgtgtgtgtgtgtgtgagagagacagagagagagtcagtggcgggcacactttcttccagacctgcatgtccctgtgccgtgtctctggctttgtgactgccacggctccccgcacatggacattgcccgtccttgactggaagcacgaggaggcgcctctgctgtgagcagtcggtcctggggagggaatggcgcacacatggaaaaggggtacgtgtgtaaagcttttataaaatgttttcccttcaggttgtcctgtgtgggtttagaagagaaacctgagaaaggaagaaaagatcacgttgatgaactcgagcctgagcgacataaggtaattggccgcgcgctgagaagtgggggagtcctgtgctcttgaccttccagccctgcgtcttccacattatagagcctgtgtttccgtccttcccaccttgtccaggggaggaaggctgcttgcggatgctgccccgacctcactgctgctccgcggtgggcctcaccatgcactgtttgatcaggaaagggggtggccgggggagccggagcccctccctcagccctgggatgccctggctgtgggcaaggcctccaccctgcagtggggctgcattcgtcagacttgacagtggcagttcaaagggtgtgaaattgtgtctttgctttgagtccacacggagcgtctgctggcttttgtgtttcttccttgagttgcttccgtgctgcgacttctgtcacctttaacttctgtggggcaaactgtccaaacggagcttctgggatgtagactgttctgggtctgtgctgccagtgtggtgcccagcagtatgtgtggctgtggagcacttgatgtgcagcatgagcaagcccggtgtcgggctccgggggacacacgggagggcagggaggagacgcaggggcagcaccgcgtggcttgttgcacggtggaaccagtggaggggaactcggggcatctgggctcagcggccaggagccctcactctggagcagggtccctgggcctgctggaggccacagggtgtccaggcagggtggcagcgggctgtgtgccagtttgagttccctgcaaagcggaccccaacacagaatttgctgcacaagaggctatgggggaaatgccagagaagggcaagggcccggctggaacaggcagccaggaccttcccacgagcaggccttgcaccagagagaacccaggaagggctggggtgggtagccccaccaggcattcgtgtatcacctgagagccaacccctgcctctgcgcgtgggtgtgacgaggacccagctgttagtgggcagtggtcacaggaggctggccttgagagcccagccctgagatgtgaggccaccaggggagacgcgaggggcacgtgccctaccgaccttgctgctgagagaattgaggagaggtctgcccggtccagggccctgccgccctgaggagcaccagtccctgtcagtgccaccaattcttgtatgtcttccggaggcctgactgagagacgggtgtgggcgggagagcatgtgagcacgccagtgggctggcggggttcaccagggcgcagcgtgtggtctcatgaacctagtgaggtttgagttttctttgtgcatagcaggaaacacctttgagggttatagctgcgagcgaggtagcttggctcactaacgtgcttgtcccacgtggtttctctgtaggagagcctgccacgcttccaggcggagttagaagaaagccacaggcaccagctggaagcgctggagtctcccctctgcatccagcacgaggggcatgtctcagacagatgctgcgtagagacttcagcattgggacacgagtggcgtctggaaccctctgaagggcacagccaaggtgggcccctcccgcctcgccatggtgtcggcaggtcccgggtctgggggacgttctcggggagcctgggtgcctgggttcgatccaagtcctccgtgaagcagctgagtgctccgacctcttcttctggggctgacacctcaacagagtgtgtcctgatgagggtttggcgttagaggcggggtcactggctgggcaggagtgcgtgtcctgggccagcgccccagcagggcaggtctgacctgggcagccaccctgggggtcatggggattgctggatggacatggtgaccattcacctctggagggagaatgtgtgtccactgggcccaggggaggcttttccaggatcctgctctgctcccagcaggcccaggtaccccagctcgcctagtcagactaaggttgtgggatgtccaggcagggcacggggcacagggctgtggggtcagaaggtgacggagaggaaactgcagtcatcccagagtcgcggtcccatggcgccggacagtggccactgacgggttccaggaggggcaggcggccctggccactggcgtggactgtgctgatggtggggctgccgtccatggtgggggtgaggggctgaggccgcgggtcctgctgggaggtgtgtggtctgactccattctgggctgtggccaagttgagagaagcctgggcctgcctgggcctccttcaagctgggggtggtgcagcggcgcctgcatctggtcctcactcctgcctgccctgcaccacaattgtccccacagccaccccttgatgcccatggtcgttggcaccactggtgcctggccagcacctagtcccttctgcttttttcctcttctgcagaagaagagatgggccagtgggggtagcgtgcctgggcacagaacagcagggggaggtgctgggacaggaaccctggcaggcccctgagctcaggccctgtccttgtggctgcctcatagaccctgggtgacacatgtgtgcccacatctggtcacaggcatgaggctcactcaggaactcatggagggtcacatgtcacacctgacctgaaggagtagcctgggcgggtcgtgtggctgtcgtgtgggcccaggacatccctgtgactcgggacggcactgtgctggggcagcatggaggtgtcccgaaagggaggggagacttgagagagccatgcctgctttcatcactgagtcagcacagagcttgaaaatccacagtgtctgctgtcagaagcatttataggttgccgttctgcctgtgcggactgtgggctccatcgagggccggcaccggcctgactgtcttccctgctccttttccacacagagcttccctgggtgcatctccagggtgtgcaggacggggacttggaggccgacacagagcgggcagccagagtcttgggtctggaaactgagcacaaggtgcaactttcgcttcttcagactgagctcaaagaagaaattgaactcctaaaaatagaaaatagaaatttgtatgggaagttgcagcatgaaactcgtctgaaggacgatttggagaaggtgagtcgtgactccacagcccagcgcctcccgcccgagtccttgctctcttccacctggaaggcttgtgtccttgtgtatggaggggcatcctggggacagcccagtgctgtacatggcacatttgtaagggcgacagtcccgtaaattcttgaaactattcctggcaatgccagtagtgggtggcggttggatagaatcttgtcagggtcagcaccggggcgaaagtgaagttctgagtgaagatttctttttgttttgttttgttttgagacagtctcattctgttgcccaggctggagtgcagtggcatggtctcagctcactgcaacctctgcttcctgatttcaagtggtcccctgatagctgggattacaaacgtatgccaccatgcctggctaatttttgtattttttttgtagagacagggtttcaccttgttggccaggcaggtgtcaaacgcctgacctcaagtgatctgcctgccttggcctcctacagtgctgggattacaggtgtgagccaccacgcccggccctctgagtcaagatttcttagggaaactgtccaggtgtcctaagagggctctgggaggaggcacaagcccgggtgccaagcacgtggctggcctctgatgctcaccccaagtcttaaattgcgtccgcgttccccaggctcttcctgtgctgttttgcacctgtggaagaggcaccctctgactccctcgccctttgcgagtgtgaggacactgccatgctgtcataaatgatgacaaagcaacacgacagcagcctccacatggcccgatgggcttggttacagccagggcagctcagggtccatcccatgctggagcagtggatttcaagtgagccgacagggcagctcagggtccgtcccatgccggagcagtggagttaaagtgaaccaacagggcagctcaggctccgtcccatgcgggagcagtggagttcaagtgaaccgacggggcagctcagggtccatcccgtgccagagcagtggagttaaagtgactgaaattgtcatgtcttgtcatgtgtgttctgactcaacctcatgcttgtgacagtgttttcatttctatttgtgtcctgcttctcccacccctttgctcctccctgtgaatgtctccctgagaatgattttcattctccatcaagagacagcttcataggaagctatgatgacctgcaagtctgatcccatgctgtttgttaaatgcaggtgttggtaaggacttccagcaaaatagaggtaagggtggagccctgtggggagccggacaggcggtaggtgggccgatggtcatgtgccaatggcacctgcagccaccagtgtgtggccttctctggcactgttggctgaagacagacttcccaagtgactttttgttgttgttgttgttttgttgttttgttttttttttttttgagactgagtcttgctctgtcgcccaggctggagcgtagtggcgcgatctcagctcactgcaaccttcacctcctggcttcaagtgattctcttgcctcagcctccctagtagctggaattacaggtgcacaccaccatgcctggctaattttttttatttttttttattttttttgagatggagtctcgctctgtcacccaggctggagcgcggtggcgcaatctcagctcactgcaagctctgcctcctgggttcatgccattctcctgcctcagcctcccgagtagctgggaagacaggtgcccgtcaccatgcctggctaattttttttttttttgtatctttagtagagacgaggtttcaccgtgttagccaggatggtctcgatctcctgacctcgtgatccacccgcctcagcctcccaaagtgttgggattacaggtgtgagccaccgcacccaaccatgcccagctaatttttgtatttttagtagagacagggtttcaccatgttggccaggctggtctcaaactcctgatctcaagtgatctgcccgccttggcctcccaaagtgttgggactacaggcgtgagccaccgaacctggctccaggtgactttttgatgctcatgtctttatgcttttcacaggccaccattttacctccttatatcaattatggggagaggactgtggatttctctcttgttaattttaattcttgttttgagtatgtggaagctctgttgttacacgtgtacacatttgtgattgtaatgtcttcctaaaaattcacccttttctgtcttgtagtattctgtccaaaaatacacctgttttttttttgttttttttttttttttgagacagtgtctcactctatcgccagggtggagtgtagaggcgtgatcttggctcactgtaccctccgcctcctggtttcaagcgattctgctgcctcagcctcccgagtagctgggactacaggcacgtgccaccacacccggctaatttttgtatttttaatagagacggggtttcattatgttggccgggctggtctcgaactcctgacctcatgatctgcctgcctcagcctcccaaatttttgggtttacaggcgtgagccaccgtacccagcctcgtcttttatcaatacagtcattccaaccttcgtgtgcattttgtctggtgtatctttttttattcgttttacctttttttttttctttttttttgagacaggctattgcccaggctggagtgcagtggcacagtcttggctcactgcaacctcttcctcccaggctcaagggatcctcctacctcagcctcccaagtaactgggagtacaggtgcacactaccgtgctgagctaatttttgtattttttgtagagatgaggtttcgccatgttgtccaggctggtctcaagctcttgggctcaagtgatccacccgcctcggcctcccaaagtgctgggattacagatgtgagccactgcacctggcctacttttaatctattcaaagtaaagtgcattttatgtggacagcatatagttggcaattttttttttttttttttttttttttaaagacggaatctcactctgttgcccaggctggagtgcagtggcacgatctcggctcactgcaacctctgcctcccgggttcatgccattctcctggctcagcctctccgagtagctgggactacaggcgcccgccaccacgcctggctagttttttttttacatttttagtagagatgaggtttcaccgtgttaggatgttctcgatctcctgacctcgtgatccgcctgcctcggactcccaaagtgctgggattacaggtgtgagccactgcgccggcttttttttttttttctgagacggaatattgctctgtcgcccaggctggagtgcagtggtgcgatatccgcccactgcaagctccgcctcccaggttcacgccattctcctgcctcagcctcccgagtagctgggactacaggcgtccgccaccacacccagctaattttttatatttttagtagagacggggtttcaccatgttagccaggatggtctcaatctcctgacttcccgatccgcccacctcggcctcccaaagtgctgggattacaggcgtgagccaccacgcctggccatagttggcaatttttaatccattctgataatctctgcctttcagttgcagtgctgagtctataaatgtttaaggtaattactggtgtggttgatttaggtcttccgtttcactgttcattttctgtgagatgcgtctggtggtcatggttctgctttttcttttttcttgtgtttttggattatttgaatattttctagaactgattttaatgtatctgttgactattaagttattcctctttgcattatgtttttaatagttgctccagggattaaaatacacattcttggcccggcacggtggctcaggccagtaatcccagcactttgggaggcgggtggatcacccaaggtcaggagtttgagaccagcctggccaacatggggaaaccctgtctttactaaaaaataaaataaaaaaattaggcgagtatggtggtgcatgcctataatcccagctactcgggggcctgaggcaggagaatcgcttgaaaccaggaagcagaggttgcagtgagccacaatcacgccactgcattccagcctgagcggcagagcgagactccgtctcaaagaaaagagaaaaaaaagaatacacattcttaaccttgtcttttatcagtacagtctactaagagtcaccatgatgctgcgttgtgtaaactgtgacctctaactgcacaggtgcttttgtcacctccccttcgtcttctgtgctgcagttttcatagactagacatcacatccgcctcctgcagtgtcaggagatttgctttggaaaacatgtgtttgaaagaaattaagaggaaaaatggccttatacttgccatttctggtgctcttcatttcttcttgaagatctgagtgtttggcgtcattcccttcagcgtgaaggatctccttcagcatctcttgctgtgctgcacacattttctccgttttttgaagtctttattttaccttgattcttgaggagtatttttgtggcattaaaaagtctaaggtgacaggtttcttgttcaggatttaaagatgtttaaaatccttctctgcagattttatgatctgttttgtcttggtgttggtttccattgattgtgttttctcttcagcaggggtcacgttttcctgcttatttatgggtcagctgggttcaggttgcatcctggacactgtgagtgatagatttggagactttgggttctgtcctgctcctctggagagtgttggttttctgttgcagcaggcagttcactcgggtgacttcagactgcatgctcccctgcgtctgtgctgggctgcggcatggtgttaattcagttcttgtagctttagccggcttgcttgcttttggagtctgcccctcgtatgtacagatcggggtcagcctgagacgtgggcgggttccttcccaggcgttgcagctctctttcctccctcactctccagttcctctggctcagtgagggatttgggatttctgtgtgtggggcatggacagatactactcttagtgaaaagctggaaaaagagaatggctcagtgctgtttcttccttctgaatgtccagccctctgcagggtctgtctgcttgtggatctctccacagccttcaggtttttttgtacgttctgttcagttcatagtggttgtctctggagggctggtctggcgaggtgcacaggcatcaccagaagtagcaccctaaactttaataacttaatttttaaataaggagttgaggtcaatcttacgtgcctttttttgggttttttgtttgtttctttttgatgagttcagtagtttattgacctacttttttctctttgaaagtcaggaagtcaggcatggtggctcacacctgtaacaatcccagcactttgggaggctgaggctggcggattgcttgagctcaggagttcaagatcagcctgggcaacatgcagaaccctgtctctataaaggattgcttgagcccaggagttcgaggctgcagtgagctgtgattgtgcccctgcactccagcctgggcgacagaccctgtctcaaaaaaaaaaaaaagattaggatatttgccctctgcattctccttcatccccctctgcacaggatccctttacagtgtgccttgcagttcatccaccccttgctcaaggtctttcattgtcctggcgttgaccttgtacagatcgggagcatcgcaccattggctgctcttgcctcctgggcatccgatcatgcttgctgcagtggcccagcgctatctgtggggctggcgttcccctaacagaggcctgcggccgatctgagtcctgccactggtcttggtctgaacaaagaagcctccggctgctgcctttgctcggctgatgtgtgctgccttcggttgttggttgctgtcaaggccacgggctccagagataaagaacagtcggttctcggtgccaggacgtaggaggcattttatttagttttagacttgtccactttaggtttcttccattgtcatcaacatgagaatcattcctgttgctgtgtgcagcgtaatgggtgtgtgtgtggtgaaaattccctgtcttcagaggtgggtttgggttgtctcttctaataatctcttccattagcgtctttcctcctaaatgaaattatgttgtctgtaggtaaaacacaatctaattgaagaccaccagaaggaactaaataatgctaagcaaaagactgagctgatgaaacaggaattccaaagaaaagaaacggactggaaagttatgaaggaggagctacagcgggaagctgaggagaagttaacattgatgctacttgaactgagagaaaaggctgaatccgagaaacagaccatcataaacaagtttgagcttcgagaagctgaaatgaggcagcttcaggaccaacaggcagcccagatcctggatctggagaggtccttgacggagcagcagggccgcctgcagcagctggaacaggacctcacttcagacgacgccctgcattgcagccagtgtgggcgggagccgcccacagcccaggacggggagcttgctgcgctccacgtgaaggaagactgcgccctgcagctgatgctggcccggagcaggtgggtttgcagtgacgccatctgcagtccctgtgaggccagacaccttggagggtagaaggtgggcaggctcctgggaggaggcgctgtgggctccactgggcgaaaaggtctggagggagctggaacaaggtgtggcgctctaggttttcagcctaattgcagtgggacagctttgtgctcggacgggcaggctggcagttgccatcctgaagccccctggccgcagtgggacagctttgtgctcggacaggcaggctagcagtcgccgtcccggagccccctggccgcagtgggacagctttgtgctcggacgggcaggctggcagttgctgtcccgaagcccccaggctgcaatggggacagctttgtgcttggatgggcaggctggcagccgccaccccgaagccccccggccacagtgggacagctttgtgtttggacgggcaggctggcagctgccgccccaaagccccccaagtctgcactccctgggtgggtgtcaggggcggggatcagtcattgtctctgttgttcttcgtgtgttttaagatttgaacagcagaagctaaacctcttttataggtgtcataaggacatggagtttatccactaagcgtttttgtgttttttttaacttaaacaggtgatttttaaaaataagcatgtttttctgaaacatacacactcttctttgaagttttcaagaggtttagaaagtgattgggttctttgcctgttggtgctgaccctttttgcgagcctcagtcccagggctgtgccgttctttctcatctgtctgccccacccagcccttccccagcaaccagggccgcacagggccccgctcagggattggagaaactcacgttcaggtcgctggggctgcatgaacacgagcaggacgctcttctcaccaggctacgacatgcagttcgtggtagagctgaaccaaggaggccctcaagagaggcttccaggcgcagaggtgcctgtgcctcttgccatccgtcctgtgtcgccagtgcccattggaggccttggcattttgcaggaccctccagctccaggctctttggcctcctgatgggagcaggtccttctgtgaggactctccctgcctctgtctttggccctgagtgccgcctgcacctccttaattcactgccacggggttctattcacttccatggggttctattcattcactgccatgggggttctattcattcactgccatggggttctcctcactgccgtggggttctattcactgctgtggggttctgttcactgccgtggggttctattcattcactcccatggagttctgttcactcccatagggttctattcactgccatggggttctattcactgccatggggttctattcactgccatggggttctattcactgccgtggggttctgatcactgccgtggggttctgttcactgccgtggggttctgatcactgccgtggggttctattcactgccgtggggttctgttcactgccgtggggttctgttcactgccgtggggttctgatcactgccgtggggttctgatcactgccatggggttctattcactgccgtggggttctgatcactgccgtggggttctgttcactcccatggggttctgatcactgccatggccttctattcactgccgtggggttctgatcactgccatggggttctattcactgccatgggggttctattcattcactgccatggggttctcctcactgctgtggggttctgttcactgctgtggggttctattcactgccgtggggttctattcattcactcccatggagttctgttcactcccatagggttctattcactgccatggggttctattcactgccgtggggttccgttcactgccacagggttctgttcactgccgtggggttctattcactcactgtcgtggggttctgttcactgccatggggttctattcattcactgctgtggggttctattcactgctgtggggttctgttcactgccatggggttctagtcactgccgtggggttctgttcactgccgtggggttctattcattcactgccttggggttctattcactcactgccttggggttctattcactgccatgaggttctattcattcactgccatggggttcaattcactgccatggggttctcaggcctcgccctccccatgggcccccatgggcagtgccccttccctgttgaggagcagagattaccttgggattcttggttggatgctggctcggacgctgtggtgtgagtaggaggttggttgtgcctgccgtgcgtggctctggcggggatgtgtgtgtgccatctcttgctgagggcgctggttcctacctgtggtctgtgacctggcgactcccatggctttggcctttggcctctgggcttctctggcttcatggggcctcttcactctcccacttactatttctggtggtcgagggaaaagtagtaagagcagttaaaatcccgaaacgatgacctgaacagttgaagtggcatttcctgtgggaaactgacttggcttttgcaagggtcattgcttcctgatgcatgtttaactgtcctgtgttcactttgttgccgcaggtttttagaggaacgtaaagagatcaccgagaaattcagtgcggaacaagatgccttcctgcaggaggcccaggagcagcatgcccgtgagctgcagctcctccaggagagacaccagcagcagctcctgtcagtgacggcggagctcgaggccagacaccaggccgcgttgggcgagctgacagcctccttagagagcaagcagggggctctgctggctgcacgtgtggccgaactgcagacaaaacacgctgccgacctcggcgctctggagaccagacatctgtccagccttgattctttggaatcctgttacctctctgaatttcagaccatccgtgaggagcacaggcaggccctagagctcttacgagcagactttgaggaacaactgtggaaaaaggactctcttcaccaaacgattttgactcaagagttggagaaactgaagcggaaacacgaaggggagctacagtctgtgcgggaccacctgcgaaccgaagtgagcacagagctcgccggaaccgtggctcacgagctgcagggagtgcaccaggtaaggcgccagggccctgccccagcccagggcaggcctctcctcgctgcctgtgtgtttccaccgcgtgtcacatgtctgcgtgcgtgctgtgtgtgcctgtgcgggtgtctgtgtgtctcacaggctgccgagatcagtggggacttctggtctctttgtgaactgggcttttttttttttttttgagccggagtctcactctttcgccaggctggagtgcagtggcgcaatcttggctcactgcaacctccgcctcctgggttcaagtgattcttctgcctcagcctcccaagtagctgggattataggcgcctgccaccatgcgcggctaatttttgtatttttagtagagactgggcttcaccatgttggccaggctggtctcgaactcctgacttcaggcgatccacccgccttgactcccaaagtgctgggattacaggtatgagccaccgcacccggcctgagctgggctttaaaacactgagttgaagggttattttgatcgcaggcaccttgttaaaggctttgctctcgtacgtatgtgggagggcctagaccttggtgggggattttgtgggctttggagtattcctcaaggctgaccagcacctctgcagaagacttggtttccaggctgctgtgggaagatctgatggtcatgttgtgtattcagagccttggtcccctccttttattgatgtttcctgaaataaaacccttttgctacatttcaagagcagtgatgggccaggcacaatggctcacgtctgtaatcacagcagtttaggaggctgaggcagttggattacttgagcccaggagtttgaaaccagcctgtgggctacgaaaattaaaaacaattcaccgggcgtgggggcacgcacctgtagtctcagctactttggaggctgaagcaggaggattgcttgagcccaggaagtcgaggctgcagggtgagctaagactgtgccactgcactccagcctgggctgtaacagagtgagaccctgtctcaaaaaaaaaacaaaaatagctcacacctgtaatcccagcactttgggaggccaaggcgggcagatcacaaggtcaggtgatcgagaccatcctggctaacacggtgaaaccccgtctctactaaaaatccaaaaaaaaattagctgggggtggtggcggacgcctgtagtcccagctacttgggaggctgaggcaggagaatgatgtgaacccgggaggcggagcttgcagtgatccgagatcgcaccagtgcactccagcctgggagacagagcaagactctgtctcaaaaaaaaaaaagcggtgatggttcatttgacaggcacttccaagtttttatcatgaagaagaatttctggcgaagtccctcttgccctgggctggcgcctgactgcagaagctgcagtgcctgtgactcaggaaaggacacgtgttgtcgtatcacacacaccttgtgctttctctgccctcagtgaggtctctgaggttttctcaccttgaaatagatgagtctgctctgttgagcatgtggagccactggggctggcctatctccctgcaggaaggggatgcataggcctggctgcacggtggatggggcatgggctagagctgatgaggcagttagaaatggttgttctggcagatcaataccttgtcagacgtttaagaagtacacgttccaaactataaacgagggaattgccagcttggataaggtggatacgttgatttcctgataccagcatgccacgggagggcttcctccttcctgactgtggggaacagttgtgaggctccaaagcgttggcttattgtttgctttccttcagctctgtgtaagaacaggagaaaagtggaaccttctttaatcgctgtgagggtttcatgttatgtttcaggctgtctgttttgtgtggtctgagcatgtgatcttgggggaattcctagaaagcagaatatgttcaggctccctctgctctcctgagtaaggtgcagtcagttgcctgtctcaggcctctgtgtcctgtccttgtcttcaccacatgtcagggagtcctggggatgtgttttgtttgtttcttttttgttttttaaaagacagggtctccctgtgttgcccaggctagtctcgaactcttgggctcaagagatcctcttgccttggcctcccaggtagttggaattacaggcatgagccactgctcccagcttgggaggtgcctcttgagagaagctggagccatgttgtctttctggacaaaattagacaggggtctgatgctgctgggagctgccctccaggccagtcctcagatgccagcttcagtttcctttcgttcccagttttgatcataggcaaacagatgctttggagaatagcacttgttcccaagctgtggatttaaaattaggttttcttggtttgtttggtttaaagaaaatgaagttctgaaagaatattcagaaaggaggaacttgcatatcacacatgaagtgtgtgtttcaaaccacggcctgatttagtcagaggaagcatgtggagcgtgtgcaccttctgtgccctgtgtggggatgtggcacatctggatgtttcctggacggaaggagctggtcgcagccctgtgcaatcagagacgcctgctggaggcagagaggaccaaagccctggacagggtgggtgccaaggtcctgctcctggagcatcagcaccaagcggccctgcaggaactcagagatgtacgctgccaagatgcaggagcatcaagcagggcaggcggagctggaggagccgggggagccggaggttctgggggtgctgggggagctacaggtgctgcgggaggggctgtgcaggtgagcagctccacgtgtgtggttcccacaggggtgcctccccggcttctctgccctgagtcttcatcagagcgttcaggcacttacggatacacttggagccgctggattgtgcgtgcagtggggtctgtgctcaaagagtgcagcttcgtgggggcagatgtgtcagtgcacctggccagcgaggcagctgcaggggtgggcatccgggggggggtgtctttggttggcctcccctcctgttggggcctccggagggcagggttctggtctggtctgcaggcagtgagtggtctgtggcgcgaccagatctgtcctacaggctacttggcagctggacgaaacacaaagtggaggcgattcagagcctgggaggtgcgggggtcggggaggctggggctcatcctgggtgtcgcgctaggcagctggggggatagtgaggggtgcctgccagctgatgatggcatagggaggggcatggagagcctgggggctgacaggggaagccacgcttagctggaggggtcatcccaggttggactggtgcaggggatgtggcttgtgtagacacagaagcacatttagttgctcttataaatctgcacacgggctgggcttggggctcatgcctgtaatcccagggcttcgggaggccacagtgggatgatctcttgagctcaggagttcgagaccagcctggggaacatagcaagagtccacttctaaaaataaaaatcggccgggcgcggtggctcacgcctgtaatcccagcactttgggaggctaaggcgggcagatcatgaggtcaggagatcaagaccgtcctggctaacacggtggaaccccgtttctactaaaaatacaaaaaattagacaggcatggtggtgggcgcctgtagtcccagctattctggaggttgaagcaggagagtggtgtgaacccgggaggcggaggttgtggtgagctgagatcgcgccattgccctccagcctgggcgacagagcgagactccgtctcaaaaaatatatatatgaaaataaaaataataaataaaaattaaccaggcatggtggtgcaggcctgtagttccagctacttgggaggctgaggagagaaaattgcttgaacctgggaatctgaggctgcaggaaaaaaagaaagaaatctgcacacagtatggtttattttctttctttctttttttttttttttttttaaagacggagtctcaaaaaaagtctagagtgcagtgtcacgatcctggctcactgcaacctctgcctcccaggctcaagcagtcctcccacctcagcctcccaagtagctgggatacaggcacgggccaccacgcctcgctaatttttattgttttgtctcccaggctggtcttgaactcatgggctcaagtgatcctcccgccttggcctccccaaagcactgggattacaggtgtgagcctctgcacctggccagtgtagttacttactttttcagttttttaaaatcttgtgtgtcagaatatgcgtaagcactggtaccaaattgtgtcagaagaagccagactgagtagtcggaatcccccttggattcccaaggtggccgtgaaggggcctggctgaggtcccctgccacctgctgtggtcttgattctctgcacctatgcaggactgcatttaagcagcaaggtctccccacttgtggacccgtgcacctgccccatccaggcgccaccaccccgcctgctggtctgcatgatgagcacacgcacacacagcacatgtgcacacacagcacatgcacacacacatgcagacacagcacatacagcacatgtgcacacagcatgtgtgcacacacacagcacatgcacacacagcacatacacagcacatgtgcgcacacagcacatgcgcatgctcacacagcatgtgcgcacaaacagcacatacatagcacatacacacatgcagcacatgcacacacacacagcacatgcacacacacagcacatacatgcagcactcacagcatatgtgcccatacaaggcacatgcacacagcacatgcgcacacatagcacatgtgcatacacagcacatgcacacatgcagcacactcacagcacatgtgcccatacaaggcacacgcacacacacagcacatgcacacacagcacacacacagagagcacatgcacacagcacatgtgcacacacagcacatgcacatacacagcacatgtgcacgtgtagcacatgcatgcacacagcacatacacatagcagatgtgcacacagcacgcacacacaacacgtgcacacacatgcacacgtgcttacacagcacatgttcatacagcacatgctcatacacgcagcacatgcacacatacacagcacatgcacacatgtcattctgcatgttgtcctgcaggatgaatgcctggggccctcctgcttctgtgttctgggtctgtacgattttctggcctttctgtggggggagggttagagtctggagcacttcagaaataattgataatttatttgaagcattatgtgcaaattttaggtgattatggtacatatggtttcaagggggttttaaacaaggacatgctaagatctcatttctagccataaagtaaggttttgaacctgaaaggtttgcttggtgaagagggactgctcctgagaatgggtgatgcagcgccggattctgaggttagaaatgacttgtttcttcacgtggacagctctgggtgctgcccagtgtggacactggcccctcagtcctgaggcacagccctgagacctgcaccctgctgggtatcgtgtgggtctgtcttctctggaaaagtcagattctgtctcgcttttccagggactcatgctaaagaaattctgtccgttttatctgtgcatagcacaaggaggtgttcgttttctgaaatcgtgtgtcacctgtgtcctttaacctgtacttttgttcttctagggtgactgttgttgttgttgttttggagggaggatcttgctctgtcgcccaggccgaaggtagtgatgcaaccacagctcactgtgaccttgaacgcctggcctcaagtggtcctcctgcctcagcctcttgagtagctgggactacagatgtgcaccaccatgcctggctaatttattttttgtagagatggggtctcactgtgttgcccaggctggtcttaaattcctggcctcaagcaatccttttgtctcagcctcccaaagtgctgggaccataggcgtgagccgcgcctggcctggactattatcggaatactcctagagcgtctttgcagtatttttgtagttgaggtacaggtttgcgcgagtaagttagctttttactttgctgctagggatgtgcatgtcaatactctttttttttttttttttttgagacagagtctcgctctgtctccaggctggagtgcagtggcgtgatcttggctcactgcaacctctgcctccctggttcaagggattctcctgcctcagcctcccaagtagctgggactacaggcatgcgccaccatgcctaatatttgtatttttagtagagatggggtttcaccatgttgcccagggtggtctgatctcttgacctcgtgatccgtccgcctcaccctccctaagtgctgggattacagatgtgagccaccgcgcccagccttagcttttttttttttttttttttgggcggagtctcgctctgtcgccaggctggagtgcagtggcatgatcttggctcactgcaacctccgccccccgggttcaagcgattttcctgcctcagcctcctgagtagctgggattacaggcacataccaccacgcctggctaatttttatattttcagtagaaacagcgtttcaccatgttggccaggctggtctcgaactcctgaccttgtgatctgtccgtcttggcctcccaaagtgctgggattacaggcgtgagccactgcgcccggccgctcagatactcttttatgtgattgttttggtgtagctgatttcacagaagaaaacaattgggctgtggggaggtgggatgtactctttattttatattatgttttttggggcagagggcagcatttgcaggaatagaataactcagcaagcccccggtcccgctggttagtggggtgcacgttcaatacatcagtccccctctcctcctgattgtttagaagcaaatccaagacaccatgtgtctgcgagtgaggtgttttcccccaatacagcataaccatgatccattctcacctaaaacatccacagcgatccctgcatttcatcacaagcccagcccacgtgccagtctcttctggctggctcacatcaggatctatttgttcctgtgatgctggtcactgttccctcgttcctgcaagcgtgttggtagatccacaggcctgtgattggtgagaatgcttcttgtatggtggccactcctctcctggtctcctggtctttcctcaggctttacaccgtgaaaagacataacacaagctggctgcagtggctcacgcctgtaatcccagcactttgggaggccgaggcgggtgcatcacctgaggttgggagttcgagaccagcctgaccaacacagagaaaccctgtctttactaaaaatacaaaactagccagccatggtggcacatacctgtaatcccagctactcgggaggctgaggcaagagaatcgcttgaacctgggaggtggaggttgtggtgagccaagatcgtgccgttgcactccagcctgggcaacaagagcaaaacttcgtctcaaaaaaaaaaaaaaaaaaaaaagttacacagagccctgccaagccctgacgggagtgttttgggtcattgtcccagaatagctgggatgtcctgttcttccccgcggcgatgctttatctgagcctcaaatatctttgcacctgttggaacagcagtcacttgtcagcagtgtgacttgacctacacttgtggggtgattggattactttccgggataccgcccttgagagtttggttgtgaggaaagtcctctgaaaacgtaagcttgatttctttttgatagaagtatgtatcccataagattcccctgccctgccctgccccgcctgtgctggtaacacgacgcagagctgagtgcagaagtgaatcgcatgcggccggtgtgggatgctcaaggcggtgtcatcttttctcggattgaaaacccaaatctattcataggttaattattttaatattaagataatattaacgttggtttagatagcatttgaatgtcctaaatgcgttctcaattgaatgtctttgccttctgacattggtattctctgtgcatgccacttacttatgattaaaacatatgtgatatttttctataattgtgtggattttagaaaaacctgaaaataactttttttgaaacgtcttttttgatactgacctcacagcttagaagaacatggtcaatttaaagagttttattccaggctagagcctctgccagggggttgcaggaagaaaatctcctttgagccggcccggtcagattgagggggtggctgaggacgcacgcttctgctcgacattgtggccgagccgaggccctgggcctgagggatcacatgtggggcactggccgtctcactgctgggcctgcatgcctgtgacctgcccagccctgcccgacgtctcctgggggctgtccccccgcggggagccgcctcatttggcctccaccacctcctacgtcctctgcaggtctgccgaaggcctgagagtgtgcaggcaggacagggccaagcgtggacagttagggtggctcccctgggtgcgaggcggtacctgcgggtggtgctgtgccttgaaacaaagcgaaggtcaagactgcacacatggagcttccagctgccagtgggtggagggagcgccacctctgtctgccatgcccgggcgtcctggtgggctgcgtgcagtgttggcactccctggctggggttctctgtggagcctgccctctaccctctccgtctgcagtgtgtgactctgggatcccggaggccgcggggctagagcgtggcaccagctgtgctcctgagtggggcgtagtttgggacgcctggagcttaggccaggctccgcaggctctgggggtgtccaatgttcttgggctcccgtgttggcctcaaacagaagtttgattttctcattgttacacggtaggcctctatgagagatttttgtccaaagagagtaagtagtctgtggctcagaaagatgttcaaaggaccactgatttcagccttggactcttgccacatcctttgctgggcaccgggagcgcagaggtttgccctcgggccccacaggctgacgctgtggatgccaggagggaagcgcctgatctgtgcctggctgggcctgaggagcccgtccactgtgtctgagcatgagctgttgtgggcaccatggtggcgcctggtcttgaggattaattttcctgttttcccagtcccttggcctctgtcctgccgggtgcattggcatttggggttttgttcttgaattcaccagcgttttgtggttggtgtacactgaaccagcatccctgtttggacctcttactcctggcccgctgccccctccctggctgttggtccggatcaatgcgtctgtcccccaggagacgcactgctgatggttggggtatcagcaaggtaattaaagttctttggaaactttgtagtgtgcacagctcagaagttaatcttaagtccttcctttcaaacagatggaactaaatcaaatccaggagagaaagttgattaaagtgaactgtactcacattccaaatggccttgagaccttgcgagtgacttcagtgttgtgccgtgcgaacccgtttctggtccctgtgactaagatgcagatgcacagcccacctggcacctcagcaagttccaggccggcgcggggggcacccgatcctttatccttttcctccccatggcttatcacacaaaaaaaggtagagaataaaggtcatttctggtgtcagggcttccatgtgtttattgaaactgttgccccagttacttcagaaaaggcactcactcattgttgacgtcttcctcctcctgaagctggtggagccccagccctcagccctcctggccgtgctgggcagggagcgggagccggcaatccaccccagatgttctggagcagcaggtcccggagcagcaggtcccactgctgaggacatgggcttcgtgctgtcctttcctgcctgctaagtagatacaaaaaacttactttatcagttaccttttcacatgccaagtcaaaacacaaaataatttcattgtcttaaaactgagctttttctaggcaacttttgtcaggcctttttatatttaaatctgctgtgtaacacaccttttctaccaagaatctgtcatcacttatcttagagctgagaaaagtttattctaaaatatttcatcacctcaaaaagaaacccccagtggctcgtgcctatagtcccagcaccttgggaggctgaggcaggaggattgctggagcccaggagttcaagaccaaaaataaaaaaatactaaaaataaaaaaattagcctggcatgttggcgtgcccatatagttccagctactcagaggctgaggtgggaggaccactggagcccagaaggttgaagctgtagcaagctgacatcgcaccactgcactccaggctgcatgacagcaaaacgttgtctcaaaagataatcaatgaaaattaaggaagaaaacaagaaactccccattctcccttctcccccatgcctggtgatgtgccgtctgcttgccgtacctgtgggcgtcctacgtacatagactcagcgtgtgccctcggtgtccgcggctttcactttgtgtgtttcccaggttggcgcacgttgtagcatgtgtcaatacttgcttggtatgtgttttctgcatatcttatgccctttttgttctgtattcctccattactgccttttttcactttaatttccttgatgtttcctttaccatacggtggtcgccccttacccacaggggatgcattccaagacccccagtgggtgcctgaaatcgtgaatggttctgaaccccttatatgctgtttttgtctatacatacctgtcatcaacttttaccttaaaggaatcaccctgtggtgtctctggcatatctgaattgctccgtcatcaacttttaactgaaaggcatcactctatggtgtctctggcacgtctgaattgcagcattgcaattgaacggcctctcttgcgctttggggccgttattaaatgaagtaaaggtgacttgaacacaggcactgtgatgctgtgacagttggtctgatcaccgagatgcctgcgtgtgggcaggtagtgcttgccacgtggataacgccggacagaaggatgacccccggcctggcctgcgagatttcctcacaccgttcagcttgggggcaggcagtttaacactcataagagttgtttacttctggaatttttcatacgatattttcaaaatgacgttgaacacaagtaactgaaaccgcagacaaaggggactgatatatattgagttattttcttagcgcttgccctgagcgttacagcaagcaccttctaacaatctggtttggattaataccaacttaattttaaaagtttacaaaaccatttgctaatgtagcatcattccctcgtctgccctttgtgctcatattgtcgtaccaaccacatctttctatctttttgtgctcgttactttatgcacgtgtcttttaaaccaggaggaagaagaattgtaaacaaaagccatgttgttttgtctcctgttttctctgtgtcgttacctgcactactgctgctcgtttcttcctggaaattcaggtctggtgccttatgtttcagcccgaaggacttcctctgggatttcttgaaggacaggtctgctagtgatgaatcctcttagcttttgtttttgtgggaatgtcttaatttctccttcatccttgagagatcatttcctggatgtggacttcaagatccaggcttttccttcagtgctgcgtgggctctccgctgcctcccctgtcatccggggctgcgtgtcgtgagctgcgcccgtcttcctgggctgcgtgtcgtgagccgcgcccgtcttcccgggccgcgtgtcgtgagccgcacccatcttcctggggctacgtgtcttgagcggcacccatatacctgctgtgcactggctggcctcaagctttgtcctgaaccctgctgaggtttggctgtgatgggtgaagtgtgggtctctgtcagtttgtcctacttggagttcattgagcttgtatgtggggattattatttttattattattgttattttcatcaaatttgggaggtttttggccgtcgtgtcttcaagggttcctctgcccttttctctccctctgtctggcttgagggtgccccacaggccttggagactgctgagttttcttcatgtttctttctgttccctgactggatcgtcttaattgacctatcttccagcgtgtgaattctgtcttctgcctgctcgagtctgctgccgaacccctctctagtgaatttttttttctgtgattgtatttttcagctccagatgtcaagggagctctatttcagtctttctctctgctgagggccctgcgtgcattgtgccctcagggctctggcgggcggtggacagcctggccctggccttcacccctgctgtgccaagccacatggtcactgcagccggcccaggacctcttgggcctttccagcgtgggcacagccctgcacgtgttcacaccttgtagagtcccagaagatgtcagagctttccagaggcccctgtggacatcgcattctcaagtgttttcttttgtttttctggcagtcccttattagtcccaactggtttctctactgtgggcagtgcggctattaaacacttgacactgactgtttccaaccggtgccctggggtagattttttttttttttttttttttttttttttttttttttgagacagagtctctgtcgcccaggctagagtgcagtggcgcaatctaggctcactgcaagctctgcctcccaggttcacaccattctcctgcctcagactcccgagtaggtgggactacaggtgcccaccaccacacccagctaatttttgtatttttagtagagatggggtttcaccatgttagccaggatggtctcgatctcctgaccttgtgatctgcccgccttgacttcccaaagtgctgggattacaggcgtgagccaccgcgcccggccaaccctgggtagaatttttgacaccgagagctctgacccagtcacggcagcaaggtgcccggcaggtgggctcgggcagttgtgcatggaaattttggggtgctccaaatccattctgtcccccaccccaccccagcagctactggttttcagggctgttagattggagaggagatatggagtcagggcaaagttaagcacctgaagtttgttcttatggacactcagcctgtgttttccataaacactcttcggatgattgcaaacctgaccagatttccacagctctgaaaacactggttttgatggtttttaccactttttcttttatagaggaacagattttggaggtccttactttgccattctagaagtgctacctctggaagtttaaaaaaataagcttatttcattaatttaattggccgggtgcagtggctcacacctgtaatcccagcacttttggaggccagtgtgggtggatcacttgaggtcaggagtttcagactagcctggccaacaggttttggtagaaaccctatctctactaaaagaaaaattacaaaaattagttgagtgtggtggcaggcgcctataatcccagctactcgggagactgaggcaagagaatcccgtgaacctgggagacagaggttgtagtgagctgagatcacaccactgcattccagcctgggtgacagagaagagtccttccaaaaaaaaaaaaaaaaaatctctgtgtgtgtgtgtgtgtgtgtgtgtgtgtgtgtgtgtgtgtgtgtgtgtatagaattcatctattgaaccttatttaaaaggttttgttatttagaaagaaggtttaatcttttaaaagggaaggaacctaggtttccaaatatcttgggttttcatggctgtaattccttgatggtgaacttcttagtgtgactcttaaagatgttacaggagccatttgggaatggtagtgagcagttgcttatgacacgcagctgtcaccagtgcgaacttgtgtctccttaagtgttttatccccgaaaccaggactttgtgttcccagtgaagtccttgaacccatgttttctttgatgggggctgtggtctggctcatcccggctcttggtgcagagtgggggctccatgcatatctgctgaatgtgctgaattccggctaacagcaaagaaagtatttttctagcttactggtattttttattgttattgatgtgtacagggtgaatttggaagtgaaaagaaaactgctttgcatgaaaaagaggagacacttcggcttcagagtgcacaggcacagccttttcaccaagaggagaaagagtctttgtctctgcagcttcaaaagaagaatcaccaagtccagcaggtgtgtggaatacgctgttcccttgtgataagacgtgtatagcataaaaatcattttcactttatttcagtgcacagttcagtggcaggagtgcactcatggtgttgtgcatttatagtgttgtacattcagtggcggaagcgcattcacagtgttgtagattcagtggcggaagcgcattcacggtgttgtgcattcaatggcggaagcgcattcaccatgttgtatattcagtggcggaagcgcattcatagtgttctgcattcagtggcagaagcacattcacggtgttgtgcattcagtggcggaagcgcattcatagtgtagattcagtggcggaagcgcattcatagtgtagattcagtggcggaagcgcattcatagtgttctgcattcagtggcggaagcccattcacggtgttgtgcattcagtggtggaagcgcattcatggtgttgtgcattcagtggtggaagcgcattcacagtgttgtatattcagtggcggaagcgcaatcacagtgttgtatattcagtgacggaagcgcattcacagtgctgtgcattcagcagcagaagcgcattcacggtgttgtatattcagtggcggaagcgcattcaccatgttgtatattcagtgacggaagcgcattcacggtgttgtgcattcagtggcagaagctcattcacagtgttgtgcatagttcagtggcggaagcacattcacggtgttgtatattcagtggcggaagcgcattcacggtgttgtgcattcagtggcggaagcgcattcacggtgttgtgcgttcagtggcggaagcgcattcacggtgtgcgttcagtggcggaagcgcattcacagtgttgtatattcagtggcggaagcgcattcacagtgctgtgcattcagtggcggaagcgcattcaccgtgttgtatattcagtgacagaagcgcattcacggtgtgcattcagtggcggaagcgcattcacggtgttgtgcgttcagtggcggaagcccattcatggtgttgtgcattcagtggcggaagcgcattcacggtgttgtgcattcagtggcggaagtgcattcacagtgttgtatattcagtgacggaagcgcattcacagtgctgtgcattcagtggcggaagcccattcacggtgttgtgcattcagtggcggaagcccattcacagtgctgcgcattcagcagcggaagcgcattcacagtgttgtatattcagtggcggaagcgcattcacagtgctgtgcattcagtggtggaagcccattcacggtgttgtgcattcagtggcggaagcgcattcacagtgttgtatattcagtggcggaagcacattcaccatgttgtatattcagtggcggaagcgcattcacagtgttgtatattcagtgatggaagcgcattcacagtgctgtgcattcagcagcggaagcgcattcacggtgttgtgcgttcagtggcagaagcacattcacggtgtgcattcagtggcggaagcgcattcaccatgttgtatattcagtgacggaagcgcattcacggtgttgtgcattcagtggcagaagcgcattcacggtgttgtgcgttcagtggcagaagcgcattcacagtgttgtatattcagtggcggaagcgcattcaccatgttgtatattcagtggcggaagcgcattcacagtgttgtatattcagtgatggaagtgcattcacagtgctgtgcattcagcagcggaagcgcattcatggtgtgcgttcagtggcagaagcgcattcacggtgttgtgcattcagtggcggaagcgcattcacagtgttgtgtattcagtggcggaagcgcattcacagtgttgtatattcagtgatggaagcgcattcacagtgctgtgcattcagcagcggaagcgcattcacggtgttgtgcgttcagtggcagaagcgcattcacggtgttgtgcgttcagtggcggaagcgcattcaccatgttgtatattcagtgacggaagcgcattcacggtgttgtgcattcagtggcagaagcgcattcacagtgttgtgcgttcagtggcagaagcgcattcacagtgttgtatattcagtggcggaagcgcattcaccatgttgtatattcagtggcggaagcgcattcacagtgttgtatattcagtgatggaagcacattcacagtgctgtgcattcagcagcggaagcgcattcacagtgttgtatattcagtggcggaagcgcattcacagtgttgtatattcagtgatggaagcacattcacagtgctgtgcattcagcagcggaagcgcattcacggtgttgtgcgttcagtggcagaagcgcattcacggtgttgtgcgttcagtggcggaagcgcattcacagtgttgtatattcagtggcggaagcgcattcacagtgctgtgcattcagtggcggaagcccattcacggtgttgtgcattcagtggcggaagcgcattcacagtgttgtatattcagtgacggaagcgcattcacggtgttgtgcattcagcagcggaagcgcattcaccatgttgtatattcagtgatggaagcgcattcacggtgttgtgcattcagtggcagaagcgcattcacggtgttgtacattcagtgacggaagagcattcacggtgttgtgcgttcagtggcggaagcccattcacggtgttgtgcattcagtggtggaagcccattcacagtgctgtacattcagtggcagaagtgcattcgtggtgtgcattcaggggcggaagtgcattcacggtattgtgcatagttcagtggcagaagcgcattcacggtgttgtgcgttgagcggcggaaacacattcatggtgttgtgcgttgagcggcggaagcgcattcacggtgttgtgcgtagttcagtggcggaagtgcattcatggtgttgtgcgttgagcggcggaagcgcattcacggtgttgtgcgttcagtggcagaagtgcattcacagtgttgtgcatagttcagtggtgcaagtgcattcatggtgttgtgcgtagttcagtggtgcaggcacattcacggtgttgtacattcggtgatggaatcacattcacagtattgtgcagccatcaccaccatccatctccagaagtcttcatcttgcaaaactgaactctgtccccattagactctcactccccatttgccctcccctggcaccatggctcacacctttaatcccagcacttcgggaggctgaggcaggaggaccactccagcccaggaattcgataccagcctgggcaacatagggagaccctgtctctataaaaaattaaaaaaattagccgtgtgtggtggcacgcacctgtagtcccagcttctcagaaagctgaggtgggaggattgtttgtgccctggagtttgaggctacagtgagctgtgattgtgccactgcactccagcctgggcaacagagtgagaccctgtctcagaaagaaagatctttgcctgcctggcaactgacttttgtgaatgaccagatacagtgacttatttcgaattgctgtttgagtggtggatctctgatgaactggccccttccctcccctagcctcaggttccacctggggatgtttgtgtattcttttgtaaatgatgaataatggaggaaaaaccgtatcaataattttcacctttaatcagcacctcgttcacctttgccgtatttttattaaatgtgcaggtgctccttggcctttgctgaggtcacgcctttgaccactgtcagtggaaggcgttgtgagtcgaggaacgtgccgaagtgcctgctccttttgccccatcaccaagctgaaaagtcctaagtcagagactctcaaatactgaaattgtgttgaaagtcccttacagccatttgcttttaaccaaattgttttaacgaaagctttaaccatttttctcgatagctgaaagaccaggttttatccttaagtcacgagatagaagagtgccgctccgagttggaggtgctgcagcagaggcgggagcgggagaaccgggaaggcgcaaacctcctctccatgctcaaggccgacgtcaacctgtcccacagcgaaaggtcagtgtgtcctcggcaccgaggctgccttgtggccgccagcacccgctgggtcatgcagatgccattggtccccacggctcctggccccgtggctgctgccaccatgcacgctggctcctggtggacggggacccggcttccttcttctctcagttagaaagattgtaagcaccgggaagaaatcgcctgctgtgtctcatctcccagcccccgtgccctcctcccaccctgcctgctgtgtctcatttccccatctggccagattaaaaccagccgttatctcccacacagagcccgacccctcccctttagtgtctgcgtccccgcagcgtgtcctcgtccccggcacggggtgcaggcccacatgtctcgtggttcctgtgctttggactgtgtgcaagtgtcgtgcctcatgcatctctctctgtgacgtgtgtttctgagaccggcccaagcaggggccgtagccctgtccgttcctttctccattgggagcctgtgcctgggtagctgcaggcactgggctgagcgcccagccccgagggctctcccagggcggggtgtgggtctgcttaccacgggccgtggggccgccttccctgaacgcatgggtccaggccacatcctgccttggtgcctcctcacctgcagtgatgctgtccagcaggcttgtctgcccttttgtcgcgtgtggggtcttgagaaactttttgctcctctgacaccatggaggtttttcccaggtcacctcacagggttttaagttttgcttttgtgtgactctggggtgagcctgcagagttgttcttgcttgcacctgtctgggcagtggactcggcactgtgttgccaaacgcagcctccccttggtgcgcgtcctccccgtccccttgtgtgggtctttggctgctcccattggcgtgtccccgcccgaggcctctgtgtcctgctgctgctcccatctgtgtgtccccgctgaggcttctgggtccagccactgctcccgtctgtctgtccccgccccaggcctctgagtcctgctgctgctcccgtctttgtgtccccactcgaggcctctgggttgtgctgctgtgtcctgaagctctgaactggtttggctctgctctggagaccacccagggtccggagaccaggtcgggcttatgggaccctctgagctcacagctgtttctggagcattggtgtctgtcatgctgagggtccatccgtgtgtggggggtgtctgtgcaggtctctctttgttcttttcatcaagttttgtgatttttctgtgaggaccttgccttctgtagcacttggctgtgggtgtctcgtagcttggtgctgactctctccagtcacccaggtcagtgggcgagcgagagctctaaaccgaggggcacagcggccagtggggcggtctgtgctcttaactcgaggggtgcagaggtgggtggtgggcggggtagtcccaggctctaaacacaaggggtgcagaggtgagcccacggtccctggacactggagaggctgcctgtcttgaggtggggtggctgcagacgccctgatgcctgcaggagttgggcattttggggggtggaagtgtgctggggagcaggtggcattctctccgtcaagcccctcctcaggactccccctccctgttatttgcccagaatcttcggtttcgcggggcctgcacgacactgcctcccgttgtcacctcacggtccccacgaatgagtcctcatcgtctgctcctcagggttgggctctctggggacagagctgtgagcagagtagagggagggctggctgtgtagtcactgggtcaacgtgcctgtcctcagcggcgtcacagctcctaaatcatagtgcagggagcgagatgtggaggggcctgtggcctcgggagcccctgtgtgtaaaaacagaagcatcccagccgggcgcagtggctcacgcttgtaatcccagcactttgggaggctgaggcgggtggatcatgaggtcaggagatcgagaccatcctggctaacatggtgaaaccccatctctactaaaaatacaaaaaattagccgggcgtggtgacagacgcctgtagtcccagctactcgggaggctgaggcaggagaaaggcgtgaacccgggaggtggagcttgcagtgagccaagatcgtgccactgcactccagcctgggcgacagagcgagactccatctcaaaaaaaaaaaaagacagaagcatcccagaccgcacgtccacgaggcctagcgagaggctgggagacaccatcctcttcctgccacacaactcctgtgaatgtgtggctgaggcgtgacttggtgttggacagacatcttgtgaaatggctggctggtgcaccctgtgctccaggggaggggcggagcctgtgtgctgctcccgggtgattgacgctgtgcggccacatcgcacacctgcgggacgggtttgccgtgttcctaatgtgatgccttttacacatcagaaatggcatcaggaagacctcacctaggaaagcccgtgtccctgagtgggctccacgtggttgtcttgtctgtggcctcagcttcctgtgctcacatgggcatgaggatcatgtcttccggccccgtggggacaggcagccgtgggccgaggtgtgcaaactggtgggcggcccctcagcagcatccagggtgggggttcttatgccgtgaccagcttgcctgatgatgggtgtctcctgtctcagaggggccctccaggacgccctgcgcaggctgctgggtttgtttggagagacgctgagggcagccgtcaccctgaggagccggatcggggagcgcgtggggctctgcctggatgacgcgggcgcaggcctggccctgtcgacaggtgagtgtgccgggaccagctgcccagccctgtgcttgcagcccctctgtggtcctggagctctctgagaggagcctccgtattgggcgatgcccttgggagcactgccgtcctggtttcctgctagtttccgcacttacagaaggccgagaccggggtttgggctaaatttgtcagctcccgtggacgtggcgctgactcatctcggctggggcgacgttctgagttctgtggcttccttgtcgtcttggctgccatggccgcggccggcttgctcactgagccgcgtgtgccggcatctgctcatcttgtagctccggcgctggaggagacatggtctgatgtggccctcccggagttggacagaactttgtctgaatgtgcagagatgtcttccgtggctgaaattagcagccacatgcgtgaaagctttctcatgagcccagaaagtgtgcgggagtgtgagcagcccatccggagggtcttccagagcctcagcctggccgtggacggcctcatggagatggccctggactccagcaggcaggtgaggcccaggctcccggggtcctgtggagatgtgaacaactgagtagctgatgatgccacacgagcctggtggatgccggtgccaacgacgctcgcacgggtttctccccaaggaggaggcttttctgaaccagatctttgaggaagtgggcttgctacgaatgagagaatctgtttgtttaatttggataataaacaggcccattttctttacttcatgcactgttgcaattccatgtggagtgttttcatatttagagattatcactaagaaaggaaattttttgtaaccgttttagaacattttagacaattaaaaaagacattaagtaggaatacacggaaagcaatcaaagatctttttttcagccaggcacagcggctcactcctgcagtcccagcactttgggaggctaaggtaggaggttcacttcagcctacttcagcccacgagctcatcttgtagctctggcgctggaggagatgtggtctgatgtggccctcccggagttggacagaactttgtctgaatgtgcagagatgtcttccgtggctgaaattagcagccacatgtgtgaaagctttctcatgagcccagaaagtgtacgggagtgtgagcaacccatccggagggtcttccagagcctcagcctggccgtggacggcctcatggagatggccctggactccagcagccagcctgggcaacatagcgagacctcattttaagttagccaggcgtggtggcatgcgtctgcggtcccagctcctcaggaggctgaggcaggaggattgcttgatcctgggaggctgaggctgccgtgagttgtggttgcaccactgcactccagcctgggtgcagagcaagaccctatctcaaaaatgaaaataaaaattcttttttgctaagttttgagttcagaggtaactctgggtctcagcctgtagatggcctgggagccccagactggacacagttgccaggggagtgtctggaggaagggagaggggcccagggctgaactgggaggctgaggaggggtcctcattggagactgtggccacagtgtctcggagggtggctgagatgtgctcaggtcccgtcaccctggcctggccctgcctgggtggtgacggcctgaagggtctgggggtagaagtggcgttctcttggtcttaatgtaggcttcagttatttttgatctggagttttgatttgcaaatgtgttttaacagctggaagaagcacgccaaattcattctcgttttgaaaaagaatttagttttaagaatgaggagacagcacaggttgtcaggaagcaccaggagctgctggagtgtttgaaggaggagagcgcagcaaaggcagagctggcgctggagctgcacaagactcagggtgagcagcatgaggcctcggggcacctggagcacaggcacggggagcaggcctggcctcactgagggaaggaagccttcagaatagggtttttaaagtgaaatgtaaaaacaaagccaacatgggaggcacccatggtttgggaggaatggggtggtcgggagctgctgcggccagcagggctgttggaggcctacacctgggtcctggaagctgctggctcttagctctgctgctctcaggggcagtggccccgtcccttcctccaagcaggctctcctcagttacacccaggactggctttgtcagagcatctgtgtctcccacaaaggtacccttgagggattcaaggtggagacagcagatctgaaggaggtgctggccgggaaggaggattccgagcaccgtctggtgctggagctggagagcctgagacggcagctgcagcaggcggcccaggagcaggcggcgctgagggaggagtgcacccgtctgtggagtcggggggaggccacagccacggacgccgaggccagagaagctggtaaggagcgcgggctgtggagggtggtgcgagctgtggggcgcggatacagctgccacggtttccccagctcccaaggacactcagtgtctctagagggtcaagtgtaaaccagcacgcagcttctcctggaacactgggcatgggaagcttgtgcggatcaggtgaggcatccactggctttgctgccctttcagagaaggcgggttgtctgtcggtcctgctggttggagggtccccacctctgtgaggtggaaataagaggggctctgagtccaacagcagcagctggaggcagagccgagtgcggcaaacaagagctactttaaaatttcatttaaaataaccaagtgcctgatattaaccctcattaggaaaacatagtgttaacaatattagtttgtatcttttcagatttttagatattttagtctcaaaggtatttaaaatgaaaactgtcaaaacataagtttaaaatgtcgagcctgcagggagctgcgtcctcagtagctggttcagctcgagcaaaggcttttcacattgcattcgtgcatctcaggcacgtgggaggcagaggggcctgcgcttctctaaaagttccttccaggatggccgtggcctcggggtcatcccttcagaacacagattggagttagaagcttgggcatcgcaggcaccacctcagccaattcagaagtctcatttattattattattatttttttacatttttctctttagaaaacaaccagcttttgatttttgtggccattctcatttgctgtcttctgtcttgctgatttttgcccttgttcgtgtgattccttgttcctatggttttgtttttgtttttgttttttttgagatggagtctcgctgtgtccccaggctggagtgtagtggcgtgatctcagttcactgcaacctccgcctcctgggttcaagtgattctcctgcctcagcctcccaagtagctgggattacaggtgagcaccaccacacctggctaattttttatgtttttggtagagatggggtttcaccatgttagccagcctggtctcgaactcctgacctcaagtgatctgcctgcctcggcctcccatagtgctgggatcgcaggcgtgagccaccatgcccggccagctcctatggtttctcactgccttcgttgggttggacgcttttggacatgtttgctgcctttcacaggatgtggggttcaggtcgtgcctcctcgtggtgccccagcctttccacctgtggtgctcgtgttgacatctgggtcccacaagcttataattctttggcccagggggcgttttccagggtggaagacattggtcccacgggatgttttaaactctgcctatgactgtgcccacactttgtcctctccttttcttggttcatttctgtcattctcgtttatcccgttctattttttatataaatttctgatgctgaaggattagcctggtgtttttcccctcgtgtatcttttcttgtccttttattttaagtcttttttaatactctgttttagttgtgccttgtatggataccatattcatgactgttttttaaaagcctgtctgtgagtatcttcttttagtcatttagccaagttttatttgccgcacctcctggcgttgggcccttgctcgggggtggattttccttggccagctgtgaagtcctcactgcggtgttgcctgctgccgggctcagggcggcgtcatctccccacgggcctctaagccctgttgcccccgcactctgtgtgtccacagggggagtgcgggggaacctccagggccaggagggcctggagtctcttcaggtcccttcctccaccagtgaagtggtgctggagacatgactcgagatcctgtttcttttcctttgacgccctcgttttcctgcatctcctcaggatttttcagggtgttttcaggaacgtctctgacgtcctgcatcgctctcagcatctttgccctggcggtgctgttgcatctgggcgtccgttgtcgctgtttctccgatgctttctctgcttgtcctctgctgtccgggggcagcctcatggtcgggcccctccctgtagactctgctgccccatttccagtgtcttcgcgcccagccagccggcgctgggccacaccccgccgggggagaccacctggtgtttcatcacctcgagcccttggacttcagccagtcacttcgtttgtcaggcctccgggcagataaaggggtgtgtggcctgcattctgttgaacggcccggtgaggccggggccctgtggctagcgcccccgtgtcaggtgcctgtgtcgtgccctgggcctgagcacgtgggtctgagcactgcagggcttcttcccaaggctgtggtggcccgtctgctgccttgcctctggttcatctcctgccacaaagcctggcccaccagggagtgtcgtgacaggtggatgtgggccctgggtgtccatagcctggctgggctccctgcaggccccaggattgaagctgaggcttaccatgggccttgcagtggcaggcgcctggcatgccgggagtggatctcatggagccctttcgcaggctcgggccaactttgtcactgggaaattctcgttgtttctctggggtcctctttgtttgctttcctttcgacatggttaaccctgccctagtttctcactctggtttgttttctttcctttcaccctggctctgcggttgtgtgactctgcgccagctaccggccctgaccactctcccggcagggcctaggctctgacggtggcgtgaacccggccctggtgtgcagcggccctgcctcgccgtgttgcgtgacgcccccttcgctgtgtggtgttttgtggctctcttcaggtgttgccatctgtcccttttgttctctttgtctccttgaaaagttgatgggcctgcagccgcacaggcagttgtgggcatggtgggcgctgagtctggaggttgttcaaggccagcagcgttgcccagagccctgctgctgacgctgccgtcactggttctagctctcacattctcagctgcacgtttctgtttccacctcagtaaacgcaaactcttgttcataggcacagctgtcactgcagcacacaaggactcaggtttgtaaagacaaacgattgatttgtgtgtgacgtgctgtttgtttgcactggattttgcaaattatttactaaagaaaagtacttcagaccttttgtggcaaacaataaatacagcgatactctaatcttcagtattcataaaaatgggtggagttgtcccattttaacgccccagcaaaacaggagcatttctctaacggtctttactacagtgcctaagctacagtttgtgctgcttttcagaaactgatgtcttgtgatagttacagctgttcttgggctgggtcccagctctggtctccagggagggcctgggccccctggatcccctgtgcctgttcagcgtgggtgtcacctgcttcgccagctgggattgcgatcctcgtgtgcctccctgagtctgcgtgcatgtcagcaggcaccctgccccagtgcccctggccctgaagatggtgatgttctgggccaagcacagcccaggtcgtgtccaggcccagggagtgcagtcaggggagcagctgccctcaggcctcgccgcacgtctcaggttgtgaatgttaccgcagcagcatgtttacagcggactcgccgttaactgctgacagtggcatcaacatttattgagaatgttacttgcattggtcatgatagtttgtgataaaagacttaacacttttacaaatcaaaatgattttttggaagctggtgaaatgtcagttaacatgtatgaatttaatattttagtttttgggtggcttaaagacttcaggattcaggccgggagtggtagctcacagctgtaatcccagaaccagactccatctcagaaataattataataaaatagagacttcgggactcagcagcagagactccatctcagaaataatagtaataaaatagagacttcaggactcagcagcagagactccatctcagaaataatagtaataaaatagagacttcaggactcagcagcagagactccatctcagaaataatagtaataaaatagagacttcaggactcagcagcagagactccatctcagaaataataataaaatagagacttcaggactcagcaacagagactccatctcagaaataatagtaataaaatagagacttcaggattcagcagcagacactccatctcagaaataatagtaataaaatagagacttcaggattcggcagcagacactccatctcagaaataatagtaataaaatagagacttcaggattcggcagcagagactccatctcagaaataatagtaataaaatggagacttcaggactcggcagcagagactccatctcagaaataataataataaaatggagacttcaggactcggcagcagagactccatctcagaaataatagtaataaaatagagacttcaggactcagcagcaggcactccatctcagaaataatagtaataaaatagagacttcaggattcagcagcagagactccatctcggaaataatagtaataaaatagagacttcaggattcagcagcagagactccatctcagaaataataataataaaatggaggcttcaggacttagcagcagagagcccctttttccaagacgctttttcatctgcagtttccacttgggccggggcttcgcaccccaggtctcaggctggttttgctgctggaagagaatttttgaggctaggcgatttatcacagacacacgtttgtgacttacagttctggaggctagaaagcctaaggtcagggtgccagcaggtttggtgtctggtgaggtacccatctctgcttctaaggcagagccttgcacactgtatcctccggagtggagggctggatcatcctggggcagaggcagaagggccgagtgggaggaccactcccaaagccgcttattgaggcattaaaactgctgtgagggtggagcccttgcggcctcgtcaccttttcaaggcccttccaataccatcactctggcagttaaatttcaacatgagttttggaggggacagaaatttaaactgtggtacccagttaattttatttatttatttatttatttgaaggagtctcactttgtcacccaggctggagtgcagcaatgcaatctgggctcactgcaacctccatctcccggattcaagtgattctcctgcctcagcctcccgagtagctgggattacaggcacacgccaccatgtccagctaattttgtatttttagtagagacagggttttaccatgatggccaggctggtctcaaactcctgacgtcgagtgatccacccgcctcggcctcccaaagtgctgggattacaggtgtgaaccaccccacccgacctagattcgcttttgatttaccgatggggcgtttgcctttcccctagacacgtcacaaccccaggctctcagcaccgtccgtcgtctgctgggactgggcttagtcgtgtgtttctgtctgggagactgtactgaaggcagaattcctagagaatcacccacatgtcactcagaagtattcttctcaggcttcagaaatttgctttagccaatgttgttttaaaagatgggcgttttaccccgaattgaagtgacttcattttcggtgggttttgactgaatcaccatcaggagatgcacgtgtcatgcaccagcctctgaggtgcgggggtgtccccgtgtctgtcctgtttgcatccttagctctccggaaggaagtggaggatctgaccaaagaacagtcggagaccaggaagcaggctgagaaggaccgctcagccctgctctcccagatgaagattttggagtctgagttagaagaacagctgtctcagcatcgcgggtgtgccaagcaggcggaggccgtcactgccctggaacagcaggtggcatctctggacaagcatttgcgcaaccagcggcaattcatggatgtaagaattctgaataatacatttttttgcatcactaaaagttgccgttacagcatgaacttctttccagatcgttacgtaagcttctgcagtaggatgttgaagagggcgccccacacctgctgcacaggtgcacccaggtcgctgactcttggtgggtgtcttcttgcccacatgttgtggcgcagccctctgagggccacctcccatggtcttgccatgctccttctcacagtcacggaggcgtcacttggggcccgggctgggcctgtgctgcagctctcactggttcttgtcctcccacccaccagtctcagacgttcctctgtgttccatgcagagagctgtttttctttacttaactccattttacaaagtgactgtgatgaggggggtatttggagtctgagctgctgggcagttgcacttgtacgtgcagtggaagcctgggtggaccttcgctgcaaggggcacgccagccccgttggggtggtcccaacacgctgcctctcctcccaggagcaggcagccgagcgggagcacgagcgcgaggagttccagcaggagattcagaggctggaggggcagctccgccaggcggccaagccgcagccctggggccctcgcgacagccaggtgagtcagtgcagcgtgcagtgctgctggttgctgtctttcactgtgtttttaagctttaactttctttaaatttttgccttccatgtacatgaaatcggcagcaggcgccgctggatggagaggtgaggaggcgtcaacgagatgggcactccctgcgctggcgcccaggctcccctgcgctcgctgggactgtcctgccacccactcgcttttcttgctcttgtttgggctgcagccatctgctttctcttgtctgaggaagctgtagtaggttcgtttatttttttaaaaaattaatggtggattcacacacagttgtaagaggtaagactcggatccctcgtgcctggcacgtggttccccagaggtctcatccacagagccggaatgcagtgtcacagccagtatgggcagggatctggtgacgctgcagtgccttctgccccccacggaccctcgtgtactgggtcacggccatgccgccgtcctttctcgggcaaccactcatctgtcgtctatttctaaaactttaccatcttcctgatgggtgaagcgtgcctgtcatcttgggggattgacaccattcaccgagcctgactctctggagattgatccaggttactgagtgtagccatagtttgttctttatgttgctgagaagtattccattctttttttttctttttctttttttttttttttttgagttggagtctcatgcagttgcccaggctggagtgcagtggcgcgatctcagctcactgcaagctccacctcccgggttcacgccattctcctgcctcagcctcccgagtagctgggactacaggtgcccgccaccacaccccgctaattttttgtatttttagtagagacagggtttcactgtgttagccaggatggtctccatctcctgacctcgtgatctgcctgcctcagcctcccagagtgctgggattacaggcgtgagccaccgcgccggctgtagtattccattcttttctatcagaatagatttcattttcctaacaaattctgtattatagagaatgcctttcttaacacaacatcaccctatacttcctttagatctctgttcagcctctgggtctaggtctccctgtgcagcctgtgggtctgggtctctgttcagcctgtgagtctgggtctcttttcagcctgtgggtctaggtctccctgtgcagcctgtgggtctaggtctctgttcagcctgtgggtctgggtctctctgtgcagcctgtgggtctaggtctccctgtgcagtctttgcgtctgggtctccctgtgcagcctgtgagtctaggtctccctttgggtctaggggagggcatagggcatctattttgtctctgttgttttgggtacttttttgtttggaaaatgggtttttataaaacattctattgtattcctcaagcattttttgttgttttaggttgagttgttacaacaaaagttgagagaaaagttggatgaatttaatgaattggctatacagaaagagtcggcagatagacaagtgttaatgcaggaagaagaaattaaacgtctggaggagatgaacatcaacatcaggaaaaaagtggcccagctccaggaagaagtggaaaaacagaaaaacatcgtgaaagggctggaacaggtaaagcgtctccatgttgtggttgggcacgtggtgaggtgtcccgcaggcatggcttcatcgctgagctggcagggagtgggcagggcgtccttcttcactggcagccaccacgtctgcaccagaaacactggcgtcagggagaaacagaagtcattggtgacgggtagcaagagtactttgacctttctggagattgttgattttatttactgtagtaggatttatacaatttctttatgtctcaagaactctgaatttatccttaatatttcataaagtaaacatttaagattttaggtttaaaaaaatcttagcttattaaatactttgatgagagccccttgtaattgtttcaatctttgagctcaggaactcatgtcagctcccagtgaagagatctccagtgatggttttgcattgctggtgtttgccgtgttgtgtgtgttcgtttgtgtctgagagtttaaagaggggctggagcactgagccaggtgggccatctcatggctggagggggcagggctgcctgtctgcatttctgggtagcggctgtgccctccattgtgagcatttagctaaaaggaattcagctgacttctatgaggttaaaaggttacttgaaaagaggctcagtaagaaatttgattttagaattagtagtttggcctcagacacagatgagaggaggagtctttctcaggtgtgtctgattcttttttttttttttttttttttttgagacagagtcttgttctgtcacccaggctggagtgcagtggcgcaatctcggctcacagcaacctcctcctcccgggttcaagcgatctctcctaccttagcttcctgagtagctgggagcacaggcacgcgccaccacgcctggctaatttttgtatttttaatagagatggggtttcaccatgttggccaggctggtctcgaactactgacctcaggtgatctgcccgccttggcctctcaaagtgctggtattacaggcgtgaaccaccacgcccggccaagtgtgtctgattctcgtaagtgctgatgagaattattaaactggggcctttcctcaggccctgacgtgtttccgttccgctgtcgcagggaggaccgctgagcatcacctgcacttggagcggagttgtccccctggccggccactgcacacatttcagtgacagctgctccagggcggcttcaccccttctgccttcactcagcgaacgtttactgagcttagtagatgccagggttagaaaatgtgtttttatcccttcgtgaaatttggactgtgtatgcaattttatatgtcatgctcttgcgcatgtaacgtattgtgaccattttcgtcatattaaatattgtttgaaaaattttttctaggcaggtaatattcattatatgagcataccatcagccattgccctattttttttggcaagttcttgtcagttttgaaaatattggtaatagtttggtgaatattactgtagataaattcctcacagtggactcgggcacaggctgtggctctcagtcacgtcctgcaccaggcaggcctctgctgggaggtggctgggtcctgggtgccagtgttgcctggtgtgtcactgagtgcaggggcgtgcaggtccacctgctctgcttcaggtgcagctaaagatggtctgtgctttaacaggcagcagttgaggtactgaattcccaaatatttgcctaaaatagagttcttttttttttaataggataaagaggtgttaaagaaacagcagatgagtagcttgcttctggcgtccacgttgcagtctacactagatgcaggcagatgtcccgagcctccttcgggcagccctcctgagggtccagaaatacagttagaggtgacacagagagcactcctgcggcgcgagagcgaggtgagtgcagagtggggccatgggactgccagccctgggtcagtgtccagtgggcttctctgtggcagatccgatgtccagataacacaggcgatgggcttgtgaccactgtgtattcttttcttttcttttttttgttgttgtttgagacagagttttgctcttgttgcccaggctggagtgcaatggtgcagtctcggctcactgcaacctccgcctcctgggttcaagcgattctcctgcctcggcctcccgagtagctgggattacaggtgcacccaccgccacgcccggctcagttttggtatttttagtagagacagggtttcaccatgttggccaggctggtttccaactcctgacctcgggtgatctgcctgcttgagcctctcaaagtgctgggattacaggcgtgagcccatgcccagcctgaccactgtgtattctttgcagttttaccatttgtgtgcgggtacaggtacagggtagtaattgctttaggcatgtgcatttaaatatctcaaagctattttaataatgtcttaattattaatattaatagaatattagatgacttttaatacttttcttcttttgttttaatgaaaggttttggacttaaaagaacagctagaaaagatgaaaggtgacttagaaagtaaaaatgaagaaatactacatctgaacttaaaattggacatgcagaacagccagactgctgtcagcctcagagaacttgaggaagagaacacgagcttgaaggtaagctaccaaaggtccacgtgacgcccgagttcatgttgcttatgccggtgccgagcggccaccaagaccctcatcggggaggcgagtctctggtcttcacagacgcccgtggcccccatgtggcagacagtgcagagagcgcccgattctgcctggggacatgtgcatggaagcagctttctagggatcttgagtgaggaaccagcgacccctgccccaaactgctttctgattgcagcactgatagggatctgaggagaggcacttccctagggcagcaccccagggctgtgagaggcgtgaagctattgggctgttggtggcttgctcttctcaaggaggtgacttgagtaagtggctactcactgtttctcttcccactggcatgatgggaaaaaaatcttaagaacaaatttttttttaaatttttgtgagtacatagtaggtgtatattaaaaaatctatttttaaatcttttattttaatgtagccgtgcttttgaagcaaaaaagaaaaccaaaaccaacctgtttatagtagagatgatattcaaaattgcagagcattcataacttcacagatgcccttgaaagaccttgtgtagaatcgtgtgtgtggtgcccacacaacacgtgctcagtgaatgaacacagcgtgggagaattagtgtgtgtggtgcccacgcggcgcgtgctcggtgaatgaacacagcgtgggagaatcgtgtgtgtgtggtgcccacgcggcgcatgctcggtgaatgaacacagcgtgggagaattgtgtgtgtggtgcccacgcagcgcgtgctcggtgaatgaacacagcgtgggagaattgtgtgtgtgtggtgcccacgcggcgcgtgctcggtgaatgaacacagcgtgggagaattgtgtgtgtggtgcccacgcggcgcgtgattggtgaatgaacacagcgtgggagaattgtgtgtgtggtgcccacgcggcacgtgcttggtgaatgaacacagcgtgggagaattgtgtgtgtggtgcccacgcggcgtgtgctcggtgaatgaacacagcgtgggagaattgtgtgtgtgtggtgcccacgtggcacatgctcggtgagtgaacacagcgtgggagaatcgtgtgtgtgtggtgcccacgtggcacatgctcggtgaatgaacacagcgtgggagaatcgtgtgtgtgtggtgcccacgcggcacgtgcttggtgaatgaacacagcgtgggagaatagtgtgtgtttggtgcccacgcggcgcgtgctcggtgaatgaacacagcgtgggagaattgtgtgtgtggtgcccacgcggcacgtgctcggtgaatcaactcagcgtgggagaatcgtgtatgtgtggtgcccacgcggcgtgtgctcggtgaatgaacacagcgtgggagaattgtgtgtgtggtgcccacgcggcgcgtgctcggtgaatgaacacagcgtgggagaattgtgtgtgtggtgcccacgcggcgcgtgctcggtgaatgaacacagcgtgggagaattgtgtgtgtgtggtgcccacgtggcgcgtgctcggtgaatgaacacagcgtgggagaattgtgtgtgtggtgcccacgcggcgcgtgctcggtgaatgaacatagcgtgggagaattgtgtgtgtgtggtgcccacgtggcgcgtgctcggtgaatgaacacagcgtgggaatgctccctgagtgaacacagcgtgggagagtctcaaaaaacaacaacaataacaacaaaaaaaattttcaaattgattttccatttttccaatttaaaactgtaggcttatttaattaggacatttcatatctgtagggtcagtggaatatttccctattaaggttctgtcggctctgttttgatatggttgttgttattaccatttccaccggcatttctgcccaacaaagaagaggagatagtgcgtgtgaacgagcagctctaggcaccgcaggtttacctcggcgaggtacgccactccctggtgctgggggagaaggggctcttctcacgcttctggctacgcctgcgtctcctgtacgaagtcctcatagtttctgggtgtgattgactggggccttggctttccaggatgacagtcttctgtttcctcatacaatatttataatacttttcaaaattaattttatcagttgggcacggtggctcaaacgcctgtattctcagcactttgggagactgaggagggtgggttacttgagctcaggagttcgagaccagcctaaacaacatgggaaaaccccatctctactaaaaatacaaaaattagccaggcatggtgacacaccactccggagactgaggcaggagaatcacttgaacccaggagatggaggatgcagtgagctgtgattgtgccactgcactccagcctgggcaacaaagcaagaccctgtctcaaaaacaaaattaactttatggccgggcacagtggctctcacacctgtaatcccaggagtttgggaacctgaggtgggaggatcgtttgagcccaggaattcgagatcagcctggacaacgtaatgagacccatctctacaaatttttttaaaaaatttagccaggcatacacctatagtaccagctactctgaaggatgagataggaagatcacttgagcctgggaggccaaggccacagtgagctgtgatcatgccactgtaatccagctgtaatgacagaacaggaccctgcctaaaaaaaaataattttggaggggaccatagaagtaaggagaagtttgtctccagtttgtcacttttaatttccctttgacagaggctactgagatgttatctgtcttagtatctgattgtatcttgtatatttggcaaaaatttaaaaatagccttttgggttacattgaagaatgccttttatggccaggagcggtggctcacgcctgtaatcccagcactttgggaggcccaggcgggcagatcacttgagctcaggagttcgagaccagcctggccaacatggtgaaaccccgtctctactaaaaacacaaaagttagctgggcctggtggccggtgcctctaatggttacttgggaggctgaggcagaagaatcacttgaacccagaaggtggaggttggcagtgagccgagattgcgccactgcactgcagcctgggcgacagagcaagactcgtctcaaaaaaaaaagaatgcctttaaaaaccattgattacttttcagaagaagttgtattatttgtctatagtgctctagaacttgacctctaactataatcttatataatgaaaaatatataaaaaatagtttacatgttaaggacagtatttttgttccattaagaattgaaagctttttaaggacaatccccaatattttcttgtgggatttttcttacagatatgtgcaaattcgtacatccttcattttctgtaattctcctaattttttgtaaagatgcggatgctattttgctttatataataaagaaaagtaaaattccatttaaaggtttgactcttgttaggtttccagttatttcaaggaaaccacatttgctgtattctaccctattttatgtcagtgaagatgtttgtcttctagaagcgtcttttacacttgtggggaaacggagctcccgtctccctggcgtggtcgtggttgttgtcacttgttctgtactgccgtcctccggggctccagccatcctaacacctcatcctcaatgtgggccctccctccctgtgtggcttattctaactctggggttagtgatgtttctttaattttaccatttacttctcccttattctacaggttttaataaagaggtctcacgtcttttgttaaatttatccttaaatattttaggttttttgcactattgtaagtgagatttaaaataattatctagttgtttaccgtgaatacacatacaccttttgtatgttaaccttgctgttaccttgcacaatttatgtatattagtagcgttttgtggattcctgaaggctttttatgtataagataacatcatcttcagataaagacagttttatttctttccaatttttgttatttccttcttttattacaatgtctagcactcccagtacaaagttaaaactggctagggcagtcatctttgcccagctccttgtcttacagggaagtggtcagtgttttgccattaagtatattagctttaggtttttcacaggtgcctttttatcagatcaaggaagttctgttatatttctagtttgctttttctggatctattgaaatagtgatgatatttttctcttttattctactaataaggttaactttattgagtgatttatttcttggagattaaactaaccttgcggttctaggataaaccatacctggtagtgatgtactgcccttttcatatgttacagatattactgaatttgatttgctaatattttgttaatggtttttgcatctgtgttcatgagggatgttggtgcataattgtcttttcttgcagtgttccctaaggctttgtatgaaggttatgttagtctcataaaatagattgggaattttttcactttcttttctgaaagaggttatttaacatagctgggatttcttctttgaatgttttcatagcatcaacaatgaagccatttggagttttatatctagagagattgatggtaattaattttctttaacagactgaggtatttggatttctgtttcatgttgtgataagttgtatttttcaaggaacttgtgcatgtcatcaaaattgtcaaatttctttgcataaagaagtttatactttctctttttttttttttttttttgagacggagtcttgctccgtcacccaggctggagtgcaatggcgcgatctcggctccctgcaacctccgcctcccgggttcaagtgagtctcctgcctcagcctcccgagtagctgggactacaggcgcctgccaccaggcccggctaattatttttgtatttttagcacagacggggtttcaccgtgttagccaggatggtctcgatctcctgacctcgtgatccgcccgactcggcctcccaaagtgctgggattacaggcgtgagccaccgcgcccagtctatactttctcattttgtaactgttcaccttattaaccatttccttacttgccattgaatatctgcaggttttatgctgatggccctccttttattcctgatattagtgagttcgtgttttctcttttattcttgagtctgtctagctagtagtttatccatgttgtcagtgttttcaaagaatcagcttttggctctgatacttttctctctttatttctttgatttctcctcttattttcattattggcttccttctatttaccttgggtttattttctcttctttttctagctttttcagatagaaccttaggtcattgattatagatacttatttttcagtataacaatttaagttttttgtttttagacttcgtgcatagtaaaattagttttttttagtatacagttttataaattttgaaaaaaggatttagtcctgtaataatcaccacaatctcatcactcaaaaaattttctttgtgctgtttctttgtggccacccatcaggcctgctgtcttcctgtctggaattctgtttcgagtcaggtgttgtaatgcactggaaattgatgcatgctgtcgcctgtgtctgttcctttagttgctgagtactgttgtctggatggaccacagtttgttgatccattcacccatcgagggacatttggatagtttctaggttttggcagtgatgaatcgagccaccataaactttcatgcatagctttttgggagaaaataaatgttcacttctttcggttcagtacttaaactgaatgcatggctgattcatgtgtaagtatatatttaaccttaaaagaaactgtcaaactgttttctatagttgcactaccgttttacattccaccagcaatagatgagtgttccgggtaaccacgttctcatcaacatttggtaaggtcagtctttttttctagacattctggtagatatgtagtggtatatcctagagttttgtatttccttaatgactagtgatcttgagcatctttttctatgctatttgccatccatattgtgggggaaatgtttgcttaagtctttcagaaagtttttttttttttttttttttgagacagagtctcattctgtggcccaggctgcagtgcagcgggaacgtgtcagctcactgcaacctccacctcctgggttcaagcaattctcctgcctcaacctcctgagtagctgggattacaggcgccgccaccacacccagctaattttttaatgtttttagtagagacggggtttcatcacgttggccaggctggtctcgaactcttgacctctggtgacccacctgcctcggcttcccaaagtactgggattacaggcatgagccaccgtgccccacctcagaaagttttaaaaagttggattgttcggtttcttattgttttgggaattctttatatcttttgaacgcttttttttgatacatgatttgcaggtattttctcccaatgtatggctggtcttttcattctcttaacagtatgttttgcagagcaaaactttttacttttttttttttttttttgacagagtctctctctgttgcccaggctagagttcagtagcgcatttttggcttgctgcaacctccgcctcccaggctcaagcagtcctcctgtctcagcctcctgagtagctgggattacaggcacctgccactatgcccagctaatttttgtatttttagtagagacggggtttctccatgttggtcaggctggtctcgaacgcctaactcagaagatccgcctgccttggcctcccaaagtgttgggattacaggcgtgagccactgtgccccgccagattatacttttgaagttctgagagctctttccctagcccaattttcctgagaaatttcatagttttactttgcattcaggtctccttgaatatgcttgcatacgctttttgctttttatttttcttttttgacactatcttgctctgtcgcccaggctgcggtgcagtggcgcagtctcggcttaccgcaacctctgcctccagagtttaagtgattctcccacctcagcctcctgagtaggtggaactacaggtgcccacgcccggctaatttttgtatttttactagagaccagggtgcaccgtgtcggccaggctgatcttgaactcctgtgctcaagtgatctgcctgcctcagcctcccaaagtgctggggttacagacgtgagccaccgcgcccggcctcagttcactgatttcaggttttggtgttttacatttagagctaccttcgtatgctggctccagtattttaacgtgatatatgcgttgtgattatgaccgtcttcagtgcgcaccccttgattccagtttatttagtgcatttagggaatgagcagaagctgcgtataatcagaattgtcctcgaaattccttcgcgtgcctgtagagtacagagacaacggccggtgccgcacacagtaaggcacgcgacggggagcagaatgtgcagcgggcattcctagcccgcagctgggaggctgcttttgctaaatgcatggtgttgttcatcggtggtaaatgcataggaaggtgttgttgacagcgtccaaaccaaagccacaggttcatccggttcctttgttttttttctgtaggccagatttgcatttgagtccagagtaattgtgaggtagttccagagaaacctggagttgttatgaaaccctcagttttttggaagaacatattagtctataacaaatagttttaaaattgttagagcacaaatggattagaatttttctattttttgtcattaccaggaatgttatcttaagagaatagagtttggagctatattgacatacatctcaatcctaattttccacttactgtttttatgggtttagaaagatgtttaatatctcagtttcaattttcctgtctttaaagtggaaacaatcgtatttccttacatggctgaggattatgtttcatggcacaagtaaactcacttcgatgcctggtgtcaccgagtggcagtggcagagacgcctcatcaccagcgtcaccacgagcagtgttgggatggaaggggagcgtgcccggctcaccgctttgttggtgcagattctctgcctaggtttcttactttcctcctggagtcagaatgacacctaaaatctaatgcaccttcaggaaaatcaaacaaatcaaagttgtttaaatattaacaaaataacatttaaagggtggtgaaagcatcattctgtagatgtccttgcatggaaaatgactgcattagagcttcgtcccacgatcagacgtggagcacaaggtgtgcaccagggcccagtggcagccaaggtgggtgtggagtgcatccggcaccagcagtttgcttctatggctgctttgtttttcacgctatggagtcttcactccaagaatgcattcaggatgtaacgtgccctgaagtagggacattcggaagtggatacatttaatttgcctctgaaatgtcctctctcttcaggtcatatataccagaagttctgagattgaagagctgaaagccactattgaaaatctgcaagagaatcagaaacgattacaaaaggagaaagcagaggaaattgaacaactccatgaagtcattgagaagctgcagcacgagctgtccctcatggggcctgtggtgcacgaagtcagcgacagtcaggctggcagtctgcagagcgagctgctctgctcccaggccgggggccctcgtgggcaggccctacagggcgagctcgaggctgcgctggaagccaaggaggccctgagccggctgctggctgaccaggagcgcaggcacagccaggccctggaggccctgcagcagcgcctccagggcgcagaggaggctgcggagctacagctggctgagctggagcgcaatgtagccctcagggaggctgaggtcgaagacatggcctcccggatccaggagttcgaagcggccctgaaagcaaaggaagcgacgattgccgagagaaatttagaaatcgacgctctgaaccagcggaaggcggcccactctgccgagctggaggccgtcctgttggccttggcccgcatccgccgcgccctggagcagcagcccctggcagccggggcggcgcctcccgagctgcagtggctccgagcgcagtgtgcccgcctcagccgccagctgcaggtgctgcaccagcggttcctgaggtgccaggtggagctggacaggcggcaggcccgcagagccacagctcacacacgggtgcccggggcccacccacagcctcgcatggatggtggcgccaaggcccaggtcaccggcgacgtggaggcctcccatgatgctgctttggagccggttgtccctgacccacaggtgggctccccccgcgggccatggcagggtatttttttttactctccttttctcctttgatgtcaatgacttctctctgcgctgggcactgggggctgcagttgtcatggtggctcatgacacagcggagaaagggggcctgaagctcgggccagcctgggcctgttccgtgtcagtacgcagtgaagctgggctgaggatttcactgttttgtaccattttaagcttatcgttttaagcttttaaaaacaattctttctttcacataatagggactgtccagtgaaacggagctcactatgtgaggagggtccgcttaagctgcttctctggtttctaaccaaatggtttgtctgtcgatgagcagtgcctgtgtgagatgtggcgagcgagctcttcttttggagctggaggccctgtagggagtcgtcttttaaggcttccacttgtatttgagcagaaccttgggaacttggtgcctaccacccccacaccagctgggtctttgtagagtggctcccactctcagatgccccagtccaccttgctctgtggggtcgtcctgggtcggggcagctttctgctgggtcctcagccccgttcccatgtggcctgctgtggaccaaggtgctcggctgtggatgtcactgccacctccctctggcatccctgctggctgccgtactggttcccagctccaggccacctgaggggcagccccagcaacagcctcctgcatgctcagctttcctctgtctcctctgtcaagggtgatctgcagcctgtcctggtgacgttgaaggatgcacctctctgcaagcaagaaggcgtgatgtcagtgctcaccgtctgccagaggcagctgcagtcggagctgctcttggtgaaaaatgaaatgcgcctgagtctggaggacggcggcaaggtgtggggaggggggaaggcgcgaggtccccccgggagaggctggacacgcggcagcaaggtgtggggagcggggaaggcacgaggcccacccgggagaggctggacacgcggcagcaaggtgtggggagcggggaaggcacgaggcccacccgggagaggctggacacgcggcagcaaggtgtggggagcggggaaggcacgaggcccacccgggagaggctggacacgcagcagcaaggtgtggggagggggaaggcgtgaggcccccctgggagaggctggacacgcggcagcaaggtgtggggaacggggaaggcacgaggcccacccgggagaggctggacacgcggcagcaaggtgtggggaggggggaaggcgtgaggcccccctgggagaggctgggtgcagaacatgtgggtcttgccctgggcagaggcgggtattctgctgaggtgaggagcacagtccgtgcctgcagtgacatgttctctgaatcctttctgttctgtaacgagctgtccataactgttgtgaaatttcgtacgtgcttcatttaagccactctgtagaaacaatcagttgggtttttttcttgtaattgatccaaatggatttaactgtgctcgagggttagtcctggtttgtcttttcatgggaggaccacatcgcccccgtgggcctcacctcagctcaggactttgatggccagcgtctgttttactttgaaaggcctcagatttattcttgtaatctgttcacctcactccatattgtcacttgaaaaaaagctggcacttcttttccccggggaaggaggttgcaccttgaccatctcaaattgtagcagggtggagatttagcgagaaaagcgggtgctggtgcttctcccacccagtgcaccaggggcaggtccccagtgcccctaggaaacacctgcgcaggagctgccctctcctcaggccgcatcaggtgcagatggcacctttattttttttctctctttttttttttttttgagacagagtcttgctctgtcgcccaggctggagtgcagtggcacgatctcagctcactgcaacctctgcctcccgagttcaagtgattctgcagcctcagcctcccgagtagctgggactgcaggcatgcgccaccacacccagctgatttttgtatttttagtagagacggggtttcaccatgttggccaggctggtcttgaactcttgaccttaggtgatccaccctcctcagcctcccgaagtgctgggattacaggcgtgagccaccacgcccagccttagatggcaccttttgatgcactgtctgcacctcgcctcctccagtccaaggcccagcgcagcctccctggacacacagccacccacccttctcctccttctcctctgggacacacatctgtccaccctcctcctcctcctcctcctggacacagtcgcccaccctcctcctcctggacacacagccgcccactctcctcttcctcctccttctcgacacacaaccacccaccctgctcctcctcctcctcctcctggacatgcagccgcccaccctcctcctcctggacacgcagccgcccaccctgctcctcctcctcctcctggacacacagccgcccactctcctcctcctggacatgcagccacccaccctgctcctcctcctcctcctggacacacagctgcccacactcctcctcctggacacacagctgcccaccctcctcctcctggacacgcagccgcccaccctcctcctggacacacagccgcccactctcctcctcctggacatgcagccgcccaccctgctcctcctcctcctggacacacagacacctaccctcctcctgctggacacacagccacccaccctgctcttcctcctccccctcctccctgctgtttgctaaatgtgccccaactactcctccaggctctgaaacccagaggctctaacaccagaagtgctgggcaggtgttttatggtctctagggtggcacggaagcatgcttggtgctgaagcctgctgagacctgggctcacccgagcccctcgcagccctcgtgagtgtcccgcacgtcgctgggacgtttcttgcatgagtgcaggtgccgcctgttcctgggtccacactgcgtgcacctcattggcgtttagagcctgaaagattcttaattccacagaaatcagggaaggatgggcctaggcccgcagttctgaggagacccatgaacctggttcgtgtgcttgtcatgtgctctcgggaaatacatcctgtgtggagagcccttcgcatctcctgcggcaaacagtcttggggccctcatgacaggaacgtttctttgaattttttttttttttttttttttttttttttgagacagagtctcgctctgtcgcccaggctggagtgcagtggcgagatcttgagatcttggctcactgcaacctccacctcctgggttcaagcaattcactgcctcagcctcccgagtagctaggattacaggcacccgccaccatgcctggctaatttttgtatttttagtagagacagggtttcaccattttggccagggtggtctcgaactcctgacctcgtgatccacctgtctcagcctcccaaaatgctaggattacaggcgtgagccactgcacccggcccaattttttgaattcttaagagaaagctcagccctgcctgccaaattcttagaagttacacacacagaaactccaaattcatcacataaaccacaattttgtgttttcggtgctcagatatagaaccttcccatcctttttcccttgtatgaagcttgtgtcctcaatcaccgcagaaataggttatgacagttgccttttaagcaaggagatgtaagccttggttctgtttctcatagaattaaataaacttgaaatgtgcagggctcattgtggaatcacccgagtgctccgaaactccctgaaatccactcattaacaccagacaggtgcgactcctggtgagccaggtattccaccgtgcacctgttctgtttcacctgcagggtaaagaaaaagtactggaagattgtcagctgccgaaggtcgatctcgtagctcaggtgaaacagcttcaggaaaaactgaaccgtttgctgtattccatgaccttccagaatgtggatgctgccgacaccaaatctctgtggcccatggcctcagcacacctgttggagagcagctggagtgatgattcctgtgacggagaagagcctgacatatcaccccacatagacacatgtgatgccaatacagccacggggggtgtaactgatgttatcaaaaatcaggccatagacgcgtgtgatgccaatacaaccccagggggtgtaactgatgttatcaaaaattgggattccttgataccagatgaaatgccagattctcccattcaagaaaaatcagaatgtcaggacatgtctctttcttcaccgaccagcgtacttggtggctcccgccaccagagccacactgcagaggctgggccccggaagagcccggtcgggatgctggacctgtcttcctggagctcccctgaggtcctcaggaaggactggaccctggagccctggcccagcctccccgtgacaccccactcaggagccctgagcctgtgcagtgccgacacatccctgggggacagggcggacacctcgctgccacagacccaggggccggggctgctttgttccccaggcgtgtctgcagcagcgctggcactgcagtgggccgagtctccgccggctgacgaccaccatgtgcagaggacggctgtggtaggtgcctgctctgctcccaggcctgctgttcccgtgggaatgtggtctgcccggcgccacggcagctgccattgtttgttcacctcctgacagcacacacctcgcagtgctgtgtggggccagctctgcaggactggcatcatgggcgcatttagattatttcagttgttcaggtatttttaaaatgcctgagatgcatttgcctgcctcagacataccctgggcatgcttctccactgacgctgactccaacgggcatagcccagacacgtcttcgtgtgtgatgggcatagggttctttgtccagaatggttttttagatttatttttaggaatgcttcctttttttttttttttttttttttttgtgagatggagtctcgctctgtcacccaggctagagtgcagtgacgcaatctcggctcactgcagcctccgcctccccaggttcaagcaaatctcctgcctcagcctccctagtagctgggactacaggcacacgccaccacacccggctaatttttgtagtttagtagagacggggttttaccttattggtcaggctggtctcgaactcctgacctcatgatccacccacctcagcctcccaaagtgctgggcttacaggcgtgagccaccatgctcagccagaaatgcttcatatttttaacaggtttcacatatgctaattaattttaatttatgagttagatcgtattatttctaacataatcattttgggattttgtgtatcttgagtaagataaaattaaaaatcaggtatggttgggctcatgcttgtagtctcagcactttgggaggctgaggcgggaggattgcttgagcccaggaatttgagaccaggctgggtaacacggtgagaccctgtctctacaaaaaaaacacaaaaaattagctgggcgtgctggtgccgcccatggtccctgctcttcaggaggctgaggcaggaggatcacttgaccttgggaggttgaggatgcagtgagccaagattgaaccactgcactccagcctgggtgacagagtgagaccctccctcaaaaaataataatttagcagatacatattatctgaaacatccatatactatcatttcatgcaaaacaatttaaatctgaaatatttactattggctacattaaaatattcctaaagagctgtgggtgaatctgattaaattgttggaagcattcgacctgtgtgttcaccagttttgagttgtttcatctggggtctatgtgggaagataaattcaggcctttgaaagttttcacctggcaaagtcagcgctatgatgtaattactcattattttatgaccatttaaaaatctcttaacaggagaaagatgtcgaagattttatcacaacatcctttgattctcaagaaacattaagttcacctcctcctggattagaaggaaaagctgatagaagtgagaaaagtgagttggttatctttcatttttaattttttatttcagtggtttcctagcacagaatagtcaaaagaattcctgcatcctttgcctggttctgcgtctgccccccgctgacctccaccccggctctgcgctttgtcgggcgtgcacctggggcctcttgacttctgaaaacacgcctgtacctttcacagagccaaggttgctggcccgggccacgctccaccctggaatgttcaccctgatccaaggctggcatctcagctacagctacagaccttgctcagattcacccattgtcccagtagtgtcctttatggaaaagacaccccagctcacaggctgtgttcaggtgtctttggcaggatggagactggggcggtgcacgccatgtttccaggctctgctgccttgcctgcccaccctgcctttccctccccttggggtggacgtccctctctctgctgtgggtttcggggcaccggccctggagaggagccgaggggccgctgactgtggcgtgtcctcgcgatggtgcgtggggggctgcgtctccccggacctcgtggcgggaggtgcgtgggcttgacttgggcctttgtctgtgatggtgcctgccaggtttcctccacctccttctgtgggagatgcggagactgagtattctcttccctctcatgctcacgcccactggtctcagcctcccttggttgccctggcccgcatcagttgttgtggcggttacctgccacaccgtcctttttttcatttcataactttttctataattgttgtctttttacaagtcagtcaccttttgaggtgctctaactttttaaaaaatctgttggatttttcagcgatttagtgttttttgagaacatggtcacaatttaattagaaattttagtatttgcagagtagggccagcagctttttaattttgtttttatttatttgatgaatagtgagcacgcagggtgacagttatgggtgctgaggggaccgtttcctgagcagcctgtgtcccagctccccactcaggactgcagctccctggggatgccacattcaactctcagaaatgtcttctcgtatttgctttattttcaaactctatttgctgtttaaagtggcatcttcagccctcctagcccctcgccacacgccccttgctacacgaggtgcagtctgcacgccctgtgctgtcacagccaaggtttgcccttaaaggacgcgccccgtgttccagcagagccgctgggagcgtgcgtccccctcgagccacttttgtttttcttggctcagtttctcctgtgtgcttcactgctgtcctcgcacacagtgtccaggtgaatgtcatccaagccttccaagcacagcaggtgcttccccaacaactctcaggggctcccaggcggccccttgcccctcctcaacggtctcttatttaccgagacagggtcttgctctctcacgcaggctggagtgcagtggcgtagtctcgactcactgcagcctccacctcccgtactcaagtcatcctcccaccttagcctcccaaagtgctgggattacaggcatgagccactgcgcctggccagccccctcttttttaaggaaacatgtccccagaagcctctgtagaaaaggtgtctggtaggtgcttgtttttgagaacttcctcgtctccctggtggttgtcggttggttggctgggtgcagacacttgggttggaaggtatcgcgtgcctgtccactgcctctgtgcccgcgccctccagtgacgcacaacctttgaggggcctgcgcggtcagggtgtccgccgcctctgtgcctgcgccctccagtgacacgcgaccttggaggcctgcgcggtcggggtggaggatttcctcctcgttcgtccttcctccattcacgtatcctatgattttctctcttctttttgtaattcctgttattcaactatatcaggcctccaagattgattgtcaaattttctttccttatttctacttcttttatttttgttctcatttctaagaggttttctttagaactttatttttcaacatttgtgctgagtgttctgtttctgtgctcatattttaaatttctcagaaatctttcttatcctaactgttcctctctcctttagctttagctccttggtttctttcttttttggagggcgttcttgagtttattttgggcacagccaggtgagaggtccctgcacctgaaggaaggtgttgggctccgaggtgaagcatggtttgtgctgaaggcacagggtccagtgggacaatggggaatgtggtcttggacttgtggagctctgaccacccgctggcggcacctgctggctgtgatctcctctggatggagtgggctggggcatggtgctgggcacccatgtctcggtggcactgggtgacagtgtccgcagcagtcacatcccagagttcctggtacacgctgtgggagccgcagctcaggcagatgcaacatccttcaccctcagagatttctcaaacacctgaagtagatgatttccccaaagatttcttcgttgtcatctttagctgagatacacagggcagaagtaggacttggcaccattattagacacaaagatttgcaggcggtgggtggcctgaggcattttgaggggtacaggcagcaacccagcaccctgcacccttgcactgctcctgaggccttcatgctgctctctcggcacttgccgccactcacaaaaagcactttgttggttcattttgtgaatgacgtgcccgttatttctctgagggggtcatcgtcatcctctgaggttgtactctgcctgcatcgttggcctctactcctccccagtgtgccctctgctcagcaggctgtgccggggcatcatcccccaggtgcccaagtgctgcagcctccgctccccagggagctttgtccacacgggggccccgtctcgctggcatcctcatcctcctgttttgaagtctaacaccctttttccagggcgcctcctcctcgtctgggtctcgtgtcccttacacgatcctgcctcagtttccaaagcgcccccctccctgtgggctggcgcagctgcaggtctctgggatggaccagggccctgggaggttttgaattttcctccttgagaccccatgcccacctgacacaggagctgcaccgcagggaccccatggcaggcacggtcagcgtttcctgagcagtcattggatgcccgtccgctgcctgccttatctccgtggctggcgtggagggtgcaggccccgcacgtcccgctgctcttgagcttgcccaggccatctgggttttgtggagtctttgggggccacgtctggagaagtgagcagaggtcccctaagattggcgctggaatcagggactcaggtgatgttctcaacctgtgaagttgcgttttcttacttgacgtgcgtctttctcaccagggttatgtttttatgaagcatttttggggccatcagtgttttctccgtgagcagaatcacggtgtggttgtcgctggggactgcgggccgatcacccctgtcctgcctctgcagtgcgtcccctggggaaccccctggagagctgtgggtgggaccctgaccctgtggtgtttttaggtgacggctcgggttttggagcaagactgagcccggggtcaggaggccctgaggctcaaactgctggtcctgtgacccctgcttccatctctggaaggtttcagccgctgccggaagccatgaaggagaaggaagtgcgtccgaagcacgtgaaggtatggctggcaggggcggccctcacagcttcacatgtgcagcctcggggcatcccccaagccctgtgtcctgccttgccggggagagccttggagggccagcttttcctgggtgcctctgagcacctgcattttaatgactcacgggaggcagccccacggtggccccggaagccgcccacccagccctgcactggccccttaggtggccgcctcccatctgggcagggagggtcctgtgagcccgtgggcaggtggtgttgccccgagtcgcagagccggcctgtgcctctctcccgcctgtgcctccctcctgcctgtgccctgtagagaagccgaggcaccagacgccgcagtgctctaggactgagccgagttctcttcagacgatgggagagaagccactcagcctccttggaatcaaccttgaaggcagaattttgtggaacttttcataggttttctttcctctcccagtttagcagatcattttatggcaaaaccattgacaaaaacttggctaaacaagtgagtgatagaatgatgccactacaggagcttagtcaagtggtaaacatattcccaaacaaaacagtcttcacatcagtgaaacctcttctgagactgcgcagtaagtcctcacttagcgttgccccgaggttcctggaaactgaccttgtaggaaggacactcctgtgctgctggccgcagctcccgttgtctcagagggccctgagggtgcctttgttacatgcgtttaaaagtcgcggtttccaaaacccatccatgacgttaagtgaggacttactgcattcagaataaaacttgttttactttatttggctgggcacggtggctcatgcctatgatcccagcacttcgggaggctgagacaggaggatcgttggagcccaggagttcaagaccagcctgggcaacatagtaagacccctctctgtcagaactgagtcagttaaacctctttttttcattaaaataaaaaaacttattttactttcttaaacatggaaattggagattttttttttaatcagttttttatatcttctttgcatttcctttttttttttttggtgagacagagtctcactctgtcacccagcagtgcagtcacagctcactgcaacctctgcctcctgggctcaaacgatcctcccacctcagcctcccaagcagcttggattacaggcgtgagccaccacacccagctaatttttgtattttctgtaaagatggagtgttgccatgttacccaggctggtcttgagctcctgagctcaagtaatctgcccacctcagcctcccaaggtgctgggattacagtgtgagccacagcgcctggcctcaaatttttatacaatataaaacgtcaaggagatgtttctgttagtgtttcctatggaaaacaacctaatattagaattcctgatttttaaggaataaatttgattaatgttaactcttcatacttaggtttcataatttaaaaagaaaagcacaaaaggcaggaaaggcctcctgtagcccttgaggcagcagctgcgaagcagaggaggagggggagaggaggaggaagagaaggggagggggaggggaagaggggaggaggaggaagagaagggagggggatgaggagggggaggggaggaggaagagaagggggagtgggaggggaggagggggagggggaggggagaggggaggaggaggaagaggaggaactgctgtccagggagcacctccagctttgaaaggtcccaagtccagttgaaaatcacaaggagtttttttcatggatgtctcagactgtttcaaactcagggttttcctttattgtcttaatttctggcctgtgttttagagtgtggagccctggggttgtgcccacactgacgccgcagtggggaactgagtggagctgggtgcttgccccacttggaggtggctccaggcgcgtgggggacacccactgctcagatgcagccacagacgccaagagtgtggtcgacgctctaatagcccctgtggtccctatgctgaggaggctgagaggtcctgagcacgggtggggccccggccactcttggccacctctggccgtgcctggaattgagccataagtgggcagggtaggtgctggagctcaggaaatgaggactcccctgcctccgccgctgccaccaccaccactgctgacaggcagagccgcctggtcctgagtgtggagatggcagaaccttctcagccctagtgattgtgtctgtgggaccccccaggctgcctcacaggccatgttctaaggtacccactggtctctgccccacttcccggcctcacgggaacccacctgcaagggccccgtgtcacctggcgggaagctgtggcccagggcctctgcatctcttctttgtaagagatgttttttaaaatgcattttctcctctatacagaatctagaaaagcatattaaaaagaaggaaatggcctgtcctctgcagctggaagagaggggccaagcagcttcagggcctgcccgccgccctgctcccccggccctgctcccactgcgccccccccaaccctgctcccccagccacggccttgctccccccgtctccgctcctccccgcaccaccccgctcccctcaaccccaccctgctctgccgcagacctcagtttgcatccatcctgtgccacatacgttatgtttaaagtaaaagtgttttcagttgttagagatgaacatagtgtgcaatttggtttcacactttagtgttaatatttgaccttttttggcatatcgttaaaattacaggaaagcctattttcagtcagtcacacccgtcgtaggcttcatcattgcctcattttgcatttccctctttttggactttattagattatttttctcttcaggtttttatgcagacgtgtcctgtgcttgggtgtgtgctcatgtggtggtgaccgcgctgagcctctgggctctgggctctaggctggtcgtgacaccagcttctccatagggccgtctgcttacccctcagcctctctggcgagacagtcaagtgtgtgtccggacaccagctgctgcgtaatcggtgggataaagcagccgcctcgtgttcacagacctgtgggcagggcctgctggggatggttttctctgctccccgtgcccagcacaggcagcttcaccccacgctggtggtcggcactggcctcagccggaccacgcacagaggcctcctgggtggccatcgtgtggccttctcgtagcgtcccaggtgggcagggagtgtgtgatatgtttgtgatctcgctgtggacattggcctaaagccctgccctgagctttgtccaggcttaggcgggggacggtgtccccctcagggagcaggtggagtggaggaagtggcggggccatctttggagtggcttatagagaaattcactccaagcctggcttccgtgttgtctctctgaaggtcgggagaggtgggcttgaaaaccttgtagcttgagaagtgggtgccgcctgtacgaagccgaggcggtgccctccctctccacagctgcccgcccttcacagagtcctggcggcagctcggggccgcaggtggtgtagagcgtggctgtgtggggtggcaggcaactcccttctgacgcgctttcccgccacaggctttactgcagatggtgcgtgacgagagccaccagatcctggcgctgtcagaaggccttgcacccccaagcggcgagccacacccaccccggaaggaagacgagatacaggacatctcgctccatgggggaaagacgcaggtttattttgcccttcacacacttcttttccaaaggatttaaggagcttgtggtaatggccgcgtccttagggccacgtggacactaggatttctttctttttttttttttttttttttttttttgagactcggctcactgcaacctccaccaccccgggtcaagcagttctctgcctcagcctcccgagtagctgggattacaggtgcatgccaccatgcccagctaatttttgtatttttagtagagacgggctttcaccatcttagctaggctggtcttgaactccagaccttgtgatccacccgcctcagcctcccaaagtgctgggattacaggcatgagccaccgtgcctggcctaggattttttttagcacggccaaaaagactgaggtccaagaaccctggggaggccttcccatctcccacagccagcgcaggctctcggggcaggttccctgcgggacgtggaggtgtgtggggggcagaagggctcagggctttcaggcctgtgccctgtgtgagcctgcggggaggctgagagtggtccctcctggccatgtggccctgcggactcggcccattccagcacttgtcccccagggcctctcctcctgccactcgggtgacttgccctccggcctcattcctccccttgggtctctcctacctccccctccacaccccaagccccagcaactggacctcagggcctcacctctgtgctgtcgaccccgcaccccacttttccccaagtcctccccatctccctgcctgtctgcttccatcaccagggcttgtggaggttgtggagtgggtgccaactcccatcacgctccctcccatctccgtgcccaccctgtcctgcccctgtgcctgcctctgactgggatcaaagctttgtgagggagggaagggctttctccctgtgcctggaacgcacagggtgtgctggtgccatggagagccggtgggagggtcagccccacccgcctccgctcgcccctccagcaggccctggttgtgtgcgagcggcagcctggctggcattcaggaggctcattggtgctgcacgctgcccctggggaccagcgggtagccccttgcagccttaggtcccctccaggccctgggccttgaaggcacagcagcaggaaaagagggaaggagctttgctgacattttcctgaccttactttatcgtctttttcagtctcttctgtgctcatgatggcagcctttgcttctcgtgccttgaatggccctgggcagtgtgtgtcttctcttctgtcagggtcatttctgtttgaacggctgtcagtctgctcagctgccgtaacagaacaccccagaccagggggcttaaacagcagacattgatttcacctgttgtggcatcagggtgcccacagggttggattctggtgtaggcgcccttcctggtttgcggacagcgtctccgtgctgtgtcctcatatgatggagacagcgagtgagctctggtgtctcttcctcttcttaagaggcctcatttaccctgaatcacctcccgcaggccccatctccaaacgcagtcacactgcgaactttagggcacaaggatgcaggtgcatttgtgaggacgccacgtttcttccttcttcctttaggaagtgcccaccgcgtgccccgattggagaggggaccttctgcaggttgtgcaagaggcctttgaaaaagagcaggagatgcagggggttgagctgcagccccgactcagtggctcagatctggggggtcacagctccctgctcgaaaggctggagaagatcatccgtgagcaggtgagtgtcagctctgccaccaggcctcagtttgccccaggggtccagccctggcagagagggtgacacagactgttttgtgtgtgaatttcggtttgtgtgtttctctcgaccgctggaatgtggctgtcacttacccaggtgttgacgctcagtccatgcaggatgctgcacttttccacctgcagctgtaacaggacaggtgtgctcgagatgcaccctcaggcctcactcttttctgagataggtggctaaagaaacgttctccattccaagtagcccctcctaggttgagaggtgctctgtgtgcagggctgggtggcgttggtgccgtggggacactggaaatcctgttcctgccagcatacacgaggaaacctagtgttgagagtaactggcttgcaggcctcacgcagggtagtgcagcccagccctgacgcctgcaggccccagagctgaggcccagcagatactgtgcacccatcccagactcagcaggcttgtcccggcggagctggttttgagggcgggcagcagggaaggccggggcatggggtggctgcccaatgctcaggctgcttgtcccattgtgcccccagggagacctgcaggaaaagtccctggagcatcttcgcttgccggaccggagcagcctgctgtccgagatccaggcgctgcgtgcccagctgcgcatgacgcacctgcagaaccaggagaagctgcagcacttgcgcacggcgctgacaagcgcagaggcgcgcgggagccagcaggagcaccagctgcgcaggcagggtgggtgtcactgtctacactgcctggggcccggcctctgcacctgcccgcccgacactcacctgtgtggccttgggagcagagggtggtgacagggcatcatctagtcaagcccctgagtgttgccatggttgtcagctgataggactgagcagaaaggaccctggagacaggcagcgctgggtggggctggcacggaggcctcactcttgggcctgatgtgggcaagaggggcctgggttgggctctgagtgctggcagattcttgggagctcatgctagagttcaggaatgtctcgtaggtttctacatttaatttagcttcttcgggagtttttatgtagatgctcaggtcatctgtgggtaagtaacgattttttgtttcttgcccgtgttctctcacgtgctgtgccgtcagctgtgtgggcagatgccattccctgctcttagttttgggggcaggagctggtctcgtaccatcgcatgtggggtcaggcgcccttggtcagcttgggcaagtgccctctgttcctagttttggattccgtcaaggggaacggccttgcagttcagcccacggcccttgtcccggcgcccatgccctttgtgctctctggggctgggggccggcgctgtgcacatgctcgtgaggggcatgggtggggctggcgctgtgcaagcgcttgtcaggggcatgggcggggggtgccggcgctgtgcgagcgctcgtgagaggcatgggggggctggcgctgtgcacgtgctcgtgaggggcacgggcagggggtgccggcgctgtgcgagcgctcgtgaggggcatgggggggctggcgctgtgcacgtgctcgtgaggggcacaggggggccggcactgtgcgatcgctcgtgaggggcatgggggtggtgggccggtgctgtctgagtgctcgtgaggggcactggtctgttttctgttgtgcctttttggtcttggtgctgggtagcgccagccccacggggtgcgggaagtatttgggaagtagcccctccgccctccgttgtctagaattggggttatttcttccttaagttttgggagaattttccagtaaagccacctgggcctggagttccctctgttggaggcagtttagggtgtgagtgggggtgaggtggcatttttaggatggccccagggctatatcactcctggactctgtgtctcccggccaggtgggtgggccctggaaggaaatgggcccagagggcagaattgagcatcctggttccacccgcagtgaaagcttctagtccacagaacctcctttcttcccgaagcacatacacctcacgcccccacgagtctgtctctaacctggtgtcacttgtgcagcacgaggagctcatgggggcctgttactgttcttttgtctttctcagttgaactgctggcttataaagtagagcaggagaagtgcattgctggtgacttgcagaagacgctgagtgaagagcaagagaaggcaaacagcgtgcagaagctcctggcggcggagcagactgtagtgcgagatttgaagtccgacctctgtgagagcaggcagaagagcgaacagctgtcccggtccctctgcgaggtgcagcaggaggtcctccagctgaggtgcgcctgatcccccttcctgggacactggcgggagtccccccgttgtgccatgttttcttggtgatgaagggagacagaacctctggtgggccgcagttgggcagccccaggggcaccgcgccctgctgtccctgggttgataatcctgtggtggggggtgaagcacacgtgtgggacctggcagggctctgcctcccctcctggagctcccagcccccgggaacacactctggcccacgtggtcagattgttctgcgatgtctccacgcagatccatgctgagcagtaaggagaacgagctgaaggccgcgcttcaggagctggagagtgagcaggggaaggggcgtgccctgcagagccagctggaggaggagcagctgcggcacctgcagagggagagccagagtgccaaggccctggaggtaacagggtgtcagggcaaggcagccggcatgggctgtgtgcactggaagcctgaagccatgctcctctttcatccttcttttcctgttcttcatggcagtgcacccagttgacagcagtgtgacgtagcaggatagggctgtgtttgcaggtaaaattgcaccttggtgtagtggcagccaccacagggcgaagagtgcgatgacccgtggtggcacgatacccctgctcggagcccccccccgtccctgagcacttgctgtggagatggacacagcctcctcgctggcatccagacagagcacagcctcagaggtctgtgcacaaggcaggctggtggtggggcctctgctttgcatggcggaggcccagcaggcctgctgtggcttctgagcaagtctgtgccagttccatgggttatggctttcaacagcatggaagtggtggttcctagcaagctgggtgtgtatctctgagcctctggtggagtgattttctgaagagggggcaggagcctctggtggagtgattttctgaagagggggcaggagcctctggtggagtgattttctggagagggggcgggcaggggacatctctgaatcattttctggagagggacagactgggaacatctctgaacccaggactcaacaccatttccgaaaaaagtatgtcatctccgcagtctgggttttttgttacttgatgaactaacaaaaaaatgttgtccctacatgtggctaatagggtgcatttcaaaaggtagaattgctgggctaaagtatataaacaaatgtggacaggaaaaccatgtagacacttttcctcttgattcagtgtctcccatcgtatgtgtttgctgtctaggagctgcgggcgtctttggagacacagcgtgctcagagcagtcgactctgcgtggcactgaaacacgagcagacggccaaggacaacctgcagaaggagctgcgtatcgagcactcacgctgcgaggccttgctggctcaggagcggagccagctctctgagctccagaaggaccttgcggctgagaagagccgcaccctggagctgtcagaggccttgcggcacgagcggctcctgaccgagcagctgagccagaggacacaggaggcttgcgtgcaccaggacacacaggcccatcacgctctgctgcagaagctgaaggaggagaagtcccgggtggtggacttgcaagcgatgcttgaaaaggtgcagcagcaagccctgcattctcagcagcagcttgaggctgaggctcagaagcactgtgaggcgctcaggagagagaaggaggtaagtgccacactgaagtcgacggtggaagccctgcacacccaaaaacgagagctgagatgctctctggagagagagagggagaaaccagcgtggttgcaggcagaattagagcagtcacacccacggttgaaagagcaagaaggacgcaaggctgcgaggaggagcgcggaggccaggcagagcccagcggctgcggagcagtggaggaagtggcagagagacaaggagaagctggtgagagccgcctgccggcggacgtccacacctaaaaacgataagcaattggagttaggatggttcacgtgggggacgcgagatttatgtctggccctctgacctggtctgctctggtctgtgtgccctgacgctggcaccacactgctgttactgtagctttctagaaagtattgaaatcaggaagtgtgagttctccaacttcgttcttcctcttcaagatagtttcagctctgtggggcttcttgctattccacaggaatttgaggattggtgtttgtatttctgcagaacctgccactgggattttcttagggatggcattaaatgtgctgattgctctgggtagtattgacatctggacagtgtgaggtcttttgatccacgattacagaatgtgtctcttcatttaattaggatttttttgagatagggtctggctctgtcacccaggctggagtgcagtgatgtgatctcagctcactgcagtcgccgcctcctgggttcaagcaattcttctgcctcagcctcccacgtagctgggactgcaggcacatgccaccacgcctggctaatttttggattagtagagacagggttttccatgttggccaggctggtctcaaacttctgacctcaggtgatccgcccgcctgggcctctcagactgctgggattacaggcgtcagccaccacactcggctgtttacttaggccttctttagtttctttcagtagtgtttcattgctttcaaaatataagttttatacttttgttaaatttatttacttatttattttttgagatggagtctcattccgtcactcaggctggagtgcagtggcacgaactcaacaatgttgaatagaagggatgagagcaggccgggcacggtggccgatgcctgtaatcccagcactttgggaggccaaggcaggcagatcatttgaggtcaggagttcaagaccagcctggccaacaaggcgaaagcccatttctactaaaaatacaaaaaattagccgggcatggtagtgtgcacctgtaatcccagctattcgggaggctggggcaggagaattgcttgaacccgcaaggcggaggttgcagtgagccgggattgcaccgctgcacttcagcctgggcaacaagagcgagactccatctcaaaaaaacaaaaacactctttggaatagtcgtagttttttttatctccagaagccttggagagtagggaggtggtttggtggtacagacagtgtggccaagcatggcaggggcgtctacacaggaccccagctgagggtgagacgtggtgtgtgtgtttgcctttctcctgggcaagagctcatcctttgatggaatgctcaaaggagtctttactttttgagaacttcctgaaaccacgcctgaagttgccagccaaaacctttaattttgattgtttcttaaaaaaaatagtaacatgagtgcttagaaaatattttctaagttgcttgcttcaggatgcatcttgacctgtattttgagtgaggtggcccttccagagtgatttatttattaattttttttttgaggtagagtctcgctctgtcttccaagctggagtgcaatggcacgatcttggctcactgcaacctccacctcccgggttcaagtgattctcctgcctcagcctcctgagtagctgggattacaggtgcatgtcaccacgcccagcccagctaatttttgtatttttagtagagacggggttttaccacattggtcaggctggtcttgaactcctgaccttgtgattgatccgcccaccttggcctcccaaagtgctggattacaggcgtgagccactgtgcccggcctccagagtgttttttactgaggatagtgaatttgatctggattatagaacccttctctagctgtagccatggaagcctcccaagatagtggcatgctggatacaattccatcttttctaaataatacaatctcattagttcctctgtatcttactttccttactagaaaatagaaaagatactcattcctgtttaagaggcccgagcattgagtgaggcgctgtcaggagggtagagtctgagctgcaccctggtcaccgcagtggcaggggcgctggtgccacacagtgcaggctcagctgtgggtcctctgggctgggaaggcctcagctcagtgctggggttccctccctgacacggcaagccgcctctgtgtgtctgcatcttgggcctcttcccgctggatctgtctttgtgttgtcacaaggaagccccagcggcgctgctgggaatcagaggcccttcagaggctgcttcgtccttccttgccccatcgtgcagtagaccttctgtcccctgcctggtgggagtcgggccctgggcaggggctcaggcgcttgctgacacgcttctcccgggcaccagacatggcctgtgcccccgtcctgcagaaggaaaggctgctgctccttgaggtctggcttaggagctcaggcccacgtggccacccaggctcagccccagggctgcactcaggctcatacgtgtgtgcatgttcacatgcacaaatgtgcctgtctgtgtctatgttggtatgagcgtctgggcgtgtgcgtgtacatatgtggatgagtgggaccagggcacagggaagcgtcatccggtctgttctgtttcagcttctcaggctcctctcctttggaccccgcgtgcttgccctgggcctgatgaaagcctgatagttttaaaaactacgatggaaacgcttttaccactgaatcattctggggtgtgtgattcagctgcctccatgctggagggacacagagcagcacagcacgagggtgtgcagtgtgtcagctgtgggtcccagtacaggaccacaggggctgcctgcccgagggcctgtttctggtctgtgaggggcctcccctgtaacgcggctgtgtgttttgggcttttgcttggcagttgttgttttttttgttttggtttggttttttttggtagatggagtctcactctgtcgccaggctggagtgcagtggcgcaatctcagctcactgtaacctctaccttctaggttcaagtgattctcctgcctcagcctcccgagtagctgggattacaggtgcgcaccaccacgcccagctaatttttatatttttagtagagacggggtttcctcatgttggccagactggtctcgaactcctgacctcaggtgatccgcttgctgcagtctcccaaagtgctgggattacaggcgtgagccaccacaccctgctggcagttttgtgttttgttttgttttgttttgtttgagatggagtctcactctgttgtccaggctgaagtgcagtggcgcaatctcggctcactgcaagctctgcctcccgggttcacgccattctcctgcctcatcctctcgagtagctgggactacaggcgcccgccaccacgcccggctaattttttgtatttttagtagaggtggggtttcactgtgttggccagcatggtctcaatctcctgacctcatgatctgcccgcctcggcctcccaaagtgctaggattacaggcatgaaccaccgcgcccggccggcagttttgtttttggacactgacgtgaacgtcttctctgtcttttttctgttaacaacagcgagaattagaactgcagcgtcagcgtgacttgcataagatcaagcagcttcagcagacagtgagagacctggagtcgaaggacgaggtgcctggcagccgcctccacctaggttctgcccgcagggctgccggctcggatgcggaccacctccgggaacagcagcgagagctggaggcgatgaggcagcggctgctctctgccgcccggcttctcaccagcttcaccagccaggccgtggacaggtgtgcacccacgccacctggcgctcactggtcccttgcagccacccctctgtcccagacccggcccgagggctggggcgcgtctggtgtgaggcccctgctcctttgcacttaacgctctagtcctctttctgagactttgctgagggattccggattggcaagatggcatgttcatattctaatgtcagagaaaaaaatcctgtgattcaaaatacgcctgacgtggggcttccatgttcctttgagggttggcttggttctctttacactctgtgtagttgctcaccacccacagggtcgggtttggagcctcctgtggccccccccccccccccccgctggcactgcccagtgtcactcaaggccactcacacccaggatgacgatcgtgatatttcatatgggcagaaagggtaatgctaatgtttgtctttttccctatacacagaaactcggcaaacacagttctcctttctatacttggacttaatgtatagagcagcatgatttctaagcaaagtttcacttaggacagcattttaaatcattcattccagaggaaagccacggggcctggcaggcggtggcttcccgtgctcggtggcgcgcctcccggctggaggtttctgagctctgcagaagcgtccagccacaggcctgttgcccccgtgggcccctggctctgcctcacggctggacgaagtgattcacacacaggctcctcagaaacctgtcttgtctctcttgagccgtgagctcttgtttagttttgcataatggtcacttggggcgcgtatgcaactttgagtgcccatttatttttacaggacagttaatgattggacgtcatccaatgagaaagcagtgatgtctttactgcacacgttggaggagctgaagtctgacttgagcaggcccacctcctcccaggtaaggggtgagcgcccccaggtccctggcctggctcctcccccagaggggccctctcggcagctttgtggttctttttcacgcttccccattgttcttcctccctcgctgccttctctgaattcatggttgctatctgggtgagtgggtggggtcgaccctgtgggccgagtggggacggatgtcctccatgtcctggggcacttgtgtggtcttcgggggctgagccctgctgccatgggatgctgtgtgactgtgtggtcttcgggggctgagccctgctgccatgggatgctgcgtgactggtagagccccctcacatgctgctcgctgtgcatgacctggacacattgcaggtcgctggtcaggaggggctatggttctgctctggtgctggcggccgatgttcacctccacctggcccagcctgctggctttgtgtttgcgttgacggcctttgctagaaacaaaaacccaagtcctccttggaaagtctgagctcactgtaagctgcctctgaaggaggtgggaatctggctgctggtataaattcttgatgtgtgttctgtggcatttatgaaatcatgactttgatcgtggagcccacgcatgtgaggtgcaggggagctgcgccgcttaccctctggccccgccagctgaacgtcgttgtgggtggggtgcaccctgccccctgtgttgggccctggtgacctttcagcgtgcccaccctccacaggctgaacgtccttttgatggtggaagtaataaacctgttttgaggggcttcacatccgcccccttgggatgaactaacaacggtccagccacctgttaatttcagtgctgttagaacaaccaaacgggctatgctttgtgacaggcctgcgttgttcatacaagccagttgcgtgcaaagtctgtgattcaatgacttttacaattttctgccagctccacaagcttctcattgaaccccagacacattaattacaatccctaaaaataactgttgacaaaaaacacaagtaatgttcatgccctttaacaacaaattcttacaaatttattttcttttctccaagaaaaaaatggcagcagagctgcagttccagtttgtggacgtcctgctgaaagacaatgtttccctcacaaaagcgctcagcacggtgacccaggagaagctggagctgagcagagccgtgtctaagcttgagaagttgctgaagcaccatctgcagaagggctgcagcccaagcgtaggtgtctgtgcttaactcttacctgcctcagcctaacccaccatggtccagagcagctccaccccacaagaggccgggctccctttagggacctggggatgtgggcgtcaccttctccctaaccgccaggctctgttgcctctgtctgaagccttgctaaatgttgtgggatgtttgaacatctcagccgacttccagctccgccacagacggcgtcctcactgaccctgaccgctacttgatgtttggtgcatgttcataaaagggtattttgactaagaatattataatctgatctaatttagagttttagttaaagtgatttataatttttttttttttttttttttgagaccgagtcttgctctgttgcccaggctagagtgcagtggtgcgatctcagctcactgcaacctccacctcccaggttcaagcaattctcctgtgtcagcctcccaagtagctgagattacaagtgcccgccaccacacatggctaatttttatatttttagtagagatggggttttgccatgttggccaggctggtctcaaaatcctgacgtgattccgcccacctcagcctcccaaagtgctgggattacagacatgagccaccgtgcccggcctaaagtgacttataattttcataatggtatagttggatagagttatcttccggaatgtctcatttttttttcttttgtatttaggctattttgtttgtgatttgctttattttttataactttttaaaaattatttttaaatttacatacagtaaaatttgccctttcctggtgtagtgtcatacaagttcacacacacacacatccctgtaaccttcataagtaaccaccattcacagagcacacagcgatggcccccccaaaaagagcagcaggcatctccgcctgccacaggccctggctctctcccagaaaggtgtgtcagtggaaccagcccgtctgggacctcctaaactggcttttttcactttttgggttttttttctgagacagggccttgctgcatctcccaggctggagtgcagtggagcagtcacagctcacttcagccttgacctcccaggttcagggatcctcctgcctcagcctcctgacctgcagtggtgtcagcagcaacctgtgcacgtcctcccgtacactcttaagtcatctctaagatcacttgcagcacctcattcagtgtaaatgccacgtaaatagttgtcatcctgtattgtttagggtgtaggggcaagaaaagaagcacacgtttggtacagacacatcgttttttctgaatatttttcacccacagttggttgaatccatggatgtggaacccacagctgtcgagagttgactgtgcttgtagttaccagtggttggcatttctaggaccggagaatatgagagtgtttaaggcttaaagctttgaatttggggtgattttacaaagaattggttttctgtttctgttaaaatgtaccttttttgcaatcatacttcagcaagtggcatgtcgtaattactccatgttaattctttggctgatcacagcacggcgtaacctaggccctgctgagggggtgctgaagttgaggaggggccaggtgtggtgtggtcagcctggcctccccgcacatggccttctccctcacctgcccccggctgcgtctctaagatgctcttgttgacgagcagctctgtagacagcgctggctgtgcttccttacagaggtcggaaaggtctgcttggaagccagacgaaacggctccacagagttccctgaggcgcccagaccccggccggcttccaccagctgccagcgaggaagcacacaccagcaatgtcaaggtaggaacggtgccacgagtatagaactttggtgcttttttaagtcctgggtttgcaaattgcaggcaaagcatttttgtgaccacaaggttctcgtctgccgggtgtagcagtcacatcactaaaggaaaggacgttcacagaataaacttcggcttgaattttgttttaattgtgcacaaatactgagtttctgtgcttgttaagcgtggaacgtggaaggctttgacaaagtcagcaaatggcggcctctgcagcctgagggaggcctggcccaggggcttgccgggattcggcccaagatctgctgcagtctcctgatggcacacggtccccaccccgtgacgtccatctcatgcccagtttggaccttacctaaggggtgaaatgcaagaagcttcataggggctcatttgatgatgctgtggagaggagcttgtggtcctagatcttgtctgacaaacacaaattgatcttccaacagcaaggttgtttctggccacagatactgttggaaggccgatggctctgtgatgatttgatgggaaaaaacaatctgactctttggaaagagcaatggtgttaatgtgcttttgtcagcaagacagtctttgtttcctatgataaaattttactgctttttttcttttagatggaaaaattgtacctgcattacttgagagcagagagctttagaaaagctctgatttatcaaaagaagtatcttttgctgttgattggtggattccaggattctgaacaagaaacactctccatgattgcccatttgggggtatttccttccaaagcagaacggaaaatcacatctcgtcctttcaccaggttccgcacggccgtcagggtggtcattgcaatattaaggtaaatgccatgacgttcagtcagtgcgttccgcgtctgtctccgtgagtgggcagcacactgcatggttttttggtcattttattccttgaaactccataatatgttctttttaaagatgaatggcatttgaggccttagagaaaatacagatgatgaacttgtcttcaagaagtcatgtgtatgaatctctcaccttctaaaactaaagatttaagggcacctttgtattacagaggaacatcttgacttttaatgggtttcgtgccacaaagaacgtgctgaatttctaaaactgtttttccccctaaacactgtgcggctgtgcctgctccctgatgccacagaggtgtttcccaaggccacgcgcgggcctgtctggagtagcagatgcagcagagagcagctaggaatcccgctcctttcagagaccaggtgccgagccagttcagtcatcgcggctgcaggctgggccaaagtggggtgcaggcgaggcctcctgggttgctgtactctcagcttctctggtcctggggcactttgtctcctcgtctctgagctcccctgaccgtaggcctccaccgtccatccttccacccacccatctgtccatcctgtgttcatggggagaacaccctgcaggaggaagcattttaggcactagataggggaggtaagcagacccagatcctacctcctgtcgaggaggggagatcttttgaaggcagtggtgtcccagaaaggagcagtctctgtgtccctgtgagggcactgcctagggtagctgccaccaaggggccttgacaggtcttatggaggaatcggcagtgtctgctatgcctcaaaggagggaagccacaggcatgatgcttgttccgaaggccatcctagcagggcgtctggggccctgcacactgacctgcatgccctcgtcacctgcactctgcatgctcaccatctgacggactcctgcgagggctggggtctccgtgttctgagcctgtccagtggcatctgtgacaggatgaagatgggagggtcctgcacaccaggcgggagcggcatgtgtttcctagtcactggtgtggccggctgactttgaactggagtcgtcctgagctgggccatggtgggtgtctaggggaccatatggtccacggtggggccgcagtgaggctttgtcaggtggttgggcatgggaaggtcgccgccgccggcagccctgcgagcactttggatgtgtgcacccggcatgccaggcccgagtcaacagactggccgaccttggcgtcctggtccccatgggcagcgaggcccccattctgcttgtttggtcacagtggggttttcattgctctttcccttcctgtcttgccgtacttttaagtgtgtcttgtctcttttttttgtagattacgttttttggttaagaaatggcaagaagtagatcggaaaggagctctggcacaaggcaaagcccctcgcccaggtgggactccagctgctgttgaccgctggactcacaaacctttctttctactcttgtttttcattcactttgggtcatttttcagtgttgatggggacgtaataaagcacggtaagaaaatccgtgaattccgtcagagcagtcgtccagagggaaggcgcgcccggcgtagggaggtcagagctcatgttagctatgaacacaggtcacaggggcgtacggcgatgggaaacactgagatgctcaatatattgattatttaatagtgtttagcaaaatggtctttttttattccttaaatcaactgaaactcacttcacgtctctttccttgtagagcatcatgcttatttctggctcactcacatctttgtctcgggagttctctgccgagccattgccccctacagcagagagcacagctggctgcactagtgctgaaggagccagccccagagcagggcatttccaggggctcttgtcccagagcggcaggcgttgtgtgcagagaacgcccctcccacgcagcacagagaacgcggggtgggtgtgtggctccgggcctgtggggcttaggctgcctgaaccaccgccgactggcaccatgactcggcattcctggaagtgccttaccaagttgttgttgttgttttgttgttttttaagagacgggcttgctctatcatccaggctcgagtgcaatggcacagtcacagctcactgcagccttgaactcgtgggctcaagccatcctcctgtgtcagcctccccagtacctgggactgtgggcatgagcactgcgcctggcagctgtatcagtgttgactccacattttaatagttgcttcttgaaattaaaatgctttgattcagccttcaagccatcaggaaagtttgcccctctgagtcacacctggtggtctccagggttcctgcccctccctcctgagccagctcctcagagcggatagaggcaggacccccacccaggtcttgagacccccctgccccgcactcccccggagacgggctacccctgcagatgcagatagtcaaagctcaggtttcttccaaagcttttaaaaagatattgtaccttgagcactttaaaaatgtcttaaaattgccatacaggctcttaaaagcttatacgtttaaactgttgatagatgggcctttactaaaatgcattcatttattttcctaatcccttggttgttaaataattctggggaagggccccgagcacgacagccgcagtctccacccagaaccagagagtcccccccaacccgggatgtaccctctggccacaccagggaccctgccagaggccgcagactggcagcagcagcctccccacacagtgggggaaggtcagtgtgatgccttcaggccccgtctcctgccagggctctccctccagcctacatagggcctcagagaaatgcatttttagttctggctttggcccagcccagggcaaggcaggaaactctccagcgtgagtccgtgagggccaagaagtcccgccctgttctgggggaggacctggcttttctggtgtctctggtgcccgagagcccggtgctgccatctttagtgaaagagtaaatggtggccgagggctccttttgtgagggatgtgccttggtgaagaaggcatgttccctgccgtgaagatacttggaagctctgggtggagagggaaaagggatacccctggtgctccctgggcctggcggaaggctaggaggaaggacagctgaggtgaggactgagtggggcaggtatcaccctgacaaacagtttgggaagatcaggaaaggcaggtgagacctggtgcagaatccaggttgggtaatagatacatcgtcgaagatgtagcaagcaaagtaatatactcaactctggaacattgcacagaagcttttaaagcactctgtgacactttttgtaatgagggatctgaaggaaacggccccagagtcacccatccccacgggtctggttggcggggctggtgcctttcttctgcactcagtcaccatggctccgtctgtcaaactcaactctttttttttttttttttcttctcttggtgtggtaatttgtttgaagagccactccatccccaaattcaagattagaaagatccctgactgcttctcaagatccagaacattccttgacagagtatattcaccatttagaagtgatccagcaaagattgggaggggtactaccaggtaatgcaagtcctcgccgagtatttattaagctgattatcactgtaccctggaaacgtagggtctgttgaaagatggctggtattcagcttagtaaccaaagtttcagtctgaacaatcagtgtcactaatagtattagaatagaggctacaagtgaagaatctcacagaagtctaagccagtgtactcagtgatacgtgctgaggtcagtttgacttaatcaccgtctggacttttttgtcctttctcttacattgatagcgaacataaagattatatttcgaccaggatataatttgttcagtgtttcttaaatatcataatttaaaccactgtataattcatatttttaccaaaatttacatgaattcagtgatagtgtttcaaaattgtggaattcttttcaaaaaatctgtgaagccttgtaaccaatttgctgcctcatttttatttatatgcagattctacttcaaagaaatcctgccacccgatgattaaacagtgaataaaatgtcatggctctttcctgcgacaattctatttgaggaaaagatttgtttttcccttttcccaaggaagctcgtgggacagcatgggcactactcttcatgtgcggtgacaccagcccccagatgccttgaattaagtgtcctcacctttatgcatgactgcaaagccagctggagcattttctatggagcctccgtatgttttaggcccatgaccttcgtgaggtgacgggcactcactcccatgagccctggctgtgtgctgttgtgtgcctatcggcagatccatccttcctgcctccaaggaggatacacagagaatggcttcctgttgttttgtttattttcttaacgtgtacagatggaaacttcatttaaaaataaaaacaaaacaactcaaaaaggaataaaatttaatcactgttttgtttgtgaata

SEQ ID NO: 1667 - DNA, 36025 bp, Homo sapiens
tgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaacagtggtcctatctgagtggtgccattatgggtgacttttttactcctttatatttctcaaaagttttacgagcacacaagcctttgaaatcagaaaaaaacattgtctaaatttttttttaaagcctaatttctcatgctactcactgtcctcctcctcaacgtccaccccgagccacctcccctggaacttggggtccatgtaagtacttgccctaggagaggcatcctccgtgcccagcccggggcaccctgccaaggcccagcgatggccccccaaccattcttccacctgtcccatactcagatccttctggccttgggccccacgcatgctgcttctccagggccgcatggcccttctcaggcttcgaagtactttgaacctttgagcactttgaactcccatcaccccagctgcctatacaagacctttctggaaggcagagcctcaaaaacatgcagaccctttgaaccagcaacctcacctctaggaactgagcccaaggaaatagcagggttgtgggcagccattgagttacagcaatagccgtgagacaatggaagtagccttcatgtccagctgtgggggactgattaagtacacgtgcacattggccgggcgcagtgactcacgcctgtaatcccagcgctttgggaggccaaggcgggtggatcacgagatcaggagatcgagaccatcctggctaacatggtgaaaccccgtctctactaaaagtacaaaaaaaaattagccgggtgtggtggggggcacctgtagtcccagctacttgggaggctgaggcaggagaatgacgtggactaaggaggtggagcttgcagtgagccgagatcgcgccactgcactccagcctgggcgacagagcgagactccttctcaaaaaaaaaaaaaaaaaaaaaaagtacacatgcacatccacatccacagcagagagtgccatgcagccgccgccaaaattcaggcaggagctcatctgtcttccacttaggactggagtccccagaggatgtagaccaggggataggggtaaggtgtatttgtaccccaaggcgcagggccaggcctggtgccaggaggccacccagtgattgtggaacaaacagcaatgctgaaagatcttactgaccaggtgctattctgggccacacaccatgacctagagaaaccttaagaatcctcaggcgaaccccattttatagatgaggaaactgaggtgcaaggagtcagtcacgtgaccaagtgacaccctcgggatgaggcctgagggcctggaataccagccccacatcggctgcagacacggccttcccacttcagctccctctgctctggcacactcccacaccccaacatccagccttcaggcaaggtgaggccctggcagctcctggcaggctcaggggcccagtggccagccctctgcagagagagaagggcttgggcctgcggagaggggtttggagaggcctctgacctccgagggggaggtggagagccggggtcaggagccctgggagtttcccctgctgcacccacccaacctgcccctctctggaccagacctgccatgcagagtcaaggactccggggagctctgggtgcagcctccaggacccccaggtgtgagaggacagggacatcccctgcttcatggctcactgcctgctagaaagtgcagaaggcagctcttgacatgatttatggcactggggagatttcataaactccaccagccgcagagaaggcggggaggctccgcagttgctggaagggagtgccctagctgccagccaagcctgggctccctgcagggccacagggacagtggggatccccagggagggtgtgatcctggggagccccttcccctgagcctcaggcccttcctctagaaaatggggcagattcctgggaacctgggacctcctgggtccaagtctcagccccgtgcccctgcctgccctgaggtcccgccagtagacaggcatacccagtgcctgctcacacacactggcacactgccagggccccagacacgtgagccaaagccttggggacattgaggtgcgtgtctggcacaactctgctcgtagcttctctggtgacctgtttgtcctgtgcgtgaggacaggagccactctcttgcattttcccagccgcggtcctaatcagaggaaacagagtcgaggaggaggatgggccaggatggcagcgcccgcccagagaggggtgcaaaggagagattaagagggatagagtcgcaaactgaagagccaacaatgggcagcagggccaggcctggccttgccgagggattagtctgtgtgtctgaggccgccgctgctcttgacagatccctcagggtcagtctgcggagggggataagagctatgccaccaggctggggcttcatggacccccacttccccatgtttacaaggagggctggcctggctcactggagaggctcagctcagccagcggaggttggagcccgcaggtctcggttccccgaggtggggtgggcagctctctgtgccttgtactctgggggaggaagcagataccctgagaggaagagggggtcccccaggcttccagaccaggccccacaaaaggctcgcagcactaacacctggggaacgcccgaacagcagcctaaatgctcattcatgcagtaaacctgtcctgggcacccccaagtctgcccaggccatgcaggagaagcgggggctgggaggggtgatgtctcagctagagcttccaggacaagtctgactctgccaggcagagaggtgggaggcagtttcaggcaagaaaatagcatgcgcaaggtgctccaaaatcacaaatgatgcctcatctaagctgctgccgagtgtccagtgggaccaccagtcaggccagaggcaagaggtgagaaggtgagatccgactggctgcggaggcatcagggagggtcccccgccccagccccagccccagccctgcaaatggggctgtgcggccagaggtggaggatgtggggaagcgccagggccagggtgcatcagggctgctgtgtggaggatcccccgcgggagcagagggaaggtgggagaccagggaggggccgctggggtgcccaggagagccagggtggaggaagaacattgttgctgcagcactgcctccaggctggagagggagccaggaagaaagtgaggtagccttgcgggggctggggctggaatccaccccctcccattaagcagggtagggggtgtggatgcaggggaggggctcaaagcccaggacggagggaaaggctgctaggcttcaggagaccagcctgcccggagacagttatggacgcccaaggcagcaatggcaaaagcaggaataaacggtcacctcccttcccacagcccctttttctcaaggctggacaggcctgctctgcctagagaacaattcattttggccccaagccctcaggaggcaggaggaaggcaggtggcagatcccctggaaggggccaggctgggtggccagagggacaatggcccagagcacagggctcagaccccctacagccaaggtgggctccagttgcagaacaatcattcccaaaacagtcactgccatcagggcagcctgctgctgccactgccactacccacagccacacagagccttgggccagccctgaacttggtgtcagaggcagcctggggtctagacacagagcagggacctagctctctctcaagtgagggctaagggcagcagggcacgtgtgatcaggatggccccacctcctggagaggttaagattcctcagatgcaaaatgggggtgccaatctccctgaatgcccccaaacactgggaacactgtaagcaccaaactcaattctcatatggtcaccacttcaacctgtgactaggagccagtcattcagcctcagtttccccatctggtaccctagtcccccaagtctcaaattcatagcgccttgtttcagcacagggatgcatctgtctggaacccaggcaaggactctggggcaccccatctctaccccacccattggtgctcactccagttcagccacagggactccatgaaaccttgtcacagccccaagagacagccgggcctctgtgactcgctcccagcggaggacaccatggacccagagcagggaggcgagtggctggtgcaactcggttagcaggtggcagagtgaggatgggactcataggagatcctgtccaagtagcggtgcaggggccagagctttctgggcagcctccaaccagctcaagccttttgcacacgggctgaaggagtctggggtgtaggacgtggatccctggacagcaaccagtcccaaaggaggtgctcacatgcacaaagacaggatagaacccctttagacgggacccttcagacaggaccaggaggagagaatgtcacactccaacgtttgagtcatgtctgtaccacatatacttttaaggtggggagacaaaaactgaacacggatttaaaataaaggtaaaagacaaagttagttttaaaacacctttactggctgggtgcggtggctcatgcctgtaatcccagcactctgggaggctgaggcaggtgaatcacctgaggtcaggagttcgagaccagcctggccagcacagcgaaactctgtctctactaaaaatacaaaaattagccgggcatggtggtgcatgcctgtaatcccagctacttgggaggctgcagcatgagaaatgtttgaacccaggaggcggaggttgcagtgagccgagatcgtgccactgcacttcagcctgggtgacagagcgagactccatctcaaaaaaaaaaaaaaaaaaaaaaaggctgggcgcggtggctgacacctgtaatcccagcactttgggaggctgaggcgggtggatcaggagggcaggagattgagaccatcctgggtaacatggtgaaaccccgtctccactaaaaacacacaaaaaaattagccgggcgtggtggcgggtgcctgtagtcccagctactcaggaggctgaggcaggagaatggcgtgaaccccaagaggtggagtttgcaatgagacaattgcaccactgtactccagcctgggcggtagagcaagaatccgtctcaaaaaaaaaaaaaaaagccgagtgtggtggctcatgcctgtaatcccaacacgttgcactttgggaggccgaggcaggcggatcacctgaagtcgggagttcaagaccaggctggccaacatggtaaaaccccatctctacaaaaatacaaaaatcagccaggtatgatggtgggtgcctgtaatcccagctacttgggaagctgaggcagaagaatcgcttgaacccagaggcagaggttgcagtgagctgagatcacaccactgcactccagcctgggcaatacagcaagactccatcacaaaaaaagaaagaaagaaagaaaaaaaacaccctcatagtctctttcactggagcacagagaaggcaagaagtttggccttcacctcctggcagagctccaagggaaggcctcttcccccagactatctggccaggtccccttggcccaggccaggccaccattttgtgaagccacaccacagaggtagtcaggtctgaagcccgttgcaagatggggaaagcaaggtagtcgggatgggaaaacgtgttcaaagtcgcatgcggctcctgggcgcagctttatccccttttcctcccctccctccttcaactgctggaggaagagcccaggagctcaggcttcggttttggccgccagcctttgtctgcccctgcctgccctgtgccccgttctgatgtgaatatcacccgaggcccttccctcaaagaggaggaccagggacatcacgaagcacacaccccaaggaccccgatccagcagctccccttctacttgtgagcgtcccgagggctggggccatctccagacccccttccttagaaaggcagtgggaccaggacctcgtcatcacgcctgtgcaatcccggctctacattttcccgtctgtgtgccctcgggcaagtcgcaccctccctgttttcccttctgcaaggccctagaggcaacagtgggcagcagtgcatggtgaccacagcccaggcccctccctctggcaacggacttgtgacttgcagccaaatcagctctgccgcctgcctcccctccagccagcacagactccaacaggggcccagctttgggagaggctctttcaaacacccctcagcctctggccagggcctggggccccaagggctcctcggggagctatgtgtaggcaactttattcggcccctgggcctgggcagttcatggagattcctgagcctcaggaaggggaaggcgggctggggttttgcccccagggggcacagcgggagggaaccctggggacctgtacctgctacttggggctgagctcagccgcttggctctcttctccagccagtcctccagatggccctcggggagctcaggagcatctagtagccactccctggctcgcctctcctctgtggggacagggagacaaaggcaagtgaggggtacactcctgcctgccagaaccctaccctctcacaaagcagaagcaactggtaggccctgagcaagcctgggaagttgcagcaaccttccaggaggatgcacctggactgcttctccaggccatctgtgcacgagggcccagcactcggcctcgctctgttttcccatcaaatagagacaaccccggctgcctccaagctcttggggagctggaaacaggacagtgcttgtagagaacctggccctggccaggcgtggtggctcacgtctgtaatcccagcactttgggatgccaaggcgggcggatcacctgagtccaggagtttgaaaccagcctggccaacatggagaaaccctgcctctactaaaaataaaaataaaaaaaattagccatgtgtggtggtgggtgcctgtaatcccagctacttgggagactgaggcaggagaatcgcttgaacctaggaggtggaggctgcagtgagctaagatcgcaccactgcactccaacctgggcggcaagagtgaaactccatctcaaaaaaaaaaaaagagagagagagcctggccctaaggaggggtctgaatctgaggtgcagggaggcagtgagggcagtcgaatggggtcacatctcagctctgtcacctgccgggtctttgaccctgggcagggtaatgagcctcagcttccctggtttttattctcataagctgtccaacaaaacctgttgctcaacgaattaaaaccaatcaacgaatggaatttatacaagctgggtgtgagcgtttgatggggtcagagtcgccaagtcatctgggatggagtcttgggccagaggaaagtaatcatacacttgactagcactcactcagagccaggccccagtctctggagctcactcggggccaggcctcggtctctggagctcactcggggccgggccctggtctctggagctcacttggggccgggccctgggctgtacaggtgtcatcttgcttcatccttagagacatcacattcgacaggacacagcctccaagaggttaagccacgtaccaaggttacagaggacgtggcagagctgggactgtcagagctgccagctgggactctgttcccagcctccctgggcctctccccattcctgtccccgctcggcatcgtctccagttccaggcccactgccccgtgctcgtcccaccatgggccagccgtcctctgagagcccatagccagggaagagctgcagctgccgctgctgccaggacttgctggccagtcccacaaggccttgcttccaccctggggaaaaatgctcctggaaaccctgtgttggtcccggggctgcagccacagcaccactggctcccagggcagggcacggagcctgcagtgtctaactggtcagaggggagtgaggcccgtagggggatcagggcaaaggccaagctgccccagaccttcactggctaccctgaggcctcctggacagagaagcttaagggggcaggcactgagagacctggagtctgcccccaacctgctggggggctcacgcgaggcctttcagtctgaatgttggccttagtttccccacctgttcagtgagaggctgtggaagaagattgataaacaccatctcagtcagaacttccttgttctctaactagaggagtgaatttcccaaaggcgagatgtcagtttccatggaagctgaacttgcccctccctggaatcaccaggctgtgagactccagagggcagggaaggtgcgttcctaaactccttatccctagactgtcgtaaggggtctgcttggtgccaagtggggactgggtatgctgcctgattgaggaagggatggggtgtacccaccaatgactgctgggctggccacagggtccaggtggggctgaggtgcaccttcagggctcccaggcaggaagccacacaggctccactgtaaggggacacaggcctgccttctccactcatgctgaagctgttcctaacacctggcccaaaccgggggctcagggctccgcatcaccctgggtggcccttggttgccaatgatggggagatagggaggcataggccagcttccccggtctcagagcccacatgccccagcaccccactcccgcttagcccagggcatcccgagacgtaccctccacctggatgctcagctcctgcaggtctcgctctgacatgtgggaaaatctgcagttggagccaaagtcgcactggcctgcagcaggaagacagagttactcgctgctcgggaggggctccccacaggggctgaggggtgcccagatgagggatcccagaatcttaggggcaggacttcagggcctaaagaatagcaaccctgatccgggacagaaaatggaatctctccggccctgcccattcagcagccagagcgacttctcacctatcatgccacatgctcacgacccttctccagctgccccccatgctggggatcacttccaactgaagcctgtcatgactgggcctcgcaagcctctgcaggctgtctctgtcaccagccctcccagccctgcctcgatgaactacatatgggttcctgaaagggcaatgcttcctttctccactccaagccgcagcacgtgctatgcccagcctagtattctgcctgcctacctggctcacgggagcaattggactgctccttagaaaggcttcagtggcagctttgccaaagaggcaccaaaatctggggtggcttcccctctttcaaccaaggagaccaaaatgtatgtcgagatactgggaggctggaggtgtctcaagccaggataacctaccagtgacatattcacatcaaggcaaagtctgtagggaagcccctgatctgcaggcttggtgcccatcctaggggagcttggacattcacccagtttccctagttcagctgcagcacctctccccagtgctaagctcccttacaaaccatgtgaatcatcatagttttcctctttgccatggctgccaggaagctcagagccaaacccttagagaatacataggacctcaagggcaagcatggaggagactattctcttggttttatcttatttttcctactcttatttgtatctgtctttggttccttcacttactgaggttttacctcttgctctgtctttttttaaaagagacagggtcctcactctgttgcccaggtgggagtgcagtggtgcaatcatagctcactgcagccttgaactcctgggctcaagtgatcctcctgcctcaacctccctagtagctgggactaccagtgtgtgctaccatgcccagctaattaaaaaaaatttttttggtagagatggggtctcgctatgttgcccaggctggtctcaaactcctggcctcaagcattccttccacctcagcctcccaaagtactgggattacaagagtgaggcaccatgctcggccctttatctctctgacctatatgcatctctagtagctgagtactgagcagtcaaatctacacctagcatccttggttctgatcctgaacttcctcagatcatcaaccctgttactctctgaagttctgcctgctgggaaggaggccaggttcccaggctaacttaatcaacaagtctattccacccataagtgtctcttggatttacatgtaatctcccacgccttgcttgttctaggtgagctgatataatcacattctagatctgaagagctgaggaccagactctaggaggtcctgagacacacttgggaaggccctgactggccagtcagctggagccactgctgcaaagtgggcttgggatggtggcccgggtcggggaagacactctgcagaggtccaagtggggcaggctggatatcgcaggtccccgcagggacctgagctgtgcagaggactttacctgtcagtagaaacttcctgcagggccgcttgttctgctcatccagcaagatggcagctgcatctgcgagagaagagagggacgggattcggatggttcaggctccaccaaaggaggcaggaagtggaagccacaggggcatatggaccctttatctcgacacagctgtgcagaaagaagagtttcctgttccacggaggagtggaagcaggagatgaccacaggtgggagtcctgggcagatggatccgagctgcaggtgacctcaatccatcccaccccacgcaggacgggccaaagacaaggaccaagtttcatgccagcagttctcaacttggcacgagggagtcagctggagagtctggggactttgggtttttttgttttttagagacagggtctcgctctgtcacccaggctggagtgcagtggtgcaatcatggctcactgcagccactacctcctgggctcaagtgatccttctccagtctcagcctcccaactaggtgtgactacagctgtgcaccaccatgcccagctaatattttttatctttttgtagagctggtgtctcattatgttgcccaggctggtcttgaactcctgggctcacacgatcctcccattttggcctccaaaagtgctaggaatacaggtgtgagccactgggcccagcctggaggtataatactttaaaaaaatcctggcactatggaacttctcattattatctttgcaacttgctgtgaatctataattatttcaaaataaaatgctaaaaatttttaagtaaatcctagtgcccaggaagcccaccagccaatcccaggatccaggcactgctccacaggcaagactgcaatccctggcctctgtctcccctccttccaccagctgtagggcactcagggccagaccagccaccgccgcggacaggacttccgacaatcactctgtagcatcggcaatcactctgatcctaatcttaaccctagtttcctctgatttttcctatttttcttttctttctttgagacaagttctcactctgtcacccaggctggagtgcagcggcatgatctcagctccctgcagcctccaccttctgcactcaggtgatccttccccctcagcctcccgagtagctgggactacaggcgtccgccaccatgcccggctaattttttaatttttttgtagagatggggtttcgccatgttacccaggctggtctcgaactcctgggctcaagcgatcctccccacttggcctcccaaagtgctgggattacaggcgtgagccactgtgcccagcctatctttactttcatcatataggtatggttttaaatttgcttcttgataggcaagctattaatcagtcaaaatctgtaaggaagtagggtacctgaggatggtatcctgactcaggaacccttatatccaccccaggggaggggagaggcaaggcctgggctggacattcacccaccaccttttctagaggccaaggaaagaccacaggctccagagtccaagaaacctgagctcaaatcctaacaacatatgaccacgtgcaagctgcataaactccaagtctcagtttccccatatgtcaaatgggaggatagttcccacctggcagggctgctgtgaaaatgtcatcagataatgaatggagagtgctttgcagaggaggcccgtggctcccaactctggtggtacatgagaatcactaggaaagtgaccaggtttgcctctggggccagcagtggccttagcaccatgttctccaggtatacggccaagactgggtgggtacacagcaaatggtagcaattcttcattttttcctcacaaaccctctgaacagcgcaaacatccccactttgcagaggggaaaacagaggttcagacaagggaagtgatttgccaagggcaactggtggcttgtgggaggcgggggcgggcggggggtgtggtctgctgggataaggagttggttgtcagagaactcatgccagggggaccagcagggtggggagggtctatctgttagcgccgggcttgtcagactcattgtacccagctggtgctacagacaccactgcctgcctttccctgaggtgggggggtactaggggagggcatgtggacattgccctggacccccaaggctgggatgactgaggcaggcggcgggactgagcctgggtcctatacaaggggctgtgccaggtggcttggggtgggagaagaattccaggctgcccacgtccgcttagtggttcctgaccccagccacacatcagaatcaccaggcagtttttaaagtacatggacacccggccccagccctctcaggttctcttttaattcattggaagggagggcatcagaattgtttaaagctcctcggtgactctgaagtgtactcagggttgagaacccctggcccaggccctgcacgaggaagcccatgctcttgcagtgggtattcaaggcccctcatgatctgatcctattggtccttcttgcttcatctcccagatgaacagctgcccctggtgcctcatgtttctttgctcaatcacttagacattcatctgccaaacattcactgagcatgtcctgtgtgccaggcaccacgccaggctgaggatttaagtggagaacaagtcggagctggtccttccttctggtccaacagtcacactaatccctatggatgtaagcggggtaaacatctagcgtgtagccaaacgacctgacccgttctaggggtcggggaggacgtccctgaggatttgctgcctgacttgagttctgaggtggtgggggggcctggcttggggcagggaggacagcaggaagggcatgtctacagaggggacagcttatgcccagcagatgcagtggccagggtggctgcagctggaagggagaggccggcaggtcatggaggcctgggcaggacaggggctttgcccagaacacaccattctaattgggcgcaagctcgctaggcagaggggccctattttatccacctttgaatctttagagcctgcctgggagccgcggacatgctgaatgaatgagcccatgagatgaaggctggagggaatccttctgaggacccacaggcaccatgcctacttagtaagctcttatgtgccatgcagtcatcatgaggttactgagcccctgtcatagccctggaaggtggggactgttgtagctgttttatacatgacaaaatgagggccacagtgttagtgagtgacacctggggactggtgccctgcacctgaccatggcggatggatcatcagcccctctgagggctaaggggacgtggcccaggccaagaagctgggagcaaagctgaagtcgagttcattcacacggtatatccgcaagtccctgcggttgctcagagtgagcagaagccctggggcagcctcctgaggaagtggaaagaggtcatgtgccagcttggtcctcggtagctggggacccaaggtgagggaacccactgccctggattttatttcatttatttatttttttttgagacagggtcccgctctgttgccgaggctggagtgcagtggtgcaatctcggctcactgcagcctccacctcttggggtcaagtgatcctcctacctcagcctcctgagcagctggaaccacaggaatgggccaccatgcctggctaatttttttatttttgtttttatttttttgagatggagtcttgctctcttgcccaggctggagtacagtggtgtgatctcagttcactgcaagctccacctcccaggttcaagcaattctcctgcgttagcctccaaagtagctgggattacaggaacccaccaccacgcccagctaatgtttgtatttttagtagaggcagggtttcaccaggttgaccaggctggtcctgaactcctgacctcaggtgatccacccacctcaaacctcccaaagtgctgggattacaggcatgagccacggagtctggccaaatttttttatttttagtagagatggggtttcactatgttgcccaggctggtcttgaactcctggactcaagcgatcctcccacctcagcctcccaaagtgctgggattacaggtgtgagccaccatgccctgcctgctctggattttgaagtcaccacctgtaactgggaatgcctggcttggcctgcccagcctcttacagaactgttctaaggactgaatgtgttggggatgtgaggacactgagaacacaggagccctggggcactcctgtcacctgctgcttcatcttttctataagtgacacagggacctctgccaatcagccctggatcccagcatccagctgttgacagctgagaatctgggactaggtgatctcggcccagctccctctagatcacagcccacactggatttgcacagcagggagccttagcgtaacaccagggttagagtctcctagggagctaggagaccccactgcccatgaattttcctgtggccttgcaaccacagccacgcctggcctgctgagcagcctggccaccccctcacttgaacctctgagcctcagctccctcaagtgaaatgcggagtctgggaagcctttagaaacaccatgcctagtccccaaacctgcctctggggaggggatggggttggggaatcagtggttttagcctaaaggtctccaggtgatcctaacctgcagccggagttgagaatcactgccctagagagttgtcgagaaaagcaaatgacgaactatgaaaagcaccagcatgtagcaggcatgcgatccatgctcattccttgtttgtgaactctcagtttcaggccttttttgaggcggggtctcacaatgctgcccaggctgctcttgaacttctgggctcaaacaatcttcccacctcagtgtcccaaagtgctaggattacaggggaaagccaccacacctagccccaaccagggaactctctctccacctctcctcccttcttggctgctggatttggttccttcttcggaggccctgtcccagaatcctgctcaccaacctacagggcatcggccccactctggctcattccaggagctcctggcccaccctcgccccaccgccaagtgcccatatctctcaacctggctcctgccagtcaccctctggaacctccctggctgttcctcagtgtgaatgtccagtgacagccgtgcaacagcacaactcccctctctgggcacctcccgggaaacaggccctgtgctaggcacttccgaccttagctcattcaccccaattgttcttgctctgagaggcctttcccagaagagcctgccttccttctgcaactgggttattcacccgtgcctgcagccagtcattcaactgccactgaccgcacccaactgctccccacgaagcagtctgcgctgtcaaggcaggtctggccacggcagctaaagcccttcaaaggctgctctctgcccttggaacagggacccccccacctccgccccctgcttatgatggcctccacaggcttggaagatccctgccccagagccagcttgagccctaccattctcccctggcctgctccgcccagccacaccctctccctcctgctccgagagccctggtgctggactcagggctgcctgcttctcttcacaccctccacccagaactgcatggctagctttcccctattttagctgttggctcaaacatcacctccttctagggccttcctcctgtccacagagccttcagtcagcgttgttggggaaagagctcacctaccagcctgctcctctgagggcccagtggctcaggcctccctctcttttgatcctcaaagagcccagacctagactgtcactgacccacaggagtctttgatgataagaaagatcagagagcagggctccaggagcctggcccccagccagcggcacccacctcggaacatgtcgtaccagaccttcttggccttgaggtgctgcagcccgttcaggtgcttcttgcggttgtggaggttgtcctggaaggagcggtcgcagtagtcacagaagtatcgcttccccatggccactcagagcaggtgctttgctgcctgggaagccacaaagagctcagattagaccattggagaaaacacatccctcaccagcccactgaatgcttcctgagggccaggcctgagcccaggctttactcatatgcaccccgccccattaggagtgtcaagctgatgagtatggcctaagaggcctcattccagagggatctgttaaccattctgatgcccagcctgcaacttaggccagttaaagtagaacctcagtgggtgaggcctgggcactgttttttcttgagagggtgttgctctgtcacccaggctggagtgcagtgttgcaaacacagctcactgcagcccccacctcctgggttcaagcaatcttcctgtctcagcctctcaaagtgctgggattacaggcatgagccactgtgcctggctgctgtttggtagtttttaaagtctatcaggtgattctaacatgtaagtaggctgaactgccaccttataccctgtggctggcctcccttgtctcctaccacatagggttttatttttttgagacagagtctcgctctgtcacccagggtggagtgcagtggtgtgatcacggcttactgtagctttaaccttctgggctcaagtgatcctcccacctcagtctcccaagtagctgagactacaggtgcgtgtcatcattcctaacttaaaaaaacaatttttttgtagagatggggtctcgctatgttgcagaggctggtctcctgggctcaagtgtcctcccgccttggccccccaaagtgctgggattacaggtacgagccaccgccccatcccctaccatacctctgacctccacatttgcatcatataggccacaccggcctcccctttgctcctcacacatgccaggcacatggccacctcccggcctttgcacccaaggctccccagggaggggtatgccctcctgcaaactcccgcctcacttcccctcctgaccccttccatctttgctccaatgctactttatccaagatggcagaatcttccacttagcttcctccactccctgctttattttccctcatagcatgtatcaccctttgatatggtgaggctttgtatccccacccaaatctcatctcgaattgtaatccccataatccccaggtgtccagggagagaccaggtgggggtaactgacatgggggtggtttcccccatgctgttctcatgatagtgaagagttctcacaggatctgatggttttataaggggctcttcgtgctttgctcagcacttctctctcctgctgccttgtgaagaaggtgcctgcctcccctttcccttctgccatgattgtaagtttcctgaggccttcccagccatgcagaactgtgagtcacttaaacctctttcctttgtaaattacccagtcttgggtatttccttatagcaatgtgagaacggactaatacacccttcatgcaataagttacttgttatgtttactgtctttctcccacaatgagaatataaacccatgagggcaggtttgtgttttgtttactgctggagccccagcacctaaaatagtgcacagtacagagtaggcattgaagtacttgttaaatgtatcaattctcattttccctttgggacaactgaggttcagagagggagtgtgatttgcccaaggtcacacagctgataagcagaaggcaaacccagtcccctaacgttacattgccaggtgtcctctcttccacagccagttcaaggcttagagaagccagagggcgcaggcagtgaatgctgacagcttcccaaggagatcactaaattatcaggtggcaggtccgaatccagtcacagagggaaatgaaaacattttggggtcttaagacccctcagccatggtgaccacagccaccactcctgacccaggagatctgcagcccaaggtgggtggcaattcagtgactctcatggccagcccttgggtccatgagtatggtgctgcaaaacaggaggacagacaggtccactttgggccaccaagggggatctgccaaggctgagcccagaccaactgctcaccctgtggtcagacccctcacttcacagaaaaggttcctgaggcccagatgaggaagagaaatgatttcccccaggtcacaaggtagctatccgggctagcagccaaagccctggactcccaggacctgatcaccacagtggaccaatgggggaacacagctcaggaggaggagactggggagagacacagagacagtcccaacagccaagcaggttgatggagaaagccattcttgcagcagacagggacagcagccattaagtcaggggctgtaatgggatcaggaacagacagtcattcaaaatgaaaacatataaaacctctcttctcccattactgcagagggaccgtgtcccagacacgcacacttgatatattaaatttggcagctctaatacaccccatcttgtcaataaacttataggaattggattgaaattgtaagagatgaacgtttaacggccgagtgctaaaccaagccattcagaaagcttgaagctcccagaagcttgctggcgctggagagtaatggggaagggaggggacagggagggtggttctctgggagactggaacagaacggtggctctgcggcctacttagatagacaaaaccacacaggcattgaaaagctgcctgtgtgaccttgggcaagtcacttcctgtctctaggcctctacgttcactgtgggaatatgaggcaatggctgcttgatcaggaagtggtacagagaagtttcctaatgcagatggtgaaaatgatgctgataatacctggcattaagcaagtgctcaataaatattacctattattagggctagtggtttattgaatacctactacgtgctggcactaagctgaaagctctatatgcatcatctcatttaatccccaggacaacctgtgggggagggcctgttatgcctttttagatgggggcactcaggttccagaaatgaagtgacttagccaaggtcacactgctaggaaggagccccgctgggcttggaatccaggtagcaggcctctagggtccccactcctgatcacataatgaaagtctcctccttaatcccagcattttgggaggccgagatgggtcgattgcttgagaccaggagttcaagaccagcctgggcaatagagtgaaaccccatctgtacaaaaaatgcaaaaatcagctgagtgtggtggcacatgcctgtattcccagctactcaggaagtgaggcaggaggctggcttgagcccaggaggcagaggctgcagtgaactgagactgagccattgtactccagcctggacaacacagcaagacccccatccaaaaaaaaaaagtctccttccaacaaatcataataatgacaattttcctttattaatcactagctacaccctaggaccatgctagccccttcaagccccaagaggtgtggattataatctcattcatgaatgaggcaactgaggcccagacaggtgccatgaggggccccagctcacacacataggaagggcagagcaggcctcagggtacctggggctcaggtctgccaggaaagcctgtcttcatgctgccgtgctagctgtcccaaacaccagcccaccaggaaactggaccacacgctcctcggcctgcctccccagccacactctgacccaaatggtaagcccctttggtgggctgtatgtgtgtgtatatgtgtgggtgttcatgttttcccccctctctctcaccccctccactccatggggggcaaaccagctaatggttcccttcacttcatcaccttgtcagcctcagctcagggccatggctgcccacccatgccctcctctgcccacccatcatctagcacatgagaagtgttcggccatcctggatgggtcaacacgaccccacattccagtcccagctctgccacgtggctcagtctgtgactcagccacttgccctctctgggcctcagtttccccatgtgggaagctgcagtggcaggaccagttgatctctaaaggcctctctggttctaatatccagtgatcagatgagaagatgcccaaaataacgcttttttaaaaaatgtaaatattggtctcgccatgttgcccaggttggtctcaaactcctgagctcaagtgatcctcccacctctgcctcctgcagtgctgggattacagtcgagagccaccgcaccaagccggcaatgctttctatctacctgtcacagacacatgtgcagtgtcaggccagggagaccaacgggcagcacagtccctctgggacgggaaagcatgctcactgagcaccacctgggcaggcccctccctgaccctctcaccctaagaagcaggtcacagcacccccatctcacctccgagagcgggatacccagcctggggacagcactgagcatcaggaccagctatctctgcatttctgtgcctggggaggctgtccggggacagagttaagagctggctctggagtcagatgtcagggcttacatccagtcgctactgcttcctaattttctcactcagtgatactggcatttctggccttgttttcctgctatgaaaactgggataataacagtgttcaggccaggcgtggtggctcacgcccataatcccaacactttgggaggctgaggagggtggatagtgaggtcaggagttagagaccagcctggccaacacagtgaaaccctgtctctactaaaaatacaaaaattagctgggcatagtggcgtgtgcctgtagtcccagctactcagaaggctgaggcagaagaattgcttgaacccaggaggcagaggttgcagtaagcagagatcgcaccactgcaccccagcctgggtgacagagcaagactccatctgaaaaagaaaaaaaaaattgccgggtgtggtggcgcatgcctgtaatcccagctactcgggaggctgaggcaggacaatcacttgaatccaggaggcgaaggttgcagtgagccgagatcgaaccactgctctccagcctgggtgacagagcaagactccctctcaaaaaaagcaaaaacaacaacaacaaaaaagaaccagctgtgcagagcccccactgcccagggatggcattggggtgagggggcacacattctacctacttcacagtcctgtccccacaggcatgtgcctgaggccatgttcccagacagaggctggccttcaacaagatgacctcgctcagatgtaaaattctagagctcctgaaccaaatgcctcccgctctgatgcctttgcccacattaggataaggttcaacttgcagaatcctctggacacatgcagcgccctgccagacacacaacttggcaagcagaatgccggctggagttcagctccagctcacccctcagccaggtgtccttgcacaaggtgcaacctgcaccaccgtacttggcagccgaggaggggtcagggacaggggaggaaggggacagctggagtgtctctaaatggcgcccagataccatcatggggtgctgactaagctggccccctctgctgtgattcatccccatcctctgagggtggcacacgcagcagagtgtgagcgaggtcccgtctggaacacagaaccatccggccccacgccctgccagaaacacaggtggtgccatccacccactcccagggaccaggtgcacggctgcaaaggcatctgctggatccctggagcaccagcaggtgagagtgctggcttctcttggccaaggggcagcgggcaaggctagtgggacaacctctgggtcacatgggtcacatctgaattccagctctgctgcttatgagctgggtgacccctgggaagtcatttcatctcccttgatctattcttagctataaaatatggatcccacagctgctgaggtttaccgaggcagtagtacattaaggtgcctagtagccagctgcaatggctcaggcctgtaatcccaacatgttgggaggccgaggtgggaggatcactggagcccaggagctcgagaccagcctggacaacatgggcagaccccatttctacagaaagaaagaaaaaaattaggcaggcatggtggtacatacctgtagtcccagctatttgagaggctgaggtgggaggatagcttgagcccaaggaggtcaaggctccagccagctgagattgcgccactacactccagcctgggtgacagagaccctgtctcaaacaaagaaaaaaatgtgcctagcatatagttcctgctcaataacggaggctgttactgttgttactattatcatccgggctgcccaccccctcaccctctaagtgaacacactctgaaccccactttaaaatcgcagtcaaggccgggcacggtggctcatgtctgtaatcccagcactttgggaggccaaggtgggtggatcacttgaggtcaggagtttgagaccagcctgaccaacatggtgaaaccccgtttctactaaaaatacaaaattagccaggcgtggtggcacacgcctataatcccagctgctcaggaggctgaggcaggagaattgctcaaacccaggcagcggaggttgcagtgagcagagattgtgccactatgctccaggctgggcaacaaagtgagaccttgtcaaaaaagaagaaagaaagaaagaaaaaaagaaaggagagagagagagagggagggagggagggagggagggagggggagagagagagagagaaagaaagaaaaagaaaagaaagaaaagaaaggaaagaaagaaagaaaggaaacaaagagaaagaaagaagaaaactagtcaaggcactgtggggtggcagagaggagaaaagaggctggggatggtgggtgaggggtgacagcttcagatttgattcccgcttgcttggcacttcgctttcattcccttatttaatcctcctagagacactctgagtagatatcaatatcaagtgtccattttacagaccagaaaacagttttgggaaaactcggtcctaatttgttcacagccatggccagaaagactctaataataaccataacaattactgttagtgtcagtaacaataatgacacatcaataaccaataacaaccacgtctcatcatcctgagctgccagtgggccagggtgccatggacccccacatcccctcctgtggagtcttcaccatgacactgtgaagccacgtgcctaaggccccacagccaaggcacaccagagctggcacgcacacttgggtctggctgaccccagagcccactctctctccatcccactgtcctgccgtgaggctgctacagggcaaacatttgcgcttcatcaatattctccattcctttcgttgtgtgtgtctcaggtacagaaagagctggctttggcacaaggcaaaaataagccaacagctcggcctttggccaggggctgggatgtgcactataattatcctggacttgtgctcaccacaggcgaccctgaagctcacctgttattttttctaattatggcacctccagaccccaggtaaacagtaaaccacagccagaggacggctttattgcacgcccactaggagctcggtaatgtcccagtgtcatatatgcctgccatctggagttgatggcatcagaaccaccctgtgggggtggtctgcagactgctggtgcaggaccctgttcggaaggaagcgccaaggaaatccagatgtctttcctgaccgaacccccgtatgctagaggcatccttgagatccttgggtggcagccacacacctttttcatcctgacctcatccctgtgtttgcctcctgccctcccctggggtaaggcacatcatctttttcccacaggtctaaggcagcgaggggcccacccactgcaatttctgactcggcaggtctgggacagggccaggatgtaagaaagtcctgattcagactccacagagaaatgcgagtccaggctgggcacagtggctcacacttgtaatcccagcactttgggaggccaaggtaggaggatcacttgagcccaggagtttgagaccagcctgggcaacatagttagaccccatctccacaaaaaaattttttttaatttgaccaggcatggtggcgcacacctttaatcccagcactttgggaggctgacgcaggtggatcacctgaggtcaagagttcgaggctatcatggtgaaaccccatctctactaaaaatacaaaaattagctgggcatgatggtgcatgcctgtaatcccagctagtcgggaggctgaggcaggagcatcacttgaacctgggaggcggaggttgcagtgagccaagattgcaccactacactccagcctgggcgacagagcgagactatctcaaaaaatatatatattttttaattaaaaaattagctaggtatgataacacacacctgttgtcccagctgcttgggaggctgaggtggaaggatcacttgagcccaggagttcaaggctgcagtgtgacgtgatcacgccagtgcactccagcctggacaacagggtgagaccccaatctcaaaaaaaaaaaaaaaggacttcacagaaaaaaaaaaaaaaacagaaagaaatgctagcctaaggtagcagatgatggacagaacagagagggtgagagcatgctcaaggtcacacagaacaatcctttgaagctgttttcccttaaacacaactactctaatcaccaacccaggtctgaatccagtccctgccactctcaggttgtgtaactctcagcaaactgcttacctctgagcttcatctggaagacgagggtaatgactctatttcataagattactgtgagaattaaatcatgcatgctagctgcttagcacagtgcctggcacgccaatggtgcttcacacacgcttgtgcatgttgcagccagcctccaagcccccagcaatcccacctcctgattttcacaccttgtgtagtcccctccaagctgggtcagggttggtctatgtgaccaagagaacagagcagaggtgagggtatgccatttccaagaacaggttataaaagacactgcagggagggcatggtggctcacacctgtaatcctagcactttgggaggccaaggcgggcagatcacttgaggtcaggagttcgagaccagcctgaccaacatggggaaacctcgtctctactaaaatacaaaaaattagccgggtgtggggcgtgcacctatagtcccagctacttgggaggctgaggcaggagaattgtttgaacctgggagacggaggttgcagtgagccgagatcgccactgcactccagcctgggcaagagaatgagactccatctccaaaaaaaaaaaagacactgctgcttccatctcagtgtcttctttctctgatcacttggtctgggggaagccagctgccacactgtgagcagccctgcagggtggcccacgtggcaaggaactgagaccccctgctaacagccacgtgaatacatttggaagcaaaccctctggccgcagttaagccttcagaagactccaccctggctggtatcttgactgcaacctcccaagagactcagccagaaccactcagctaagcagcgcccagattcctgaccctagaaacagtatgagaaaataaaagtttgttgctttaggttggacgcagtggttcattcctgtaatcccagcaccttgggaggccaagaaaggaggattgcttaagtccaggagtttgagaccagcctgagcaacatagtaagaccctatctctacaaacagtttgttttttttaaattagctgggtgtggtgatgcatgcctatagttccagctacttggggggctgaggtgggaggatcgcttgagcccaggagatgaaggttgcagtgagccgagatcatgccactgcactccagcctgggtggcagagcaagacctcattcaaaaaagaaaagaaaacttaataggattatgtccagatttttttcatttggtatctattttttaaagtttctatatttggcatgtattgttttaaaatttacacacacacaaaaagtcccttcaaaaaaagtggggggctagtccaagtgcagcagtgttggtgactaactgatcacaaccagatacagatttctttgttccttctgcactcccactgcctcgcttgactagcctctaaaaaagagaaaaagaacaagagggaaatttgtaaggcggggataaatcctattccttctccctctggaggctgccatggagggttccagagacctggttcactcggatgaaccagccaggggtggtaagtgaaagaaatagagcagacattcccctcaccccctggatgaagactgacaaggcaaaccctgattccaaccagacttggcctagcacaccccaaggcctggtgaaggtcggctgagcctgaatctgggctccaggaactgcgggctggagacaagtttctcatcagatagttacaggtcccaagaggccagagtttccaaataggaaaggtaaaaatagtctgaatgaggctcctgaaccagatacttggactcagaactgtctctgcctcccgcttcttctctcccgagtctgggcaccaaatatcatctgatcctctatctccactgtcactactgcccaagaaagaactcagctcctcacctctggactcctcacatctggacagccccctccattcactgtatcataagcagcatcagatcaactctccttaaatcatccctgctcaaaattttccatggcttccaagtgagaaacttattaaaaatgaatctcagctaaatgcagtgactcacacctgtaaccccagcactttggcaggccaaggcagatcagttgaggtcacgagttcaataccagcctgggcaacatagtgagaccccgtctctaaaaaaaaattttttttttaattagccagttggggtgtcatgtgtctgtagtccttgctactcaagatgctaagatgggaggatcactggagcccaggagtctgaagttacagtgaactctgatcatgccactgtactccagcttgggcaacagagtgagaccctgtctcaaaaaaataaaagggggccgggcatggtggctcatgtctgtaatcctagcactttgggaggctaggcgggcagattacctgaggtcaggagttgaagaccagcctggccaacatggtgaaaccctgtctctactaaaaatacaaaattaggccgggcacggtggctcatgcctgtaatcctggcactttgggaggccaaggtgggtggattgcctgagctcaggagtttgagaccaccctgggcaacatggtgaaaccccatctctactaaaatacaaaaaattagctgggaatggcggcacgagcctgtagtccctgctactcgaaaggctgaggcaggagaatttcttgaacccgggaggcggaggttgcagcgagccgagattgcaccactgcactccagcctgggcaacagagcgagattccgtctcaaaaaataaaaaaataaaaaaaattagctgggcatggtggcaggcgcctgtaatcccagctactcaggaggctgaggcaggagaatcgcttgaacctgagaggcggagcttgcagtaaaccgagattgtgccactgcactccagcctgagtgacagagacagactcctctgtctcaaaaaaaaaaaaaaaaaaattagctcagcgtggtggtgcacacctgtaatcccagttacttgggaagctgaggcacgagattgaacccaggaggtgaaggttgcagtgagcccagattgtgccactgtattccagcctgggtgacagagcaagactctgtctcaaaaacaaaaaaatagtctcctgggtcaggtccccagaaatcctgatttagcagatctggagggggacctagaaatctgcattttaactagcaagtctaataccccttaagaagcaaaagcctggaggaatgaactttcccttgagttccaaatgcagcctctgctggggacagttattctgggtagacacagccccctggactcatgtcccagctagaaatcagtccaattatgaataacctcaggtcactgaagtggtaatccaacttgatgctaagcacaattagttaaagtggataaagctgttttcttactagataagtgtcttgtcacactcctggaaagtttagaattaaaaatagaagcataagagcaaatcaaattcactgtattaatgttcctatcctaaatttagtaataatctgtatattttggaattaaaaagtagctgttggccaggcacggtggctcacgcctgtaatcccagcactttgggaggctgaggcaggcggatgacaaggtcaagagatcgagaccatcctggccaacgtggtgaaaccctgtctctactaaaaatataaaaattagctgggcgtggtggtgcgcacccatagtcccagctactcaggagcctgaggcaggaggattgcttgaacctgggaggcggaggttgcagtgagccgagattgtgccactgcactctagcctggtgagagtgaaactccgtctcaaaaaaaaaaaaaaaaaaaaaaatagctgtagacagggcatggtggctcacacctgtaatcccagcactttgggaggcaggaggatcacttgagcccaggagttcaaaaccagcctgggcaacataggggaaccttgtctctacaaataatttttaaaaaattagccagacatggtggtgcgggctcgggcctgtggtcccagctactactgctcaagaggttgaggtaggaggatcgcttgagcccagggagatggaggctgcagtgagccaagattgcaccactgcactccagcctgggtgagagagtgagacactgtctcagaacaatcctactgggaactgtgcatgcgagggatctaggttatgtgctccttatgagaatctaatgcctaaaacaaaaaaagtatctgtaatattgaaaaaaaaatgtgatatgttgagtgtctaacagataagcattgtgattcctatttaaaatacaaaagttaaaatatagagttagtgacaaaatatatgtcagtaattgatattagagttgtgattttagattgagaggttagcaatgattggaaatatggactgtataacagaattacctggggtgctgtaaaggttactaaggggccccccatatattcctatttcatgtcagaaatacagcctgtttttttgtttttgttctttttagctccctaaactaagagccactgacatagagaattttactaagtctgtaaaaataattatttataagaacttgaaattcattataagtttaattgattagattttgtagtaactctttactctggggaaaactgtgcttgttatgttattcatataaagtacttaaaaagaaaatcaaatatattaaatttacaaatagatttaaaatgttggcaggaatgaaattaagctgtaaatagggatgagtgtcttgagaaattcagaatcttcaacttgagttcaaatattaataaaaaaattaaggtcatttttcttatttgccgatatttatgtattgaataataatttctaagttgaaatacatggcttaaagcaggggaccccaacccccaggccccggaacggtacgggtccatggcctgtcaggagctgggccgcacagcaggaggtgagtggcaggtgagtaagcgaagcttcatctgtatttacagccactccccattgctcgcattaccgcctgagcttcgtctcctgtcagatcatcggcagcattagattctcataggagcacgaatcctattgtgaactgcgcatgcgagggatctaggttgcacgctccttatgagaatctatgcctgttgatctgtcactgtctcccatcacccccagatgggaccgtctagttgcaggacaacaagctcaggcctcccactgattctacattatggtgagctgtataattatttcattatatattacaatgtaataacagaaataaagtgcacaataaatataatccacttgaatcatcctgaaaccatccccctcctgtatcccgtccatagaaaaactgtcttccacaaaactggtctctggtgccaaaaaggttggggactgctagtttaagggaaattacgttttttaaatgattacctccgaatgagaatttaaaagataaaatataaaaccaaaatccagtactttgagaggccaaggtgggagcatcccttgtggccaggagttagagaccagcctgggcaatgtggcaagaccctctctctacaaaaaaatttttttaaattaggctgggtgggaggccgagacggacagatcacctgaggtcaggagttctagaccagcctggccaagatggtgaaaacccatctgtactaaaaatacaaaaattatccgggcgtggtggcaggtgcctgtaatcccagttactcgggaggctgagagaacagaatcacttgaacccaggaggcagaggttgcagtgagctgagattgcaccactgcactccagcctgggcaacacagcgagactctgcctcaataaataaataaataaataaataaataaggccaggtgcggtggctcacacctgtaatcccaggattttgggaggccgaggtgggtggatcacgaggtcagagattcaagaccagcctgaccaacatggtgaaaccccttctctactaaaaatacaaaaattagctgggtgtggtggcgggcgcctgtaatcccagctactcaggaggctgaggcaggagaattacttgaacccaggaggcggaggttgcagtgagccgagatggtgccactgcactccagcctgggcaacagaacgagactccgtctcaaacaaaataataataataataataaataaataaaaattaggctggggagatggctcatgtctgtaatcccagcactttggaaggccaaggtgggtggatcagttgagctcagtaatttgagaccagcctggccaacatggtgacacccctaaatttttttagtctttacaaaaaatctataagaaaaccagaaaacgaaattagtggggcatagtggcatgcacctgtagtcccagctacttggaaggctgaggtgggagtaccacttgagcccaggagttcgaggctgcagtgaactatgatcgtgccactacactccagcctgggcaacagagtaagaccctttctcaaaataataatagtaataataataacccagcatggtggtgcacacctgtaatcccagctatttgggaggttgaagcaggtgaattgcttgagcccaggagttccaggctgcaaggaactatgattattacaaccaggaattatgtgccactgtactccagcctgggcaatggagggagaccctgtctctacaaaaataaaacataataaaaccaaatgaaacaagccacacctttaactccctgtggtcttccctactcatttctccctcctctgaacttcccatcagccagattggttggaaatgattagcaagacctaagtagtcttcccctggagcctcacaacttcctgctctgaggggctcccaggatgctttgcaaatagtataaaaccacagtaaggataactcatggatgtaaagcatttcacattttaccttctgatcccctaacctggtattactgttgctctttacagatgaattaaaagagagttaaagcctgatcaatgtcagagtcagaggcagagccaggcctgcaatccaatccctagtttttgtttgttttgttttcatttgagctccatcacccaggctggagtgcagtgacgcgatctcagttagtggcagcctccgcctcccaggttcaagcgattctcctgcctcagcctcccgagttgctgggattacaagcgggtaccaccacacctggctaatttttttgtatttttagtagagacagggtttcaccatgttggccaggctagtcttgaactcctgacctcaagtgatccacccaccttagcctcccaaagtgtggggattacaggtgtgagccaccgcgcctggcccctagtttgtttttcatggagacggtctcactatacggcccaggctggtcttcaactcttggcctcaagtgttcctcctgccttggattcccaaaacactgggattataggtgtgaggcaccatccccagcccagtccctggttttgaatgccacccctatccggatgactcttctcaggctcatacctctcctctaaactacagatccatgtcctcatttgcctctagacacctccacttgatgtctgttggctagctcaaactgatgtggccaaaacagaacttaagatcattctgttgattttaaattgttgaggtcaaaacttagatgtcagctggacgcggtggctcacacctgtaatcccggcactttgggagaccgtggcaggcggatcacttgaggccaggagttcaagaccagcctggccaacatggtgaaaccttgtctctactaaaaatacaaaaatgagctgggcgtgttggcatccgcttgtaatcccagctattcagtaggctgaggcatgagaattgcttgaacatgggtggcagaggttgcagtgagccaagattgtgccactgcactccagccgcacagagtgagactctgtctcaaaaaaaaacaaaaaacaaaaaacaaaaaaaacttagatatcctcctcaattcctctttcctgtgcaccctacacacatctgctagcttgctctgtctgccctccctcccaaattacatcccaaatctgatcactgccctgctccacaccctaacctaaattaccacccatcaggccgggcatggtggctcacgcctgtaatcccagcactttgggaggccaagatgggaggatcacctgaagtcaggagtttgagactagcctggccaacatggtgaaaccctgtctctactaaaaaaaaaaattagccaggcatggtggcaggcgcctgtaatcccagccactcgggaggctgaagcaggagaatcacttgaacccgggaggcggaggttgcagtaagccgagatagcaccactacactccagtctggacgacagaccgagactccatctcaaataaataaccacccatcttccctcaaatgatctactacaataacttcccccttgcggtccactctccatagaccagccaggatgatgacattaaagtgcacattaaatcttgtcgcatttctcctgaaaacccttcaatggcctcctagtgcaactagaaaaagacaagactccttggccagacgcggtggctcacgcaccttggggggcgaggcaggaagattgcttgagcccaggagttggagaccagcctgggcaacacagtgagaccctgtctctaaaaacaaaaaccaaagaaaacaagactccgtaaggtgggttccaaggccagacatgagctgaccggagtcaacctcttcacagtccactctacttctttccctcaaacatcccaggactgtagctgcctcaaggcctttgcaccaacgttttcctgttcaactctactattcattcaggtctctagtcaagtgtcaccccccagagcagctacccagggtgcaatgtcaccaccactgcctctccagtcaaccaaagcactatctgtttgctgtactgcatctccccacccgcccactccgtagattgagcgctctgtgagagcaaggactttgttcactgctgggtccccagagcagggaccagaacaggcgctgggaaaacatctgttgaatgccccaggtactccaaagcccttgctcttttcaatcccaagcaggttccaagtctccagccttccaaaccagggttgcccggtgcgaagcccaggggtgagaggaacaggaagcagggcagatccgtccctgcccttaatccagggtgaagggtttaacctccaggacaagacttttgccgcaggctccagctcctggcctagacttggggctggtgcaggggacaaggcgaagagttgagccagggtctcgggaacccagctgccctcgcccctctatccacaccctatcccaagaaatggtgcgtcccgccgcagggcgtacgcacagagaaggaagtgttcaagtcttccagtgcggagaaaagagactaggactcgcccctcgacgtctcgcggaaggtacctggctccccggtggctgcagctccgggctcc

SEQ ID NO: 1668 - DNA, 36025 bp, Homo sapiens; identical to SEQ ID NO: 1667

SEQ ID NO: 1669 - DNA, 57214 bp, Homo sapiens
attcataatgaaattgaatatttatttgaatttctcctggtaatagcactcaacaaataagaaaaaccgagctgtgagattttgttttaaatgtagccatatttcaaaaggtaaaaagttggcttctatatttaatggcaagtgggacatcttctattttaaaattaacattcaaaaagtagtaaaatatacactatcatgaacacgatgtgttttatagaatggattcatgtccgaatactaatctgaatgtggaagaaatgtattatctgttaaaaaccacactggaaaaatgttcttttttataaaaagtagcttgaagtaaaaaggaacttgctaataaagccagtaaactttcacacgtgggatttttaaaaaatctccacccatcccacctctgaaaaaaaaagaaggagaagaataaaagaaagaaaaagaaaaaacccatatggtcaatctgagtagagccattcattacatgactgctcattctgtacaatgtggaagcctggttatttaggaaatatttcgtttcctaaagtgcatcttttgaagatttgcctagtaaaactgcaatatcatatacaaaacacttaacacaagacatgcaataacaaagctaaatcattccagtgtaaagttgttaaaactacttttaaaacttttgtttcaccaagaaataaagatgtaaaatacagtagcattcttgttctccaacagtatgcattgtatgcttttgttatttggcaaatcttttagagtcgaacaaaaataatagtctaaacaacatttcttctgtcattataatacgaatcccgggcagaacagtaagatgtagaggaagagttagatttttggaagctttggtgcattaaccacaggatttgcctcgtgcaagtatctcctccctgcactcttgtaatcataggtacagccatgagtttctgcataacgatgagatgcacagaagttgtttccacatctaaagcacaaaaaaagtttacgtgaatagttgtatttctatgaaaggctcatctgtctgggagacaggagcttgacttcaggtagtccaacaggggccctttggttctttttagcaatttcactgctgacatttcccttccattcgtaaacaagcataaatacccccaaaaagaacaagttaattatctacgaatatgacaatttatgataaagaagtcattattgactgaaacagggtagaccaggggcggtggctcaagcctgtaatcccagcactttgggaagccgaggcgggtggatctccaggccatccaggccaacatgatgaaaacccatctctattaaaaatacaaaaattagctgggtgtggtggcgtgcatctatagtccagctactcgggaggctgaggcaggagaatcgcttgaacccaggaggtggaggttgcagtgagccaagatcgtgccactgcactccagcctggtgacagagcgagacacaatctcaaaaagaaaaaagaaaaaaaaaaaagaatgaaacagggtatagaactctatcagtagtaaaactgcaaaaagctgataaatatgcccatcgtttctcttatacctagtaaacctaaaagaattctgaatttctgaggaattcagtctcatgataaaattaaaatagtaaaacctaactatgccatgaaaggatttttaaaaatatttctagtagcaaaataggttgttttcattcgaaccgaatacactctaaaaagcagggattgggatgggtgtggtggcggctcacacctgaaattccagcactttgggaggcaaaggtgagaagatcacttgaggccaggagtttgagaccagcctaggcaatatagtgagatctgtctctacaaaaaatttaaaaaattaaccaggcatgatggcacatgcctatagtcctcactattagggaggctgaggcagggggatcgcttgagcccaagacatcaaggctccagtgagttatgattacagtactgaaaaaaaaaaaaaaaaaaaaaagtccgcagcagcagttattttaattcaagcctagccccaatctaagggcagacatccaagataatatgacataacatccttggaggatatcaatcaatactaatgaaataaataattacagtaagaaaaaggtcatacttttttggaaatatattattcatctattttatattaacttttaattttttaattaaatttttaatagaatattcagggaggggttcttccaaggtgccactcaaacaaaatccaagcaggttcatcataagacgaaaaaggtacactctcagattggtttaaacctcctaacttaaaggacaaggaaggatctgtttttgtcttttggaaacccatgagctatctacttgttctttacttcagccaattagaagttcaactgaagatagctattgaacatcatcttaatgatgttataaacaggcaatttaaatattttattttgcataatccccaagctgggttatcacagagaaagcatctgagcttctccagctcgccaacctgcctgcattcgtagctactagccagtcctgttttctttccacaaagaaaacaatgatttgttgttttcttctttgtctgaagaggggctttcacaggtgggaggtgatgagtagtacattctcctgtttagagaaaggacaccttgattaacacaggcataaaatcctaaacatgaaatattattaagcaaaacacaaaacatagtcctatcaaagtaaatatctatgccataaaaattaatttgtgctatttttatatctaaaattacttataaaatctacaggtcaagttgcagtggaactatttcttttaagatgtggtaggtttctactgattagcacttatatttttagaactttttatacacaccactttcctcattatttctaatggtaatcagtttatataaagtacaccaaattttgacagagaataaagaaaaatgtctgcttcaaaatcatatttgatgaagcctctgagaacatgattgcaatataaatattctgtttgttcacaccaaaaagaagtaccagaatatcatgaaacatgccttttagtcctattacaccactgacagttcatcaaaccatgagcaagtcatttattctttcaaaacttcaatatgtttatttttaacataatagaacatgtatttttctctctaggttaataagcactttaaggtcaactcaatccatatatgtaaaaagcactctgaaagttttaagcatgttataattacataaaatgtcatattaataatagtaactaacagtacacagctcaatttcacagtactactagttttccaaaaatatttactgaattctgtattactgtatcaacttgagtttttaccttaaaaataagagcacatctgttattatataagaaagaattaaatcaattttttttttttttgagacattttgctctgtcgcccaggctgtagtgcagtggcgcaatctcggctcactgcaagctctgtgtcttgggttcaagtggttcttctgcctcagcctcccgagtagctgggactatgggcacgcaccaccacgctcagcttttttttttgtatttttagtagagacggggtttcaccatcttggtcagtctggtctggtcttgaactcctgacctcatgatccgcccatctcaacctcccaaagtgctgggattacaggtgtgagccaccacgccaggccaaatcaatttctttaattactaagttaaatgtcttttagaactgatcaaaatgccaacaaaccccagtcataagcagagaggctcaaagttcctgcccatagttgataaagtaacagtacaaatacacatgtgcttggtgtcacacaaaggctaagaagcaagaggcaaagaaagaatgcaagaacaagtggaaggagtgaggaaaaactggtagtgtcaatggtgctgggaccttttctccactactgaaaaaggtttaggaggcctaagcttggtatttagttggcagctaaaagtctgaaatttcttaaagggttcaaaaaattggatttacaattaattggttctatgtctttttttttttgtcacaacagagattaggtaatttgtacacaagcccagcaaaattaaatcttctttattaccagtataaaatacacttccagatcttgccaaaactagaaacaaaatttgaaacaattgagagactcctaatggtgcctgggtaccaactcagttaataaacgttttctttctcaagtgcacttagagataccaagaacatctcacaaaggtgagggagtaattccattatttaaagtatttttaaaaagatatttacttgcacttgcacaagacaccaaagaaaggcatatattacaagatgtccaatgaatgttaatctactcgaaaccatctttaaaattcaggcttaggatattcttccttaaacaatggtggaagaatctctgatgataatttaattcactgtagtcacattttcattttttttcttttcttaggggatgcttaacttgatattctccatactttttttcatttaagaactcttgtgaggctgggcgcggtggctcacatctgtaatcctagcactttgggaggccaaggtgggcgaatcaactgaggtcagttcaagaccagtcaggccaacatggtaaaactccgtctctactaaaaatacataaattagctgggcatggtagcacgcgcctgtagtcccagctactcaggaggctgaagcagaagaatcacttcaacccgcgaggaagaggttgcagtgagccgagatcgtgccactgcacttcagcctaatcaggtaacagggcgagactctgtctaaaaaaaaagaactcttgcgaatgtgtagagacagagaatacattagtgacagtaatgaggtagcacaaaaatataagtgcagtactctatgagagcagcctccatacatccttctaccaatagagaaaactattagcaactactgtgtactaggaaccatcaataaacatattgattccccactataaacaggaaaaatctaaattccttggactggcatttaaggtattattatgtccaatataatgcctttctaactatccagagacactgtaatttaccatgtcatacctaccccgaaggatgtaccaagtccttccacatctgcaatctcttctaaagtaaactctaccttgtcaacccagtagaatttgacttatcctgtaagacatcatcaattatcaactcctctctgaagccttctctcaaatgtgtactgaacagatgaataaagaaaaaaacccataaaatcatattgatggtaagagttgcttttcacaacaagatgaaaggtacttgaggtaattcacttgcttgccatttcctagtctcatattttatctaacatctaacaggatctacaaaaactgacccaacagaaaggcagcaaaaagtaataaatcagtgttccagacgcaaggctggtagtcgtctgcctaaaatcaatggctaaatctataataatgaatacagtttccaagggaaaccttatagtgaaaagaacagaggaccaatggaggaatttaggaagtcaattaaatgaaacttgcatcaaaatgtatatagactcttctagataattcagaatgatagttattacagtgagagaaaaatggaagcaagttacacagctctactgcagctagcagctgatacttcaaatctaaatgaaatcaaacaaaaaagcatatatctggggacaagcagagggctggttaaaaaaaaaaaaaaaaggacagaagaaaactgaggttaaggccaggcgcagtggctcacacctgtaatcccagcactttgggaggctgaggtgggcggatcccgacgtcaggagatcgagaccatcctggctaacacagtgaaaccccgtttctactaaaaatacaaaaaattagccgggtgtggtggcgggcacctgtagtcccagctgctcgggaggctgaggcaggagaatggcgtgaacctgggaggtggagcttgcagtgagccgagatcgtgccaccgcactccagcctgggagacagagtgagactccacctcacaaaaaacaaacaaacaaacaaacaaaaactgaggttaaaaaaagattaaaacaaaagtaaaaatttataacaatgtgatagcctagaattttttttaaaaaaaactatttcaagaatgaaggacacaaaaatcaaataagataaagatatggaggcatccaatggatttgaaattatggagattgtcagtgaccacggcaatagcagtttcagaagagcagtgagacgtgaaccagcactgaagactgaactagagctgagtgagtagggatgggtgcaatgcaaatttccaagaagatcagttgtgcgttagggcaggacagagttatgtgtcaacgaaaaacaacaactataacattaaaagtcaataaattacagtaataaaaacgatgtgatactggcataaaacagacacatagaccaatgagtagacagtccagaaacaaatcctcgtatacatgatcaaatgactttcaacacgggtgccaagaccattcaatgaggaaggacagtgtttcaacaaaagttaataagaaaatgggatgttcacatgcaaaagaatgaagtggaacccttactttacactctattttaactcaaaatggatcaaagacctaaacataagacctaaaactataaaacttctagaagaaaagataggggaaaagcttcatggtattggatttggtggtgatttcttggatatgacaccaaaggcacaggtaacaaaaggagaaaatagacaaactggatttcctaatgtgtcaggcatcggatttcctaatgtgtcaggcattctggactttccagtgatgccactgagatagcacctgtcaaaagagcagtggttccatttctagattgtggatcttcagataaattctgccattttcatttcacttcctgaaagtcagggttggcttgtgaaaagttgttaaacaacatgctaaatgtgaaatgtcaaccctcactctaaactttccccgttcagaacatcagatacttcattgggttttatagtggctttctgatttttggtagtccgttgaagacgggagtttgaaagttgttgtatactgttaacgactgtctgtccatgtactgcctgaaataccatgattgtttatggaaagtatctttaataaagctggatacagtttggtttcggggaaaaaaaaaacatgaaaagacatttctccaaagaagatctacaaatggccaataagcacatgaaactactcattaggaaatcaacttcactaattagggaatcaataatcagtaacactaatcgtcacagatacgcaaatcaaaaccacagtgacatcacctcacacccattaggatggctactagcaaaaacataggaaaataacaagtgttgccaaggatgtggagaaattggaatccttttgcactgtcgatggaatgaaacatggtacagcaactgtggaaaacaatatgacggttcctcaaaaaattaaaaatagaaataccttctgatcccgcaatttcatttctgggtatatattctaaagaattgaaagtagtgtctcaaagacatatatgtgcacccatgttcacagcaccattattcacaatagctaaaacatggaaacaatacaactgtctattaacagatgaatggataagcaaaatatggtgtgtgtgtatgtgtatattgtgtgtgtgtgtacacacacacgcacaatacagtatcagccccaaaaagaaaataatttctgatatatgctactacatgggtaaactttgaggacattctgataagtgaaataagccagtcataaaaagacaaatactgtttgattccacttacataggtacttagagtacctaaaaaatcattgaattaggaaatgaaatggtggttgccagggtggtgggagggggaagagtgtttcagttttgtaagatgaaaagtgttctagagaaaggtggtggtgatggatccccaacaatgtgaaagtcactgaactttatacttaaaaatggttatgacagtaaaatttatgttatgtttattttaccacagtacaaaataattgaaaaaatgtgcaaatagattatgattttataaccttgggccttacataggaatgaaaaacaaaccctaaatgtcttcaataaaaacataaaacccacatgacaaccataacaaataaggtatcttttaaaaccttgaggctacaaaggtggcacatctttggtaacgagtttcccatccctggtctgggtattaaaacatttaaaaagatggcttccttcctccttgaaaataatgactggccggtgcatctttaatgtgttaccatactggtagaaagaagtgctaatgtcatggtcacttccactaataggccttggaaagggctggccctacagactgtccctttcttttatccagaaatgactagttcatcaaaaagagattcttaccaccacctctgatgtttggccatgatgttgaaagacatctttctagggtaattcttcaaaacccacatggctctagagtggccagcaactaaggtggttgggaactacatgttcattcttcaataatcttgtgggtttttttgacatagataacacctcttccaagataatatatttcaatttcaatttttgttttattctttatatatgtcctacagtccgttctcataattattcttaattggaaaaagcatttagagacagaatttactctgtacatgccacagagaaggttcttcccatttctctttgaaaattcaaccggatgcataattatgtaattatcagccttgtattgttttcaaaattatctgtagcttacctacgcttttccctgctgctgcattatttccattcattccaacaccatgggtagactacaattaaaacacaaaacatctatagaggtgagtcaatgaagaatagaaatgatcaacaaacatgaaatacttgtattttatcactaagatgctgttggactttcattttaaattatttattccaatttttgtttaattaaattaactcagaacctgattccacatctagcaatatcgtgcttattatttatctttaagagggtagaatttgccgggtgctgtgactcatgcctgtaatcccagcactttaggaagctgaggtgagaggattgcttgagcctgggacgtcgtggctgcagcgagctgtgattgcaccactgtgttccaggagtttgagagcagcctgggcaacatggtgaaaccccatctctacaaagaatataaaagttagccaggcatggtggcatgtgcctgtagtcccagggactcaagagactgaggcgggaggattgcttgagccctggaggtcaaggctgcagtgaaccatgattatgccactgtgctccagcctgggtgacagagtgagaccctgtctcaaaaaaaaaaaaaaggccgggcgcaatggctcacacctgtaatcccagcactttgggaggcccaggcgggtggatcacgaggtcaggagatcgagaccatcctggctaacacggtgaaaccccatctctactaaaaatacaaaaaaaattagccaggcgtggtggtaggtgcctgtagtcccagctacttgggagcctgaggcaggagaatggcgtgaacccgggaggcagagcttgcagtgagccgagatagcgccattgcactccagcctgggtgaaagagcgagactccgtctcaaaaaaaaaaaaaaaaaaaaagggagagagagagtgaaatttgatgactcaaataaaaagttcttacttgggatggaaaaaaacattaaaaacatttagcatttaaaaatacatatttttaatacgtatttgaaaatatgggtgtattggcatgttcctatattcccagctactcaggaggctaaggcaggaggattgcttgagcccaggagtttgaggagtacaacatatacatacatatctgataaactgtttacattaacttatgttcaaattactgttctcatttcaggactaaaacagcattcaaaattcgactatcaagattttatacaaactaaataaacattttcagataaatttatgaaaataatctaatcttagccttccttatttatgtaaacaaaaaccaaactttaaataagttgaatcactacaaggataactactagagcatgttgaaaggaaaatactgaccaaaaaaactcctgtatgttctaactggggagaacttttcctaaagttttcttcctgaaaatgctggaggtttgtagacagcccagttccagagttctgaagcctgcctgccccacgtgtgctctgtaatctatttctgcttgtgctcccggccagtgaggcaagaaaactgatattatttacacaaccaacaggctctttggaagccttgttagtcatttctgtgatatcccgagcctcaactttggaaataacatcagatcttttcccaagtgaatcaactttaacaccttgaaagcaagtagtcctagagaaagaagaatcagttatgttttgaacatccagtgactgagaagaagaaggctgtagcttcccaaactcaaaacatttggactgtctctctggtttcaccagagaattatgtagcgacattggtgcagaacagcgaagaggtgacaagagtctattcttgtgaggacttaattcccggtagttaagaactgaagtctctactgattccccattcagcactcctgcaacatgcttgagatgctgctctggagctttcaaccctttgtcagcattagtgagtagcaactccagattcactttgcacgcaccttctaagccgctgctctgttcatcagcatttccttctgcaaatgaagccagtgagcccactttaggtagaagtgattgttcggttacacattcttctgaaggtaagacaatgttcccattactagatggcaagtttcctaaaaaatgttttgtttgcctaggcagggatgatccaagatggagaacagagtcagcaagctcctggtcatttcccaactccaaatggggtatctgaggaggtagtttgacgttgctactgaagtgagacagtgtgttattctcccagctattatcttccttaagaaattcaccagtgatagaagatatgtatctctcagcagagagttgagttgccaaacttgaaattccattcctggagatttcgggcggatatgcattcccaaaagcaggtgaacaagattgaccaatgttggggaggacccttaacaatcggtggcgagatggtgcagtggaaccactagaaggtcgaggagctacaggtgggtgaggttttatcttgacagctttcttaggctaaaaggaatgaatatacagtttctttacacagtcgttttctctgcccattaacaaaaattagcgaaggaagaaaatgttacttaccataacatactagcatttttactatctcaatttaaaatgtttaagaagaataaaatcttaagattatgacagagaagatgctattttccttcactgagtatacttttctgggaatattaaagaaaaataattttgttttatttccttactgctgtttctcagagttttactacaaagaaaatgaactgattatattagatatgacattgctgacctattttagatctccaacaatttttcctactatgttgaataaatgtttcattggactggtacacagaaaaaaagttatcaatcctaaaaaaaaaaaaaaagttaaaagggctaaactgctatccttgaaaagacttgctggcaacactggcctttggctggcttttgggaacatctatttcaggaggttcaggagggttcccatgaacctaactgataagagtcgttcattgtgccaaactatttacgcaataatacagttcatgatgaacacttgctttccttttgggagtctgaaccgcaaatgctaggcagagggtgcctacaatgaagaggcccagtaaaatccctgggcacagagtctctaatgagcctccccggtaaacaacatttcacatatattgttacaactcactgatagaggactaagcacatctcatgagactccactgaaagaggactctaggaagcttgcacttggtttcctccagacgtggctctatgcaccttttacctttgctgattttgccttgtatctttttgctgtaataagtacaactatatacagcaacatactacagccctgtgaatcttcctagcaaaccatcacacctggggtggtcttggtgccctctggcatggtagattttttaaaaagtaccacaaaaattcaagatcttatgaataaagttgagaactaaacacaagaaatctagctcttaaaaataagcaaaaatggtagcaagcaggcatgaggatgggatggaataccttatgacataccaatgctcccacttacagaagatataaaatatatgaaaatataagaaaagctggataattcagtggataccaactgaggcaagaaaaattagaggagctaagaaggaagaaaccttggaaagatgagctggctcctatagatgtttttatcctagagacagagttgtcgcctaggcaggagtgcaatggcacaatctcaggcctccacctcccgggttcaagcaattctcctgcctcagcctcctgagtagctgggattatgggcacccgccaccatgtccaggtaatttttgtatttttagtagagatggggtttctctatgttggccaggctggtctcgaacccctgacctcaggtgattcacccatctcagcctcccaaagtgctgggattacaggtgtgagccaccacgcctggcccaatctgtaattctttatccagcaaaaaattcttcaaaaattaaggatatgacttctgggctgttgaaattaatgacagctgcctaaaactgaatttctccatgctccagaaaaactacacagatcaacaacatacacaaataaaatcactcataacccatgcatcagaaaaactgggagacatatgatatgaacttcaaaatattccccaatccaagaaactcatctgcaaagcctatgcctgtggtgacagacaggcaaaagtatggagaagtatggagcttcaccaaaaaaaaaaaaaaaaaaaaagggaaaaaaaataaagaaagaaaaggagaggtttgctgatggaacaaagaaaaatccacaaaagacaaaatcccacttgattatgaagatactaaaaatagatctaagatatgggatatcaaacacaggctaccgagaaattaaaaggaagtgactttatttttatgtgtattttttgagacagggtctggctctgttacccaggctagagtgcagtggtacaataatggcttactgcagcctcaccctcccagggtcaatcgatcctccgagcagctgggactacagacacacatcaccatgcccagctaatttttatattttttgtagagatggggtctccctatgttgacaggctggtctcaaactcctggattcaagtgatcctcccacctctgcctcccaaagttctgggattataggcatgagccaccacaccgggcattaaagttgttcaggataaaggaggtagcttcaagaagacatcactttttgaagggagaaggggtaaattgaaaggaaaaggcaaccattgagactttgatagtaaaagtaaagaaagaagcaggaaagggaaaataaggatccttcaaaaacagtagtgaatcacaaatcagaaaacatactgacactgccctccaataagagtgtcattgatttgagccaggcatggtggctcacaactataatcccagcactttgggaggccaaggtgggaagattgcttgagttcaggagttcaagaccagcctagaaaacatgagaaaaacccatctctatcaataatacaaaaaaattagctgggcatggtggcaggagcccgtagtcccagctacttgggaggctgaggtgggaggatcgcttgagctcaggaggcagaggttgcagtgagtcaagatcatgccactacaccccagcctggatgatagagcaagaccccatgtcaaaaaataaaaataaattaatttttaaaataacaaataaaaaagtgtgtcactgatttaaaaaacctgcatctcactacaccaaaggaagaggatgctcttgaaataagaaacttacttccctacacaaaatcctcacttctgtgtattaatatataactgttaatactcatctaagtaaataaaattatagaaaatacaattagaaaataaatagaaaaaggcagaccaaatccatgtaaagctgctataaaaataaaacagaaaatgagaatcagaacattttagctaatgaaaatcctccctaaaacaatgaaacaaaagaaaactccatcacaataccccaacctaaattaagtatcttttagtatttgcagatattttttaaaatctcatcaaatcataaatgcaaaaactcaaggcagaatagataaaagtaataggaggatacgaaatgagagctgagcaaacccagaaatactctgcagaaaacaaaatcatctcagaaatgaagactaaattacaaggtgcccacaggagactaaaattctacttaatatttaataaagaatactgagaaaaggtataggccgggtgcggtggctcacacctgtaatcccagcactttgggaggccgaggcggatcacgaggtcaggagatcgagaccatcctggctaagagggtgaaatcctgtctctactaaaaatataaaaaaattagccgggcgtggtggcaggcacctgtagtcccagctcaggaggctgaggcaggagaattggcatgaacccggaagacaaagcttgcagcgagccaagatcgcaccactgcactccagcctgggcgacacagcaagactccatctcaaaaacaaaaatactgaggaaaggtatgaaaacagccaaaagaataaaaataaaataaagaatctaaaaggataagagagaaggtggttgtatattagacaaagaagttctaacagggcagagggggtatctcatgccgctgaggcaggaaggtcacttgagcccaggagttcgaggctgcagtgagctcaggctatggcactccagcctgggtgacactgcaagaccctgtctttaaaaaaaaaaaaaaagaaagaaagaaagaaaagaccacgacgatgttctaacttatgtataaaataagctccaaaggccgggcgcggtggctcacgtctgtaatcctagcactttggaaggccgaggcgggcggatcaccaggtcaggagatcgagaccatcctggctaacacggtgaaaccctgtctctactaaaaatacaaaaaattagctgggtgtggtgacgggcgcctgtagtccagctactccggaggcagaggcgggagaatggcgtgaacctgggaggcggagcttgcagtgcgccgagatcatgccactgcactccagcctgggcaacacagcaagactccgccccccaaaaaaaaaaaattccaaaaaagaaaacaaacaaaaaaacaaataaagtactaaaaaaaaaaaacatataaattctaagaaataatcctgaaataaaagacttgaatctttatgttaaaaagactcaagtgtatagtgaaaattgaccctgaagagttaattccaagatacatcctaataaaaccactacatttaaaagaaaaaaaaatcctcattttctccagacaaaaaaaccaaatcatttacagagaaaagaaagattggtaattagatttctcaatggcaatataaaaagcaaagcatagcagagcaacattttagacaaactcaagggaaaagatgtgaaccaaacattttatatccaggcaagccatcatgtaaggattaaggctaatgtttctagcattaaaaaaagatgaatatttaaggttatggatatcccaattacactgatctgatgtttacaaattatattcatgtattaaattatcacatgtaccctgaaaatatatctattacgtatcaatgaaaataggaaaatacaaaaatagaagaaaaacctacaattaatatcatacataatggtaaaaacaaataaaaatgttaagtctaaagaaaagggtttgaacatcgaaaaattcaagaattactgtacctacaagcctttcttgaggacttcagatgagcttcttctaaccaaaatgtatggggaaacctacagcaaaaagactgatcataagaatggaatacaattggccgggcatggtggctcatgcctgtaatcccagcactttgggaggccaaggtgggtggatcacaaggtcaggagttcgagaccagcctggccaacatggtgaaaccccgtctctagtaaagatacaaaaaaaaaattagccgggtgtggtggcacacgcctgtaatcctagctactcagaagactgaggcaggagaattgcttgaacccaggaggcacaggttgcagtgagccaagatcgtgccattgcactccagcctgggtgacagggcaagactccatctcaaaataaataagtgaataaataaaaaggatggaataaaattaaaactaaaataagagtgagtagaaagaaaaatgatttgtaaaggctatgttttctttaaaaaagtagaaaaaaatttttaatgagaggatgaagagagaagagaaaaaaataagttcactgattttcacttagtaattaggagtcaaaggatatttaaagctggcaaataaaagaggagaaggttaaataaggaaaaggcagatcaagaacatgataaatagtattaatgtaaagtgaatcaataaaacaaaatgcaaaagccttctgaaataccaaaaaatacacccttacacattcatatatacagatacacacaaaagaaagcatagagaaggaaactgtaagtataacaaaataagacatttaagaccaaatatgaagtcatatcaataaatataaacgtgattaagttacctgttttaaaatttcaagctggctcacaaagcaaaaaccaactctatagtgtatataaaggaaatatgtaaaacaaagtaacttaaaagttaataaatagagacatgggaaaaggtataccaagcaaatgaaaccaagaagataccagtaggtatgggcctgatatcaggcaaggaaaattcaaggggaaagtcagtgaatgtgatagagatgaaacatttcactacttttgtaactagcaacacagtgaaaatatgttattaatatttatgtaccaaattacacaactaccactttcttacagcaaaaagtatgagaaatgaaaagagaaatacacagaaacctatgaataatagaccttcatctattaccattctcattctaagacagatcaagttgacaaaaaaaaaaaaaaactttaataaggtctatcttataaatatctagcaaacttttacctttttgatagagaataaactgtcttctgaggtatatattcatgaaaagtgctattagatcccaaagaataaaatgctataaagtagaaatacaaacaatattctctgagttccatgcaataaaactagaaattaaaaacaatgaaaaatcaagcccggcatggtgctgcacacatagtcccagctacgtgggaggctgaaatgagaagatcccttggtcccaggagttcagtaacatagtgagactcccacctctaaaaacaagaaaagaaaagaaaaagaaaaaccaaaaagcctctgccaccagaacattttcaaaatatattaaaatactcttggactaatgaggaaataccaactaaaattgcaaattttctttaaaaaaaaaaacgaaaaagaaactactacaaattaacattatgtgccttctgatgtgttgcactgagaagaataaatcatctgtgtagtattcctaccaaaaatgttcaaattccatctaatcataatgaaacagccaaatctccaaattgaagaatattttacaaaacaactgatctatattcttcaaaaatattttacatgcatgtccaaataaggcttagaaacagttttgtataaaaggagactatgaaaacattacaacgaaatgcaatgcatcattcttgattggatcccagattaaaaacaatataaaatgctattaagcacattattaagacctgggaaatatgaatatagatgacataatgtgtatcaatcataaatgagtatggtaactgtatcataatcatgtaaaaggtggcccttattcttaggagatacataataaataaagtacttaggggaagtgtcatgatatctaacttgcacatagatcagctaaagaaaaatccaaacagaaagcaaatgtgggaaaatattaattgatgaatctagtcttataacatttctaaataattaaacatttctcagccaggcgcggtggctcatgcctgtaatcccagcaccttgggaggccgaggcaggcagatcacggggtcaagagatcaagaccattctggccaacatggtgaaaccccatctctattaaaaatacaaaaattagttgggcatggtggctcatgcctgtagtcctagctactgctactcgggaagctgagggaggagaatcgcttgaacccaggaggtggaggttgcagtgagccgagaccacaccactgcactccagcctgggcaacagcaagactccatctcaaaaaaaaaaaaaaagaattaaacatttctcaaaattaaaaaggtaaaataagttttcagacaaatgctgagagaattatcatcaggaaccctaaatgaaaagaagtactagtactagaagtcctagctggagaaatcagacaagagaaagaaataaagggcatacaaatttgaaagaaggaagtcaaattatccttgattgcagataatatgatcttgtatttggaaaaacagaaagactgcaccaaaaaacgattagaactgataaacacattcagtaaagttgcgggatacaaaatcaacatacaaaacccagtagcatttctatataccaacaataatctaaaaaaatcaagaaagtaatctcatttacaatagctacaaataaagtaaaataaaatacctaggaataaacttatctaaaaaagtgaaagatctctataatgaaagctataaaacattggacgacacaaaaatatgaaaaaatattccatgttcatgagttggaagaattaatattgttaaaatgtccatactgcccaacgcaatctacaaattcaacataatctctatcaaaataccaatgacatttttcacagaaacagaaaaaataatcctaaaatttacatggaaccacaaaagacacagaatagtcaaagccatctaagcaaaaaaaaaaaaaaaaaacaaaaaaaaaacaaacaaaaaaaaactggaagaatcacaattatgtgactttaaattatactacagagctacagtaaccaaaacagcacagtactgacatgaacatagatgcacaaccaatggaaaagaacagagaacccagaaacaagtccacagacccacagtgaacttatttttgataaagatgccaagaacatacactggggaaaggatagtctcttcaataaataatgttgggaaaactggatccacatgcagaagaatgaaattagaccccttatcttttaccatatacaaaaatcaaatctaaatgaactaaagacttaactctaagatctgaaactatgaaactactaaaagaaaacattgaaagtagggtctcaaagacatatttgtatacttatgttcatagcaccattattcacaatagccaaaagatgggggcaatccaagtatacattgaggaatgaatggattaaaaaagtgtggtatatagccatacaatgaaatattatccagccttaaaaaggaaggaaattctgacacgttatgacaattttacaagacaaaaaacttctggagattggttgcacaacactgtgttatacacttaacattactgaactgtttgtacacttaagatggttaagataattttatgacatatgtattttaccacaaaaataaaatttaaaaaattttaatggtagaatctagatattagataaataagtgttcatggtaaaattctttcaaccttactgtatattggaaaagaaaaatatagatcaaaatttctctcatgaatgaaatcgtaatgcaaaaatcctaaagaaaatattaataatttaaatctaaagaaatgaaaaatacatcacaaccaagaatggttcattctaacaatgcaagactattttatatttttaaaaaatcagttcatcacaatatcagaatatttttattcagtgaaaaaatacttacttctctttggacttcttgactatcagttacttagaagtgtgttattttcaaatatcagaaagctttccacatatctattattaatttctaattttattccattgtaatcagagagcatttttgtattatttggaatcttttataatttatttgaaactggtctaggcgcagtgactcatacctgtaatcccagcactttgggaggccaagacaggtggattgcttgaggtcaggagttcaagaccaacctgaccaacatggtgaaaccccgtctctactaaaaatacaaaaaattagccaggcatggtggcatgagcctgtcgtcccagctactcaggaggctgaggtaagacaatcgcttaaacctgggaggtggagattgtagtgagccaagattgtgccactgaacttcagtttgagggacagagcaagattctgtctcaaaaaaaaaaaaagaaaattgaacctgttttatggcacacaatatggtttaccctggtaaatgttctacatgcacttaaaaagaaatgtgtactctgctgttttgggtagagcatactgtaaatgtcagttgggtcaagtaggttgattagtgttgttcaagtctcctaaatccttcactgattttctatctgttccatcgatttttgagagtgggatgtagaaatctttcaacaaaagtatttgtttatttctttgtagtttttgcttcatgtattttgaagttctattattaagtgcataaacatttaggactgtgaagaaaggatgttttttcttaatagagctaagtcaattgttccccatcagaaaaaaaaaaaaaaaagatctttaccccactttacgttatatcagaaaaatttcagctgggcgcggtggctcgctcctgtaatcccaacactttgggaggccaaggtgggaggactacctgaggtcaggagtttgagaccagcctggccaacatggcaaaaccccatctctactaaaaatacaaaaaatagccgggcatggtggcacatgcctgtagtcccagctactcaggaggctgaggcacgagaatcacttgaaccaaggaggtggaggttgcagtgggccaatattgtgccactgcagtccaccctggagacacagcaagactccgtctcaaaaaaaaaaaaaaaaaaaatttcagctggactaaacctaagtgagagaaaaacaatcataaagctttaaagacctgtggtaggaaaatatttcatcaaaaggttatcaaaaatgataatcataaaagtaagctgggtgcagtgactcatgcctgtaatcccagcactttgggaggccgaggcaggcagatgacaaggtcagaagttcaagaccagcctgaccaacaaggtgaaaccccgtctctactaaaaatacaaaaattagccgggcgtggagatgcgcacccgtaatcccagctatttgggaggctggggcagaagaattgcttgaacccaggaggtggaggttgcagtgagcagagatcacaccactgcactccagcctgggcaacagggcgagactctgtctcaaaaacaaaacaaaacaaaacaaaacaaaacaaaactgataaattagaatacaattaaaaacattcacccaaagaataagaaagtaaaagaacaagccaccatagagtgttagaagtatctgcaacccatatatctgacaaaggacttgtacccatagtatataaagatgcctagaaatcagtaagcaaaaggcagagaactcaatttaaaaataagcaaaagacttgaacaggcacttcacataaaaaacgtatcttaatggtcaataatcatatgaaaagtcaatattattcctcattagagaaatataaaagaaaaccatttacacagtcaccagaatggttaaaattaaaaggactgacaatatcaagtgttgacaagaatgtggcataaactagaactctcacgttgctgggaagaatgtaaattggttcaaatgcttggcaaaattggccgggcgcggtggctcatgtctgtaatcccagcactttgggaggtcgaggcagtcagatcatgaggtcaggagatcgagaccaacttggctaatacggtgaaaccccgtctctactaaaaatacaaaaaaaaaaaaaaaaattagcccggcgtagtggcgggcgcctgtggtctcagctactcaggaggctgaggcaggacaatggcgtgaacccgggaggcagagcttgcagtgagccgagatagcgcctgggtgacagagcaagactctgtctcaaaaaagaaaaaaaacaaaaaacaaaaaaacaaaaaaaccaaaaaatgcttggcaaaattgtctggcataatactaaagttaaacgtgcatcttccctctgactccgaaagtccattgctaggtatatgctccaaagaaacaagtgctatgtccaccaaagaatgtatgagaatattcaaaggaagtttattgataaaagccaaaagctagagacaactcaaatgtccatcaaaaggaaaagaaagaagcaaattgaggtaaatcaatcacacagtacaatagtacacaacaataaaaaagaattaactgatacatacaaccacatggataaatcaaacaaatacttttaacaaaagaaaccagaccatactctctatgattccatttatataaatttcaggaataggaaaaacgtatttacggtaatagatgtaagaacagtcgttatttctgagagtaggaacaggtacgtattaactgggaaatattatgaggaaacattctggagtgaaaggtcctattttaatttgggttgtgtctacatgagtgtatataaatgtaaaaattcgtcaagtagtatattaaagatttttgaattttattatacatgaaaaggaagggagccattaatagagtaaaaaggaaagcaataaagtggtaatatgaaacaaaggacttttatctagaatatatataaaactccaaaaaaaatctgtaacaaaaaacatacaacccaatagaaaaatggaaaaatataggtgttttattaaaaagggtatccaaatgcccaataaacatatgaaaggtgctcaaccttccaggtctcatgagagaaatgcaattaaaaccacaatgtgatgccaccacaaacaaagtaggattacaaaaattacaaaggaccatgccaaatactggtaagaatatgggaaaatggcaactctcattcactgttgtaaagaatgtaaattggttcaatcactttggaaaaaactggcactatctactaaatagtagatatctttatccataataaataaatattaacatattttaaaaagtaattattgccagattaagattaagctctctttttttatccttcttagacccagaatgatctttaaaatgatgttaagtgcagtataatcccttcaggtgtgcttctaatccaaaaaatccaatttatcccttttagaagtttaataaataactgaggccagaaacctgaaatgaataatactttataattttttcacaatgaccaacagacctcattgctgagtgctctgcaggggtaagctagagataagcctggtcaaatgccaacagcttcacctttttgctgagattcatgttcttcatcttagccttcagcagcttcatcttattcatagttattgaattttcaattatctgttgcccagaagaagaaggctcagtttcttcatcctcatctgtatctgaattatacatagaaccaccactgcaaagaaaacaataactacttgaaatttttctgatacctgctcagtgactaaaaatgctctatatgaaacagcaatctatagaagttactaatgataaaacactacatccattttgtcaatgttaatgtcaggaaaatatatttcaaagaatgtacttcttaaaagaaaaaatgaaatgggaataaatattatgatctaggattactgaaaatctagtatagctgagcttctctgaattcagtatatcataaatgaagatgttttgacacctgccatatcattcccaaagaggcaaaatccatttccatgagaatgtctgatttcattttatcagccaaggctgataattgtgcaacccagacaacaggctgatgagatttccatgaatcagaatttttttaaatttggcacgggagagaagtacagatttttagtcatcctgaggagattctcactaaaaaaaaaaaaaaaaaaagaattcatacacaggtgtcatcagaacattttctattcttaaggagcaaaaaacattttttttttcttgagacagtctcactcttgtcgccaggctggagtgcaatggcacaatctcggctcactgcaacctctgcctcccgggttcaagcgattctcctgcctcagcctcccaagtagctgggactacaggtgtgtgccaccatgcccagataattttttgtatttttagtagagacagggtttcactgtgttagccaggacagtctcaatctcctgacctcgtgatccgcctacctcggcctcccaaagtgctgggattgtaggtgtgagccaccgcgcccagccaatacatttttttaagtagagataacttcaaatttttctaagtgtgtttgaaaatgtaaaaacctagactagcatagattttaacaagaaaaaacacatccagtcaagtcatgatacaagctattaaacaggttaaacatttcaattactgatcaaccacagcgacgttattcatatttcaatgtaattaatatttggagcccttcctctttgattgtataatataatgatgtatcacacgatcctcatatttatacttacatgtttgttttgccccttattctcccacatgtaagcaagttgaaagcagacattagactttatcttctgagtctgcaccaggcacagcgcttggcacatagccaataaatgtttgatgaactgaacacaaagattttgaaatttaatttattttttctataatgggaaaattagaatggcaaggatttgataaaacacaagcttggcacatttggaaaacaattaagactttaaataaagcaaaataagaatacatattagtttctatgcagatttacttataggaaaactaggttatctacactatggaagtatgaggaaaatttcccgttttatatggttgtaagaaatggaaacaatttaggacagccttaatggggtatattccttaatgtttctgaagcacatattgtcacacaaggccaaaaaagagagcagacagccccattcctaaattttatatggtgcaacatgaaatgttctgaaactgtgggttaattacacgcactatacgcatgggtagcatctgaaggaagaatgtaggactggtctccacaaccaattcagtctgtggtgcttgacttgtgacagccacagttacctactacagcatggctaccacagtatgataactgacacaagtacaacactgaagtaataatattgcctgccatttactgaatgcctgctctgccaggcacttcccacacattattcctaattctcacaaaactacataaggtagatattatagctgattttattaatgaagaaactgcaggtgagagaggttaagtgatttggctcaagatcagaaagctatagacagcagacctaagattcaaatcccctatgtgtctggttcctaagctgattcttcctactactactcattgcttccccaggcaccaaatgacaggacttactgcatcatgcttgtgcacccagatgagtgccagaacttctactgtgtgaaggcttttgtctcaaggccaactatacaatacctgaagaagggtgcatgaagattttcgtcatgtcaccctgtggagttagaaggaataactcaagtatacactattctcagttaccttgcaatattttaaccttaaatacttctgagttactctgtggcattttaagtatctttactgaatactgaaagaagtttctgattcaacattactgtcatgaaaagacctattctctcatggaatagatacatatatacacacacatacatacacacatatatatatatataaaagaacaatcagctgggcgtgatggctcacgcctgtaatcccagcactttgggaggccgaggcgggtggatcacgaggtcaggagatcgagaccatcctggctaacatggtgaaaccccatctctactaaaaatacaaaaaattcgccgggcgtggtggcgggtgcctgtagtcccagctactcaggaggctgaggcaggagaatggcgtgaacccgggaggcagagcttgcaagtgagccgagatcacaccagtgcactccagcctgggcgacagagtgagactccatctcaaaaaaaaaaaaaaaaagaacaatcatgataaatcactggactcattttagagtataaaaacacttttaaattcacctttttttttcaaagaaccacattattttgttttctctcatgaagtatagattcatgagatgagttagaatccaatcacaaatttttttcagatgaaaaaatgtaactaggttaacatactaatttataaatttaatccgaaatgactttctttatatttaaatataatataacatttccttgaatttctaaattttttttagtgctatatgtaatttctccaaatcttttttttttttttttttttttttgagacagagtttcactcttgttgcccaggctggagtgcaatggtgcaatctcggctcaccgcaacctccacctcccgggttcaagcgccctttctcctgcctcagcctccctagtagctgggattacaggcatgcaccatcacgcccggctaattttgcatttttagtagagatgcggtttctccatgttggtcagactggtctcaaactcctgacctcaggtgatccgcctgcctctgcctcccaaagtgctgggattacaggcatgagccaccacgcccggcctcaaatcttttgatttaatgatatgattaaaggatacaagataggcaaatgtaatattattcaagcatgaaatctgcacatcgcaaagccaagacctcatttaactttcacagtttaccattaagtcttacaatgtctccttatctatctttctgcttaaaaaatcccaggccgggcacagtggctcatgcctgtaatcccagcactttgggaggccgaggtgggcggatcaccaggacgggagatcaagaccatcctggctaacacggtgaaaccccgtctctgctaaaaatacaaaaaattagctgggcatggtggcgggcgcctgtagtcccagctacttgggaggctgaggcaagagaatcgcttgaatctgggaggcagaggttgcagtgagccaagatcgtgccactgcactccagcctgggtgacagagcaagactccatctcaaaaaaaaaaaaaaaaaaaaaaataccagtaaggtggcatgatccactaaaaagatttgagactaaaaaaagactgatgctgcattttgtatcagaatgaaacaaattaacactcaattctccctctttctttttagagtagaagccagcaaaccatggtcatgggtcaaatctgccccaccacctatttctatttctgtgtggcccatgagctaagaatggtttatgaactttaattagttgaaaaaactcaaaataatggtatttcataacaaatgaaaattaaataaaattcaaatttgtgtccataaataaagttttattggaacaaagccatattcacccaatcatgtattacaaatggctgcttttgcctacaatggcagagttgagtagctatgacagactttatgtggctctctcgttgctctacactgtgatatggagaactacaaatcacagtaacatagtcataattcaacagtattttgactgccatgtatattgctattctgtgactttttttattactagggtatacccaaccttgtcaaacaagaaaagtagacttcaaatgttgccattttaaggtaccgtagagtggattatttgttagcaattagatagcaaagcatgatgcttataatgcagtgacactatagctatgctaaaggaaaacagcataaatagacattaccaggttaggcattcatcacaatattcccaactttcaggaaagcaacagtcagaaaaactagaaaatttacagtagaatatctcatcacagcagaatttctttacacaaataaaaaatgaaaatgaagctataaaaccaaagaagtttctgaatgtttatatctgctagccaagcaaggaaagctactcatcaatagtgaattaattcactattgatcacagcagttgaggaagtatgtcctgagaaaataaagttgtttaaagattacttttccagcagggacaatttctcaaaaagttgatagaattggaagtaatgtcaacagctgatttaaaaagctgattgttttttgatgagctgacatatattacccatattgctctgtgttattgtttattgagggcgtcaataccaagtttgaagtgactgaagagttggcccctatgaatagtctgcatgaagctactacaggtgagaatattttcaaataaattgctaaatactaatttagtacaactttaagtgaactctgctataactgatggggtgatgtgtgaaacagaaaaaaacttattggacaaatttatagttagtgaacatgtaaggtctttttttttttttttttgtctttttgagagggggtctcactctgtcacccaggctggagtgcagtggtgtgatctcggctcactgcaacctccacctcttgggctcaagcaatcctcccaccacagcctccgaagtagctgggactacaggtgtgcaccaccaggcccagctaatttttttccagatggagtttcactgtgttgcccggacttgtctcaaactcccggactcaagagattcgcccaccttccaaaagtgctgggattacaggtgtgagccaccatgccctttaaacatgtaaggtctttaaagtctacagttattcattgtattattcatcagcaggtatttcatggtaaatatctgagtctatcctgtgttattaaaccagcagtgttaatggtaaacttcaattgtttcatggacttatccatcatcagtttggtggcttactggtaataaagttttattatgttttttttagctcaggaactctgaatgagaagaactggccttaactactattacaaacactttttaaatttttaaattgcctttggaaattaatttttactgtggacttcataatgtttcataatgaatttaacctaaaattacaaaataaaacaatatttatatgtgaaacatatactgcaataatgtcatgttaacaacaactagtgtttgaattacacgtaacagcaagctgcaatcattcccatgctttcaaaagtagaaattaagtgatatctctattcccacagaaatttgcagcagatatatttccgagctcaaattataggtctagcagtgtttttatacctcagtgcaatttccaaataatgttctatttcaaaattcatttaaatgtgcaactgaggagcttccagggcaaacaccaagagaagatctgatagaattttataaacgccttaaaaatgatcaatatgttcaataaaagcatgtgctcatggactgatatcagcatctgacagtacctatctgtgtgaaaaaaaaatttctaagataaaatacataaaatctcattacagatcagctctaacaagtgaacttttgcaattgactttgcaaatttgatgggcaacactaactttccacctcaattaggtaaaacgttattcccatgaaaaagaattccattcttctctggaattctgtggtacaaacagaagaaaagtacccaattgttagtcttatattttgaactttgttagtgaaagttctgtggaaatttgttttctctcgttacataagtacctatttaatatccttgatgctgtctcttggcctaaaaatcctaaaatagttactatctgcacacctttacagaagaagtttgctacccctgttgtagactaggaaagcctcttctagaacaggaaatataaatgttcttcatggtatgatcagattgttttctactcctctttctcattcatccatccctttccttgtccaattattgtagatgaatacaaaggaagaaaaaatatataaattatcttgtgatgaacaacaagacagttctaattaaattccatgatgatatttgggctgagtcataaacacaaatagaagttggctgaggagaagctggagtaagaggagaaaatgacgtttcaagcaaaggagaaaagatgtctaaaaacacagcataatgagaagacctggaaaactgatggtaacacgttgtcaaaggactcatacgctaagctgaggagcttgggtttcctttaggaaaagggagccaaaagagtgtgtactagagaagaaaactaaacagtgagccagcacacggcaaaactggtatgaagacattctattaatggcctaaggctgtaaccctcactgctacctcctccatttcttgcccagggtttatgccaagtttgaagtgctaaccagatgctgacatgttaaagtcaacaggtaacacccatgtgtcacagtctgctctctgaggccacaaaaaattcagtctaatctttctttcatgtaacactctgtggaggggcagaagcctaggggaatctctctgactcttgacccttggtgttcacatcacatatggtttcctacccttgagtgtgggcatgatggacatctagcttctagccaactgaatatggcaaaggacgttgcagatgtaatttaggccccaaatcagttggttttgggttcatcaaaagggagctgagggcagcctctagtcaatagccagcaaaaaactgggcgctccatcatataactgaaaggaaatgaattatgccagcaataagagtgactctgtaagtagattctcctccccagtcaagcctcttgataagagaattgctgacaccttgactccagattgtgggacttggagcacagcaatgctgtgcctggactcctgatccacagaaactgttctccaaactacaagctgttttttttttttttttttaatgattttaccactacctttttattttgcaggatgtgtaacaccttcccttgctttgtctgcttggcaaactccactccccttttagggtcacttcttctcagaggatgtgtctaactctctgcctttcatgcataataaaggccctgtcatctattctcccagagatcttgatatctttttataacatcaccaacattatatcactgatactcttcatagcagactgcatgctccatgaaggtaggaataatcatctttacaacatcagtgccttgctcagtgaatggccataaaagttcagtgagtgaatgcttaataacttgaagtgaaaggagataaaaaaatcatagtaactcagaatgcacagcaactaactgagaggttgccttgtccaattctctaattcttctattgcttagctaaatatatgtagggtttttcctcctgattttagaatattacaatttatctcccttttatagagtaggaaaacaagaccagagaagtaaagagatttatctgcctttaaggagcagagttaaatttagaaaaaaaggtatcaactttaggtttaaccctttctattatgctaaggttgtataataacacactattatgacaggattctataatctattaggcatcttagagtttcacagactaacagaaacaaatctttttatgaaaacatcccactctaaaaaaacctcagttttatcatatcaattatacgaaggacaatttcagacttatatattgggggctggggcaggaatgagatgcatgacatttgttaatatatatagattattttgacaacacaaggtaaacaaaagtttatggagtacctcatacgatgttctccttttctccgtaggacatgcaaatgaaaatctattttctttgaagagtcagataacggtgttaaagtgccatctcccctatctactgcaggaaagaaattcaattgatctccttcttggtataccaaaaatgtaacttgtttgctgcaggaggtcttctcccagacctcaactcgactggaatccaagtactctgccatcttcctaagtggatcgtctgtaggaactacaaatggaaaattgaaataagtcttcaatttggatcaagttttatgcatcttggtacagtgacaggatataatatactgaatttgaacaacagtcctgtgcatataatataaacatgatattcttcaaataagtttctgatctttctacaattaatatagcattccctatgttatattaataagaaacaaacaaacaaaatgcatgattatgttgctatattcaaagacagggctaaactaaaacatgagagttttttgtcctatgccattatagtctatattttttccctatgtcactagagtctgtgtatttgctgattctatgatattactatcaataatttttttactatatactttctgctccctatattttcaaatattggttccaacaataattaaaaccaaaataaattccacttacgttagattaaaagtacacagacacggccgggtgcggtggctcatgcctgtaatcccagcactttgggaggccgaggcgggcagatcatgaagtcaagagatcaagaccatcctggccaacatggtgaaaccccgtctctactaaaaaaaatacaaaaattagctgggcatggtggtgcgcacctgtagtccctcaaaaaaaaaaaaaaaaagtacacacacacacacaattaggagacatatctaagaaattagaagtaagcagacctatctttttctttctggttttatataaaggctgattcttaagagctgttccttgacatgaagttaggtaattaaaagtacataataacttagaacgtgaggggggtcacttcatgtactaaaactgcaacagttccaggaaaaaataaaagttctctcccaaagacattctcatcatactgcagaaacatctgttttctcctaaaagaggtaaagatttcccaagctgcataactttcacttatttattaacagaatcgtggtgctctacaaccctttaaaaagaagttgcagcaataggaaaatattaaacttggaaagcagtaaggtaaaaacatcaaagatgcttccatagcctaaattcaataacactattactaacataaaaatcttataatatggtttagcttgctttatgaaaacagttatttggatgttttgatttactttcacaggcccaaaatgtataaatattaaaagacacttttcaaacaagttcttgccttttgtaagttaatgctccactttccatattacatcaagagataaaaatttggatcagagagcagacctttaggggggaaaaaacccaacaaaacacaacaaaaaagaaataaaaattatgcccattttttagatattgctatagccattaccacagtcacatgaaagcctttcctaaaccagcacagggtgccttactcaggcaagtgtatgtgtggatcttctcataacagaaaaatctttcagattttatcagctataaaacaatatatatgaagtttgatatgcattgggcacaatttagttttagaaaagaaacattttaatctttctatgctgctttgataatagttatttcaaaaacaatttttttttatttgtattcgttttttgagacagagtctcactctgtcacccagactggactgtagtggcgcagtctccactcactgtaacctctgtcacccagactggactgtagtggcgcagtctccactcactgtaacgtctgtctcccaggttcaagcaattctcatgtctcagcctcctgagtagcccgccaccatgcccagctaatttttgtatttttagtagagatggggtttcaccatgttggccaagctggtctcaaactcctgacctcaataccactgcctgtaatcccagctactcgggaggctgaggcaggagaatcacttgaacccaggtggcagaggttgaagtgagcagagatcatgccactgcactccagcctcggtgacagagcaagactccgtctcaaaaaaaaaaagaaaagtaaaaaatatatatatttacctcagaatctgtatcacactcctcataaacatataaaataattttagttctaataagaaaagtaggtgttttgattaaacactttggtttaaagtagtactacgcacaaataaccaactttcaaaaatgtaatacaatagagttcacatggcattaaacactatataattctatcttaacataatggttcagtaaacacagggttcttgtgctacttcaagagttattactataaacatcacatagttattactataaacatttatagttattactataaatgtcacataggacaattacctaaatccaattaattaaaagtctctggtatcaggagtgctaaaaggccctaacattattaactttgtttttctctaacctataaaaagcagtccaacagccaaagtagcatatctcattaaatcctcttgaaatagctaagaaaaagatggcaataatcctattttctaaccaaaattattaaacatagggatataatttgacatgtggaagcaagccaggagtagaatcaatacttatccttcggttttctggttagtgaaggatcaaataaatctgaaggacttcctcaaaatgaggtccacagaagaggatgctctgactagtctcctccacttcatgggaattcatgtgacatacctgactcagggaccaatgtgaatactgccgtctcttcttgtgcttaataaaaccctctcatcaatcaagtctccactaatgtcatctttttcgagggcccttcctaccctattttctgcatagcacttacaaccattaggagttacatcgactctttacacatttattgtaggcactgtcatgaagcagagactttctctcccatgtctaccatacttggaacattgcactgaccattcagtagacgctcaatacgtatttgttgaatgaatgactggatttcagaactacttatattctgagaaaggatgcaaccggggccatgataatatccatgaaacccagacacatcacaaaccaggtaaacaggcaatgttggaattttgcaaaacgatcatcatcttgggatttgaagatctggtagatttaaaaataaacaagactcgtatgaaactaaacacaatggtaaagtagtatttatagtatgtcattccatttctgttccctatactggcaaaaggtttatttttaaacctctctgaattggatcaggaatcatgtgatttttctgaattgtattttagagttccagcctctaggcatttaggttttaaagaacaatgcctagagaatcaaatgtgatttttctaagacctaatagcagaaaggaaacctaaataaaacctgaggctataaaaatactaactgacataaagaatgttactgtcaaattgctttaatatatatatatgcctacctcttctagtatttataggtccgccacgcatagccaaaactagcttcaaggtacacccttctgaaatgctgtggatagttaacacaaaaataaatcataatcatcaaaatgcattcagttaaatgtacacataattatgtgctggcttatcaggcagagtggccactctctaaaatataaaaagatatagcaatgtaaatacatataaaatgttaacatatttactggtacaaataataaaaaaggtgaaacaaattctcataagccataaagaaatccaagaataaacatactggaaaagacctctgtgattacgtgttttagcctgttcatttcacattaaggaaaaggaggcccagagaacaaaagtggcatgccggagacccaaagtgcagaaaatagcaaatctatttaataaaacagaaaatagaaaaataacaaggtctcctgactctcagtgctcttacagctattccacactgcctcttatccttttactcttttcttaacaaaagagtgatgaattatgtgaaagaggggagaaataagagagacaaagtgtcagaaagtacgttggtagtcactggtgcacacagcattgcttagtaacaaaaggagggcttaatgagaaaggaaagactttgggaagaacaattctctcttatccaaaactcttgtaaaaacagaaagaaaggaacatagccaggaaggaatggttcaatattcaaagaaaggagaaaagtaggcaagaagataataggaggatttcaaaaggcaggagataaacagcttgacatgaaaaatgaaaagggaaaataaatgtatcagaggataaaggttaaagtagtatacagtaccaaactaatgcatctaaagttcaggatgtataatgaaatctaggaatgtgaactattcaggagaaaaacagacatgatctaagagttcaaaagaaaaacattagcatatggagtcataatactaagtgcctacaaaacagccaatatgcaattacactcacttgtaatcattcaagcaataatcattttcaagttccatgttattccaaattaagtgttgtcgacagatgggaataccttaagggaaagttattaaaaaaaagtgttaaagaattcaatagcatctccaaaagagtatgatacaaatctatttcattaaggaactaagagcactaaaaaattaaacattcttctaaattgaatgctaggtgctaaaatttacagaatcataggtagaaggcatgcctaaaaggagatatagtccaatccattcactgtagaaaagaacagcatgttgcaataactctctggtcctaaaacaaggtataagatagggatccctttaaaaggcaagatatcatgctcctgcacagcaaaagaaactatcaacagagtaaagagatgatctacagaatgggagaacatattcacaaactatgcatctgacaaagatctaatatctacgatctgtaaagaacttaattcaacaaacaaagaacaaccccattaaaaaatgggcaaaggacatgcatgaacagacacttctcaaaaaaagacatatatgtggccaacaaatatatttaaaaagctcaacattactaatcattagacaaatgtaaatcaaaaccacaatgagatacaagctcacacctgtcagaatggctattaataaaaagtcaaaaaataactgatgttgtcaaggttgaggagaacagggaacgcatacactgctggtgggaatgcaaattagttcagccattgtggaaagcaatgtggagatttctcaaagagtttaaaacagaacgaccattgaacccaacaatcccactactgggtatatacccagagaaaaataaatcactctatcaaaaagacacatgcactagtatgttcatcacagtactattcacaatacaaaagagatgaaatcaatcaagatgcccctgcaacagtggactggacaaataaaatgtggtgcatatacaccacagaacaccatgcggccataaaaagaataaaatcatgtcctttgcagcaacatgaatgcagctggaggccatcatcctaagagaacaaatgcaggaacagaaaacccaaataacatgtgttctcacttataagcaggagctaaacactgagtatatatggagacaaagatgggaacaataaacactagggactacatggggagggaaggggatgtgggttgaaaaactacctatcgagtactatgctcacatcctgggtgacaggataattcatacaccaaacttcagcaacacacaatttacccacgtaacaaacctacccatgtatccactgaacctaaaagttgaaaaaacaaaaaaagatattgggctgggcacagtagctcatgcctgtaattccagcactttaggaggccgaggcaggtggatcacgaggtcaagagatcgagaccatcctggccaacatggtgaaaccccgtctctactaaaaatacaaaaattagccaggcatagtggcaggcgcctgtagtagcagctactctgtaggctgaggcaggagaatcacttgaacctgggaggcagaggttgcagtgagccgagattgcgccactgcactccagcctggcaacagagtgagactccatctcaaaaaaaaaaaaagatatcatgaatcaggcctgaagagtttagtatttgaggcctaaaatggaaatcaaaagcaagcaggagtagctattcttatatcagagaaaacagagtttaaagcaacaatattacaaaaaaagacaaagaaggtcattatataatgataaaaggatcaatccaacaagaagatattacaatcctaaatatatatgcacctaactcttgagctcccagattcataaaacaattgctatcaggaaaagagataaacaacaacacaataatagtgggggactttaacactccactgacagcactagacaggtcatcaagccagaaagtcaacaaagaaaaaatggacttaaactgcactctagaacaaatggacctaacagatatttacagaacattcaaccgaagaactgaaaaatatacattcgtctcatcagcacatgaaacattctccaagatagatcatatgagaagccacaaaaaagtctcaaaaatttttaaaaaatcaaaattctatcaagtatcccccccagaccacagtggaataaaattagaaatcaactccaaaagggaatcctcaaactatacaaatacatggaaattaaacaatctgctcctgaatgatttttgggttaacaatgaaatcaagatggagatttaaaaattcttccaaaggaatgataatagtaatacaagttatctaaacctctgggatacagcaaaagcagtgctaagaggaaagtttatagtgctgaatgcctacatcaaaaagtctgaaaggtcacaaactgacatcacagtttgatgtgtaacatcacacctcaaggaactaaagaaacaagaacaaaccaaacccacagctagcattagaaaagaaataacaaagatcagagcagaactaaattgaatggaaacaaaaaatactaaagatcaataaataaaagtttggttctttggaaatataaacaaaatccacaggccattagctatattaatcaagaaaagaaaacagaaaatgcaaataaactcactgagaaataaaaatggagacattacaacttacaccacagaaatacaaaagatcattcaagattactataaatacctttatgcacataaactagaaaatctagatgaaatggataaattcctagaaacatacaatcctcctaccttaagtcaggaagaaatagaaatcctgaacagaccagtaacaagcagtgagaatgaatcagtaatttttaaattgcaaacaacaaaaaaagcccagggccagatggattcacagacaaattctaccagacattcaatgaattggtactggccgggcgcagtggctcacgcctgtaatcccagcactttgggaggccgaggtgggtggatcacgaggtcaggagatcaagaccatcctggctaacacagtgaaaccccatctctactaaaaatacaaaaaattagctgggcgtggtggcacgcacctgtagccccagctacttgggaggctgaggcaggagaatggcttgaacccgggaggcggaggttgcagtgagctgagatcgcaccactgcactccagccttgacagagcaagactccgtttctaaaaagaaaagagaagagaagagaagagaagagaagaattggtaccaatcctactgaaactattccaaaagattgaaaaagagggaatcggccaggcaaggtggctcatgcttgtaatcccagcactttgggaggttgaggtgggcagatcacaaggtcaggagaccagcctggccaatatggtgaaaccctgtctctgagagctcaaagcttcagtgagctgtaatggtgccactgcactccaggctgggtaacaaagtgagaacctgtctcaaaaaaaaaaaaaaaaaaaaaaaagaaaagaaaaaagaaagaaagaaaagaaacaaaaactgtaatggaaaacttaaaagcaccagaatatcaaaacacagtaacaagaaaacgacaaaaatttgaaaagacgcttcaccaaaaaagatatacagataatgcaacagactgaatgtttgtattcccccacccaaattcatatgctgaagcctaaatacccaatataatggtatcagaggtaaggatgggggtctttggaggtaattaggtcatgagggtagggtcctcaagaatgggattagtgtccttagaagagagatgatctccctctctttatctaccgtgagaggatgtagaaagaaaatagctatctgcaaaccagaaagagtgccctcaccagaccctagacctgtggattagtaatcttggacttcccagctccagaaccgtgagaaataaacttctgttgtttaagacatccaatctatggtattctgtgacagcaacctgaacttttttttttttttttttgagacagggtctcatccattgcccaggctggagtgcaatggtgcaattttagctcactgcaatctccatgtcctgagctcaagcgatcctcccacctcagcctcctgagcagctgggactacaggcgcatgccaccacgcccagaaaaaatttttgtatttttagtagagacagggtttcgcaatgttgcccagactggtcttgaactcctggacttgagtgatccacctggctcagcctctcaacctgaacttattaagacagatgacaagcaaattaaaagatgcataacatcatcagtcattaggaaaatgtaaattaaaaccacagtgaaatatttccagttcgaattataatagcaaaaatgaaacaaaaagtaaaactaaaagaacccagacaatattattaagtgctgataaggatacagagcaactagaacttttatgtattactcatacaaacacaaaatggtaacaaccactctggaaaataatttagcagttttataaagttaactatatacttcctatgcaattcagcaattccactcttaagtatttacccaagtgaaataaaaacctatgcttccataaaaatgtgtatgtgaaagtttatatggctttatttgtaatcaccaaaaactaaaaaccacccagatgtccctcaacttgggaatgagtaactatggtacttccttataatggaacattactcggccataaacagaatgaactactgatacatataacaatatgataagtctcaaacatattatgcataagtgaaaaaaaccagacttaagagactataaagtatatgatttcatttatataaaattctaaaaaaggcaaaattacaggaacagaaacagatcagtgggtatgataggggcttggaatagaggaagggattgaccacaaaaggtacaggagaattctgataggtgatggaactgttctatatcttgattgtggtggtgactgtatgatagtaaatgtctgccaacaccaacagaacgatatacttgttatgatatactgtgtcccttcaaaattcttaggtggaagtctaagcctcttatacctcagaatgtgaccttaacttgaagacagaatcttgacatatgtattcaagttaaagtgagctaactagggagggccctcatccaatatgactggtatccatataaaaaggagaaatttggaggcagatacacacagacacaaggagattatcacatgagaagaccagggtgatgccttgaataagccaatgaactagaaagattgaaagcaaacccccaggagctgggtgaaaggcatgtgacagattctacagccctcagaaggacctgacactgtcaccaactaaatcttgtattttcagcctccaaaatcgtgtaactttctgttaagtcacccagtttgtgatactttgctatgacagccctagcaaactaatacaatatgtgaattgtatgatatgtaaattatatcttcctaaaaaatagtttgttagaatttggagacaaataaaaacatgctcagtattattagttagcaaattaagaatgtgtataaactaaaaaaaatgatcgaagctgtctaatcgtatatattgctgtgattacaaagcccttaaagaactattataattttttaaacaaaaaaatatttttagcaaaacaaatacttggaatttaataacactgacattcaacttaccaaaaacttgtaggatatagctaacacagttattggaattttaaaataaacggttatgtttttaagaagttgagactcctagtttcagctctgatatatggagaacttttaattcaccactccttacaagaaaaaaagctgaacaaaccgaaaaccaacaacttttctttgtgccatcagagaaattaggtagtaaggtaaatcaccataagaaaatctgttgagataggcaaacccagagagtcagagccaagatccatttacgtgaagctgaagcctctaaagtcataaactggaaggaacacttgaatggtaattttgatgaattcatagaggctgagtgtggactagtatgagactgggaaattattgagggccagaaaccaggcccctctagcctccctacctcacctaaactactagaagttgaaggaggggagaagctaagatacactttgaaggtcccagcctagaggcacaggcccactgcaagatttaatcataagattacagaatgttccccctcttcccaatacctcaccaccacactaacaaggctccagtataacaacagtggattacaacggaaagaattgtaagacgcaaactctaaggaggagtctttagggaaactcaaaggcaacaggggagacaaaacaagaaaaaactagaggaatttgaaggctctggcacttataactacagcaaacattaaacacagcccaatttctagcaagttgaagataaaacctcactctaatgtcctatttacctcaattcctattacctgatatgttatgtctggttttcaactaaaaattacaaagcatgctaaaagacatgaaaaaatatggtatgaaaagacaaaactagcatcagaaatagactcaggtatgtcagagatcttgaaattatcagacagggaaattaaaacagctaagattaatatgctaagaaatctaatggaaaagtatacaacatgaaataacagattgataatacaagcagagatggaaactttaagaataaaaagtagatgttaaaaataaaagctccaacagaaataaagaatgcctttgattggtcatctgcagactggatctggaaaagaattgggaagtttgaaaaatggcaacagaggccgggcgcggtggctcacgcctggaatcccagcactttgggaggccgagacaggcggatcccgaggtcaggagatcgagaccatcctgactaacacggtgaaaccccgtctctactaaaatacaaaaaattagccgggtgtgtagtcccacctactcgggaggctgaggcaggagaatggcgtgaacccaggaggcagagcttgcagtgagccaagatcacaccactgcacttcagcatgggcgacagagcgagacgcatctcaaaaaaaaaaaaaaaaaagaaaaatggcaacagaaacttcctaggcaaggcacagtggtatgcacttgtagtcccagctacttgaaaggctgaggcacaaggattatttgagtccaggaggtcgagtccagcctggccaacatagtgaaatcccatctcaaaataaataaataaataaaagaaacaaagaaaagaaaataaacttggcaaaacggactgttaagagaaaaaagaatgcacaaaaacaacatctattaactgtgggacaatttcaaaagttgtggcaatttcaaaaggtgccactagaatatcagaagaaaaaatgagacagaagaaatacttaaataatggcccagattttccaaaattaatgaaacataccaaaccacagatccaagaagctcagagaataccaaacacgataactaccaaagaatctacaccttcaacatattatatcaaactgtagaaaagcaaagacaaagacaaaattcttaaatcagccaggaaagggaaaaaaacaccttacctaaagagaagcaaagataattactacaggggagttttcatcagaaatcatgcaaataagaaaagactagagtgaaatatttagtgttgaaagaaaaaaaataccaacttagaattctataccctgaaatattatccttcagaaatgaaggagaaatactttttcagacaaacaagaaacgttaaaagatggcttttttgcaagaaacgttaaaagacattattcacagaaaaaatgatgtaggtcagaaactaagatctacataaagaaagcaagaggtggaatttgttgccagtggacccatattgcaagaaatgttaaaagacattcttcacaaaaaacaggatgtaggtcagaaactcagatctacataaacaaaggaagagggctgggcctggtggctcaggtctgtaatcccagctctttggaaggctgaggcaggaggatcactctgctaagcacttcacctttaactcatttaatcctgagaacaaccctttgagataaatactattattcttcctatcttagactgagacaactaagatacagagagattaagtaatttgggcagccagtaatctgaagccaggcagcatggcttcggcactccagtccctttttcaaggcccattgtaaatccctgagcaggccctgctcctcccttgctgcagcctccttgttcctaatgcagcacactccttcagtcctttctccactagcccctccatcctccccactctccccaccaggctctagttctcaactcaccaaaaacttcccctaaagaaaaagcagtctggcagagtaatcattttcccagcaggacgaacccaagcagcctcatctctgccctccgtattccatatccctctaacttggagaatctgactcacaccatgtgaccccaaatgtcttccaggatataaatataaagatcacccagaaagggcttaaaatgtgtttttcagctgggttaggtggctcacgcctgtaatcccagcactttgggaggccgaggcaggtggatcacctgaggtcaggagttcgagaccagcctggccaacatggtgaaaccccatctctactaaaagtgcaaaatcagtcaggcatggtggcgcatgcctgtaatcccagctactcgggaggctgaggcaggagaatcgcttgaacccaggaggcggaggttgtggtgagcagagattgcgccattctccagcctgcgcaacaggtgcaaaactccgtctcgaagaaaaaaaaaaaaaaaaagatactatgttctctctctgccatgtgaaaatgcagtgaacaagcctagaggacagcccccaccagaacctgcccatgctggtaccctgatattcagccttcagacagtgagaaataaatttctgttgtttaagccaccggtctgtggtattttgttatgacagctccagcagactaagatagtaggtattttacatattaccttatttaatttcctaatatctgtatttgttcataaacatttaaacttagattcaattgtctaataaccaaaaagccactgcttttgtccccacaatgtctcctcctacagagacaaggactctataacttggctctggttctgactcatggaaactaaatatttcccttggatgagttattaatctcctctaaacccaagttgactcttctgacataaaaagattgaaacaggattctctctaaagtgcttttgctgcatacaaattatttaaaattcatgaaagagataaaaagtacagagattatttacaacgcaagatttcaccttcatgctccaaaaaaggtatcctttaaactatgatataaattgcaaagcagaacgaagtcaaaataaactatcatgactctagatctcaccaaatcatttagggcagacaaaagcttcaagagtcattactgaatgtgctgatgtggtcactggactcggccagccactcacttcagtaggatctcctgggtctagagaaatagcaaatattcaggagctcatatatatccttggcctcacaaaaatgaaaaattctaaccctcctcatccttctataattctgaacttaaaccagctggagggcaaccctagtcactacctttatattacaagcaagttccagctggttccatcaacaaagatccatttactgttatatggaacaatttaattttctactaaaaactggatttttaacaactataaatggcaaacattacttattgcagaaatctgcaaaatgcaaagactaattttaataaaaattagtctttttaggcactttctgcaaatatacaaaccacaaaagagacattacacattattcagcacccctgctatactaagggaactttgaatatacgtaaatgtaagccaaagactcttttcggaaaacctccacattaaaaaaaaaaaaaaggagggtggttgcaaagcagtgtaaaaagggaaataaggtccctagaagggaatataattactatttcccattaaaagtaaaatataaagtaacattaaaagtaactataaaatagttaaggcataatttgcaggtcaccataacctgctgaaagctattctaaaatattatttcacaccatagcatgatgccagggatttgtttccaaagaatctggtgaacacagcaatggggataaaatagttcataagctgataaatgttggagagagggagtaggagggggttcattatcttattctaacatcatatatgtttgaaattgtctccattaaaatactttaaaaactactagacattattgatgaacaaatttaattttcatatcctaaaaacaaagaaagatgagtaccttccaatcttcgaatttttgctttcacagaaataacagtttcaaaaggtgaaactctcagctcaaaacatgttccagttaatgtttcaatgaagagctccatggtatcacagaaatgaagtctgtagtaaaatggtcccatgttatcatcattgaagaatggaggctcttttctgttatccattactttgacttttctagttcttctaaaatatgtcgcaggcaactgtattccagttctaggcaaaccaggtttgaagattggtaatatatattgttgttcatgttttgagttttgtacctaaaaaaacaagaatttttttaacaagcctatctgaaagttgtatttgtccataaagattttccgttaactgtggcccatatcaatcttccagacggccccagaattcactttagtgcttttaattatgtctaatcctgaacttttcacatttgtctctgaaatcactctcccatctagaccataagattattaagaatacgcatatttttgatattataatgtatcttactagagctcagcacagttatatatatagtacatgctcaacaaatacttttgttgttaagtgatatataagccaaactcaacaaacacatcagtatatttctgtaaggctttgaaaaatttattcatatccttttctaaaacatacaaattatgtcttctataccatataaagcataactttacaacgattgtacatttgactttttttttttttttgacagagtctcgctctgtcgccaggctggagtgcagtggcacaatctcggctcactgcaacctccgcctcccgggttcaagcaattctcctgcctcagcctcccaagaagctgggattacaggcacccaccaccatgcccagcagatttttgtatttttagtagagacggggtttcaccacgttggccaggatggtctcgatctcttcaccttgtgatccacccgcctcggcctcccaaagtgctgggattacaggcgtgagccaccatgcctactcctgttgtatatttgaatcatactggataaaaggaatgccaaccaccataataggttgcttaaaaatagtactcactaggctgggggctgtggctcatgcctgtaatcccagcactttgggaggccgagatggcagatcatgatgaggtcaggagatcgagaccatcctggctaacatggtgagacccaatctctactaaaaatacaagaaaaaaatgagctgggcgtggcggtgtctgcctgtagtcccagctacttgggaggctgaggcaggagaatggcgtgaacccgggaggcagagcttgcggtgagccgagattgcgccacaacaccccagcctgggcaacagagcaagactctggtctcaaaaacaaaaaaaagtagtactcactaaatcatcaacggtttccagaggatattatagcattcagatgacattagaattggtaataagtattagacaatctctgctcacatacatacaatggctaataagtatgagtggtaagcccaacaaatagaagtagtaaactaaatgacaagtatagaactaggagcacaaaaatgatcaaattgctattgctattaatcgtgaaaactctatacaggggggccttgaacttaaactaggacaaatgatacacatctttctggtgaggtggttaaacctttttaaaaatagctttattgagggccaggcacagtggctcacacctgtaatcccagcacgttgggaggccgaggtgggcggatcacctgaggtcaggagttcgagaccagcctggccaaaatggcgaaaccccatctctaccaaaaaatacaaaaattagccaggaatggtggcgcacacctgtagtcccagctactcgggaggctgaggcaggagaaccgcttgagtccaggaggcagaggttgcagtgagccaagattgcaccactgcactccaacctgggtgacagagcaagactccatcattaaataagaaaaaaaaagctttattgaaatataattcacatgccataaaattcactcatttaaagcctaaaattcactggtttttatgatgtacacagagttgtgcaacaatcaccacatttgctttagaaaattttcattacctctaaaaggaaccccataccctgtaaccaacactcccaaattcccccagtcccccactcaaccctaggcaaccactaatctactttctatctccaaattggtctattctggacatttcacataaatagaatcatatatgatttttttgtgactggcttctttcacttagcataatgttttcaaagttcatcatgttctaggatatatcagtatttcactcctttttattgctgaataatagtcccctgtagcaatatatctcatgttgtttatccatccatcagttgatgagcatttgagtcgtttccaattttgggctgttacatatagtgctaagatgaacattcaactgcaagtttttgtgtaaacatatgttttcctttctctttgaagtagctttgctagataatgtggtaactcttatgtttggcaatttgtggaactaccaaactgttttctaaatggtatggatcattttatagtcccatcaacaatgaatgagggtgccaatttctccacacccttgacaatacttgtttctgtccttttgattaaagctatcctagtgggtgtgaagtagtatctcactgtggttgacttccatttctttaaaaactaatgatattgtgcatcttttttatgtgattattggccatttgcatacattctttggagaaatgcctattcatatactttgtctattttttaattggattttttattgagttgtatgagtttttatattacatattctagataaaaacacttaacagatatatgaatggtaaatattttctctcattttgtgggttgtcttttgatagtatcttttgaaacacaaaggtttttaattttgttaaactctaatttggctatttttcttttatcatacttaaaaagcttggcttaacccaaggtaataaagattgacttatatatgtttctaaaaattgtagttttagctcttatgtttaggtgtactgtccaatttcaatttagttttgtgtatggtgtgaggtagagtctaactttattcttttgcatgtggataaccagttgttccagtatcatttgtcagaattaccattcattcccaattgaattgtcttggatccttgttaaaaaccaatttactgtaaatgtgaaggtttatttccagactctttattctgttgatctacctatgccagtaccaccacatcttaattaatgtagctttgtagtaagttctgaaatcaggaagtgtgaggcctccaatttgttctttttagattgttggctattctggactccttgaattgccatatgaattttaagtatgcccattttgcaaaaatgtcagctgggattttgacagggattgtattaagtctgtagatttggagagtactgcaatcttaatactaagtcttctaatccataaatacatactatttttcagtttatatctaatttatttcaatgttttataatttttaaagcacaagttttgttctcttttattaaatttattcctaagtattttattcctttaaatgctattacaaatggaatcactgtcttatttacagattgctcattgctggtttatagaaacacaaccgattttaatatcttgatcctgtacactgcaactgtgctgaactgtttatttcgttcatttagttatttaaatcttcctaaacgctctctataaaagctctatatacaagatcatgtcatttacaaatagagttttacttctccctttctaatctatatgctcttttctttctttttttttttttttttttttttggagggggtgaaagtcccactctgttgcccgggctgaagtgaaatggcacgatctccgcttattgtaacctccgcctcccgagttcaagcgattcgcctgtctcagcttcccaaatagctgggattacaggcacctgccaccacaccaggcaaatttttgtatttttagtagagacaaggttttaccaagttggccaggctggtctcgaactgctgacctcaggtgacccacccaccctggcctcccaaagagctgggattacaggcctgagccactgcactgggcttatttccctttcttgcctaattgccctgctctggaaccttcagtacaagattgaataaaagtggtgagactggacatccttgtctaattcttgattgtagaaggaaaccattgagtctttaggtataatgttaaccgtggggttttcatagattaccaatataaggttgacgagcttcccttctattcctgctttaggtgggttttctttttaatcatgaaggggtgccaattttatcaaacgcttttttcattgtctattgaaataatcatttggttttctttacttttttattcacatattacattactttttatgtgtcaaatcaatcttgcattactggggtaaatcccatttgtacctggtatgtaatcctttacatatgttgatggatttgatctgaaaatatttcctcaggatttctgtgtctataatcacaagagatgatgatctgtagttttcattatgtctgtcaggatttggtatcagggtaatattggccttagccaaactaagcttcgtaagtgaaggagaaataaaatcctttacagacaagcaaatgctgagagattttgtcaccaccaggcctgccttacaagagctcctgaaggaaacactaaacatggaaaggaacaaccggtaccagccactgcaaaaacatgccaaatggtaaagaccattgatgctgtgaagaaactgcaacaattaatgggcaaaataaccagctaacatcataaagacaggatcaaattcacacataacaatattagccttacatgtgagtgggctaaatgccccaattaaaagacattttaatgtctggcaaattcttctcagcaccacatcgcacttattccaaagttgaccacatagctggaagtaaagcactccttagcaaatgtaaaacaacagaaatcacaacaaactgtctctcagaccacagtgcaatcaaattataactcaggattaagaaactcactcaaaactgcacaactacatggaaactgaacaacctgctcctgaatgactactgggtaaataacgaaatgaaggcagaaataaagatgttctttgaaaccaatgagaacaaagacacaacgcaccagaatctctgggacacatttaaagcagtgtgtacagggaaatttatagcactaaatgcccacaagagaaagcaggaaagatctaaaattgacaccctaaaatcacaattaaaagaactagagaagcaagagcaaacaaattcaaaagctagcaggaggcaagaaataactaagatcagagcagaactgaaggaaatagagacacaaaaatcccttcaaaaaatcaatgaatctgagagctggttttttgaaaagatcaacaaaattgatagattgttagtaagactaaagaatcaaatagatgcaataaaaaaagataaaggggatatcaccagcgatcccacagaaatacaaactaccatcagagaataccataaacacctctacacaaataaactggaaaatctagaagaaattgataaattcctggacacatataccttcccaggactaaaccaggaagaagtggaatctctgaagaaaccaataacaggctctgaaattgaggcaataattaatagcctaccaacaaaaaaagtccaggtccagatggattcacagccaaattctaccaggggtacaaagaggagctggtaccattccttctgaaactattccaatcaatagaaaaagagggaatcctccctaactcattttatgaggccagcatcatcctgataccaaagcctggcagacacacaacaaaaaaagagaattttagaccagtatccctgatgaacatctatgcgaaaatcctcaataaaatactggcacaccgaatccagcagcacatcaaaaagcttatccactatgatcaagtcggcctcatccctgggatgcaaggctggttcaatacaggcaaatcaataaatataatccatcacataaacagagccaatgacaaaaaccacatgattatcttaatagatgcagaaaaggcctttgacaaaatccaacagctcttcatgctaaaaactcttaataaactaggtattgatggaacgtatctcaaaataataagagctatttatgacaaactcacagccaatatcatagtgaatgggcaaaaactggaagcattccctttgaaaaccggcacaagacagggatgccctctctcaccactcctatttaacacagtgttggaagttctggccagagcaatcagacaggagacagaaataaaggatattcaattaggaaaagaggaagtcaaattgtccctgtttgcagatgacatgattatacatttagaaaaccccatcgtcccaacccaaaatctccttaagctgataaacaacttaagcaaagtctcagggtacaaaatcaatgtgcaaaaatcacaactatctgattttttttttttttttttgagacggagtttcacttttgttgcccaggctggagtgcaatggtgtgatcttggctcaccacaacctccgcctcccagattcaagtgattctcctgcctcagcctccctagtagctgggattacaggcatgtgccaccacgcccggctaatttttttgcatttttagtagagatttctcccaacaggggtttctccatgttcgtcaggctggtctcaaactctcaacctcaggtgatccgcctgcctcggcctcccaaagtgctgggattacaggcgtaagccactgtgcccagcctacaaccatctttgacaaacctgacaaaaacaagacgtagggaaatgattccctatttaataaatggtgctgggaaaactggctagccatatgtagaaagctgaaactggatcccttccttacaccttatacaaaaattaattcaagatggattaaagacttaaatgttagacctgaaaccataaaaaccctagaagaaaacctaggcaataccattcaggacataggcatgagcacggacttcatgactaaaacaccaaaagcaatggcaacaaaagccaaaatagacaaatgggatctaattaaactaaagagcttctgcacagcaaaagaaactaccatcagagtgaacaggcaacctacagaatgggaaaaaaattttgcaatctacccatctgacagagggctaatatccagaatctacaaagaacttagacaaattttcaagaaaaaaacaaccgcatcaaaaagtgggcaaaggatatgaacagacagttctcaaaagaagatatttatgcagccaacagacacatgaaaaaacactcatcatcactggtcatcagaaaaatgcaaatcaaaaccacagtgagataccatctcacaccagttagaatggcgatcattagaaagttaggaaacaacagatgctggagaggatgtgtagaaataggaacacttttacactgttggtgggactgtaaattagttcaaccgttgtggaaaacagtgtggcaattcctcaaggatctagaactagaaataccatttgacccagcgatcccattactgggtatatacccaaaggattataaatcatgccactataaagacacatgcacacgtatgtttactgtggcacaattcacaacagcaaagacttggaaccaacccaaatgtccatcagtgatagagtggattaagaatatgtggcacatatacaccatggaatactatgcagccataaaaaaaggatgagttcatgtcctttgcatggacatggatgaagctggaaaccatcattctcagcaaactgtcacaaggacagaaaaccaaacaccgccatgttctcactcatagatgggaactcaacaatgagaacacttggacacagggaggggaacatcacacactggggcctgtcgtggggagtgagatggggggagggatagcattaagagaaatacgcaatataaatgacgagttagtcggtgcagaaaaccaacatggcacatgtatagctatgtaccaaacctgcacgttgtgcacatgtaccctagaacttaaaaaaaaaaaaaaaatcaattcccaaagcatttctctcatttcttctgaaaagtttctaaaaacacaactccaaggatgaaatggaagttaaaggtaaacaggcaatagcgctgaatacgtaatttcagtaactcagaattttctccaacctctgctctaaagaagcttagctacagaagagcagttacctttgaaacattttccccaacataaagatatccggaatgtgaagctgccattaaaactgtgacacagatctacatttactgatacatcaaaacatccctaaagttcgaaatacgagctacagaatcacatcaaccgcctaacttgtctgtagcctaaactctagtccggagttcatctgcaagcggaattgggaagtatttcagagccagcatctcctcgcgccatccaggtacctacacacttgaggccaccgagtcacctgcgcagccgttgctcctccaagaccaatccgggctccccagacccaccggcctgaatctggaggacagcagtccgcgtgacaacagcgactcggagatcagcacccgtcgggaaagccgcgtacccgttgaagctggcgtcacgcccaaaggaacaaacgccagagcgtgtgtcctgggcaaaggcggcccgccgctccggtccccgggcagcagcggccggcgtcaggccgcaaggcgaggggcggggacaggactctacccggcagcccagcgccgagcgcccgcgccactccggccttgcgccattccggccccacgacggccggcggcggcagcgcggctgggctcagcggctcgcagcccgggcgccccccctgccggccgctcgctagctcagcctcacccgcagtcttgtccgctggctcgctcgcccgcctacaggtcgacagggcccaacgacccggcgagcaacttcacggaaggcactggccgacaacgctccgctgccgccgcgccccgcccctttgt

SEQ ID NO: 1670 - DNA, 57214 bp, Homo sapiens; identical to SEQ ID NO: 1669

SEQ ID NO: 1671 - DNA, 443065 bp, Homo sapiens
aatgcatattacaaaggtattgctttattgcccttgtctatgcagaatccatgacccaataggattcagttcctgaaagtttactattacttagcatttaatataaatccttctccactaggagatcagcgtgtaaagggaatacgttcttagacactttgatgaaaaaagttgggatggtagaagcagataggaccaaattatacaagattatatataaatctcatggacaaaggagtttggtgctatgattttagtcacagtaaaccaaagacggtccaggatatgactgaagtgatcacagtaggatatttggccacaaaaagacaaataaataaattgtgctatgaattctttacagtgctctacagttcagatatcatttatgaattctttattgctattaaaaatggatgattggaaataattttcagctacggtatgcagttgtggactgttaagatgatagatataaaagtcctgagcatttataaagtggactgtctaatgttatatatgcacatctccacatgttataacacatgataatttattagggagaaaatttttcaaaaaatcagttgtatataaatgctccctgaatctaaagtgctggcaacttttgcctcaagggaaactcattttccttctttttagccagtaatttttaaaaggcctcaattagaaatccaaattttggttgggaaaatgtgactgaccacacttgaaaaaggaaaatacaaagtgaaaaaatatcattctttctgtgctagtataagttgcaaataaattagctgcacatcattcatgatctgatattatttggattggtttaccattcacaaggaccaacagtattgtcacttttgtcaatgtttggcaataccaaagagccaaagctgcaggtatgtctgttagataatctgggccaaattgctgtaagaatagagatgttattatttgtaacatactcatgtaaaataacaaattacatttgcttttttagctcccatattcctcttttttgggttgtgaacttgttccattcattgtggcatcttccttgtttgaagctgaatctggagcaacagttcttttggtaaatgctggcaaggtaagaagaaaaagaaaaataaacctaggtgaatataaaactggcctaaaaaattaattttgcagaaggtagttaatgtatcatggtatttgatcgagttttctataattaaacttcacatggactaacagacctccaagctaagaataaatacactcaatttatgacatttaaaaaaaacacgagaattaaactttttattttatttgaagaatacctgagagtaaaaaatgtgtgcttcgtcaggatacaatgatataaaccacaccggtgtgcacgtgcacacgcacacacacttgcacactcgcaaagaattttagaggcagaaatcttaagggctcctttttatggaatcctctttattacaacttctagtctattgaaagtagacctggagtttgtgtttactgttcttttactatctcctactcctcgtctgagctatagatgcctatatccaactgtctgtgtgaaatcttctctccttatctctactctctgatgcctgctcattccttactcttctccaacttgaaaaatgatatacccgtctgcccagtttctcaaaccgtggttcctctcttcctttgtcctgtctgatccatccattcagtttaagagcgagctctaatgactctccctatcaatttcacctgagtcctgattcacaccatccccattactctcatcagcccccaagtcaccattgtctccctttctgttttcttcttgctcccttacgatcctttctccacaccacaaccacagttacctttcggaaaagtcaatcaaattacgtcattctcctgcatgactccctcatcctgcccttaatggtcgcccagtgaactcagaataaaatccacacatctgactgtggctgcaccctctcactcactcgctcagtagcccgtatctctaggagaccatggccctttcttctctggagcttttgtactttttgcccctactatcaggaagatgcttcccatccaatttcaactcagctgctgcttcttgccattcaggtttcagctgtaacctcctcagggaggcagatcctgatcaccaatctaaaggagtgctcctgttcctggtaccttctatcatttcacctttatagcaccaatcaccattttaaatgatttgtttacttgctcgctacttgtttctccatgacatcaccttgcctgtcctgttcactgctgtatactccagaactgaacactggacatggtacacagcctcctagtaaatactggttgaacaactgaatataggtgagggattttaagatgacagccaactggggattttctagctggtttctggagcgcctctagagagtaccttgtcaacttgcaaaaaccagaattcaattatttaaaaatatccggcgtttaaccgatcagtaaaaaatacctgaaccactgtcacataaaataaatctgtaatcacataaaataaacctgtaaaatgagagagacagagagactgcactttcatagaattaaatcctttaatggacaagaaacaattttattgcctttatcagtgtcctagtgttttcattgccattaatctttggcattttactctataaggctgaggacaggttacatatgaagcatcttttcacagttagccgggtagaccttgaagtataacacagaagtgaaaatagtgtgctattcttgctgtggataaattatttttcaccccacggacttaaactaccattagaggcacctcaaaacacaaagtgagaatactaacttttctttttatagcaatgtaaactgaggtaagaaagtgaaatagtatttttaagcatctttcattaatctgcttttctaagaatatcaaattatctgtaagattcactttcaactcctatactaatccttagataacatattttccccatgaagaataacaattccttccttttgggcttatttattttaacaaacattatgttttcaaacagttttagatttacaggaaatttacaatctgcatttatttttaaaatctggtttggagacaccaactccacaaagatgaaacattttagtcttaaaaaactagagatttctagaagtcatcagattactatggacctcagtgaaatctggtctggtcccagtcctgggatgtgatggctgtatcctggagttgtgttcctttagtctaaaaggagctatacatagtgactagtggtcagttgccacttttgaaaagcaaaaatgacagtttcaaaagctgacattatgagtcccttactaagcccccactgtctacaggctgaaggtaatggaatccaagtcttctaaaagagtgtcctgactcacggccataacttccagcaggccaggataaatttggtagtgatcatgcctttaaataatggatttctgtgttcctatttccaatggcaatataaacttacaatttatacatttcttcccttcttcctggcagaaggaatctaccttttcttgaattgacctgaactacacaaagctgacataaattacttcttaaaacaaactttcattaatgctggatcacttcagagaccacaaattatgcagtattttcccatttcctttgttttttccacggtcaatgattctatgctttagtttggtcacagtttgacagggcatctaagtcagcagaatgaatgccttagcatctacagcttcaacgaaagggcctcactcagtacaaattctgactagagtaaggagctgactgttctgtgggcccagaaactcatgtctgcctaaggacctatgactatccactccctatatctctatacagatctaaactgctccaaactccaaaccccagctttcatgttccacctgagacttaacaaaaaaattagacatttactagtcagacattaaagctggggttttctcagtaacacttgtctttgtaagaatcatttttagccagtgtatatacacatatcaaataataccaaagggttacatagaaaaacaggagtttcttgtcctacctctctgaattccacaatcccactccccagagtcagctatgatcacctcttccagttttattttctgtatttatttcatttttgtaaaacatggagaagcctatattgctattttctgatttatatttttagacattatccacacccacccccttctcctcaccccatactcccaatatagttacatatgagcttttagttatatgactgtttacattattatgactaaatatggctcatgaaaacatagtaaggatactatgacatttctcttcttgttcattttttcctcctgggtttattaattgactcttgttttaattttatttctttttatttgctctttctctgtgaccatcttgcttctaagtgctcagttagatctgccatatgtccactagtagtctttttttttttaagtgttcaatcgtatcagatatctattagctttttgtttgtttcctgcaaattttctggatagaatctttcctttcttccttcagtgtggcagaattgaaaaacatgagtgtccagataaaaagtagctagaagaataaataaaacaagacccacactgaggcacatcatcacaaactcactggggtgaaagagaagatcctaaaagttcctggagcgaggagtagaaaggatgtggtagggtaggaaggaggcgcagaagatgacttcaaaggagtgacagtctttatctacgaatgaaggatttttcaacaacaacattggattttggaggataattgttcaatgacttcagagagagaaaatcattttcaactagaattttatataatggaataaatctacttttagaaatacaaacactaaaaatatttacctccttttctttctttcttttctttttctttttcttttttttgtaatggagtcttgctctgtcacccaggctggagtgcagtggcgtgatcttggctcactgcaacctccgcctcccgggttcaagcgattcttttgcctcagcctcccgggtagctgggactacaggcacccgccaccacgcctggcttattttttgtgtttttagtagagatggggtttcaccgtgttagccaggatggtctcgatctccagacctcgcgatccgcccacctcggcctcccacctccttttctttggtgtgctcttgaggtaggaggtgggactagactccaaaggcagggcttcgacacctgcccaaattgaggactagctaaaatgggtctcaagcagaagcacctctccataagacacgtccacaagtgtgcctgtcagtttatcattgccacggcaacacgacacacctgtcgccattttcctggcgaaaacccaacaacctggaagttaccaccctcatcccagaaatttctgcataagttgctctttaatttgcatataattaaaagtggttataactgtgagtgcagaactgcttctgagctgctgctctgggcacactgcctatggggtaggcctgttttgcaaggagcaggacctctgctgctgctgtacactgccgcttcaataaaaactgctgctaacaccaccggcttgcccttgaattcttccctgggtgaagccaaggactaagcctcaattttggggcttgcttgtcctgcattactctcataaaagaaaagagtgaaacaagaaagaggaaggtataggatctgggcacacgggcatcaatataggaaaagagtgaaggacaatctcaggatggctgctgtgcagtgggtgtttgttgggtgggcctggccactcctggcctcttgttctgttttctctgttctctcaagacgcacatgaatcatctattgcccctcctgaattgcttttctaaaaattttatcttttctctctattgtctcattctttttctttttcttctcctttctttgtggttatttcacattgttttccacctttctggttttctttactctttatggcaatcatattttaaaattctgacaccgcttagtctgtgtccctttttcatagtattttgctcttgttaaatgtagtggatttaatattttctcttatctctcaaagggtattaatgatattctttaaaacatcctctgttccctgtattactcatttgccgtaagttctgttttcctctttgttggtctcatctcttctttttaattcttcaatttaaagggagattaaagaaaaattacaggacaatttctgtaactgagctgaaattttgctacaaaaaatgaagtattcagggtaatcctaatgtttctcactgctaatgtgccccattattaaaaacagaaaacttaaggcttatcagaaaagcaaataagaatgttttctagaaataattataattcaattacttgaaagtaattaatgataaggtagctaggattaaattttttaaagtatttttgaaaatatggggataggtctgggaagaaaatcataaaacaaacttgtacacaagaaaaatagtaaaacaagactatggattaatcagttaattaatttactaattaattaaactaatgaagagttttactttttaggttaaatttttcagttagattttacaatgtaaactataataaatgttttctttttcaaattatgctcttgatgatatattttcctatttaactttatttccttttcagccagtgtatatctatagaaacctatagttgcttgtgagaaatatatcttagagaaatgaccacaattggtcatgaaatgctagtgttgaaacctaaatacaggttctttcactgcctatcatagtactaaatacaattccaaaatcttgatgttttccatttaatgtcttctaaccacttccctctaggtgcatttctagaaaggcttatgaaggtcataatggcaaaagtaacagcagtataacaatctgttttcacattatgatgctgtttatctccaggctcttgaatgtctgactaattgggacactgtgatgtttcatggtgtgaagtccctacttccacctccatgcttgtttatattagaaggacttggagaaagttttccattgctaaatatgaaagaaaaaaaatttggcctatgtgtatatcaaattctgaggtgccataaccaacttgaggtccatattgaagggtggttcttggcttatgtagatacaaaatcacttgggaaaatgattaggacaggaagacaaaatgctcagcatttagactaaaataatcatgaaataatgaaaaaccacaccacttatcagaaatcgataaatatttattcaatgaatccatgaatataaaccagcaaaaataagagttatcacctttggatttgacctacttcctagtggcttattttggcattttattttacagcaatatagctatattaaatgacagaattatcaaatttaatgtataaccctacaggcccatggtaaactgaagagcaaaattattacctaaataaaaatccattaaataacatttggatcccaatagtttagataaatgtggacttaacaaaaacaacttatatgtatattaattgaatattagttgagtatttactatttgccaactactatatagagtgccaaggaaacagtggtgaacaaaacaggcactcctcctatcctcaagatataaagaaaaattgtagcacactgtgggtgctcataacagagactacacttcaaactgtgaagcttctttaaggaaattacatataagctgaaacttgaagaccacatataggaaggaagggagacggcagggatagatcgtggcagatggcattttgggccaatggactcatacattgttgatattgatgatgacatttatcaagattcacagagtgaaatctagcagtaatagtattcttactctttgtacaagattacatatttctcaacatttatatgcaaagaacttcaattttttgataatttgaactttattataaaataactttctttactcattcatccatagttactggcaatctccaaacgaaaaatttgcctaattaagattttcaccttgggtggttatttaagttattctgagaagcgtaaagtctaaaaaggagggattctacatatttttagtaaactgtgtactattatgaatatccttgaacattttttgtatgattcatgaggattttctcagacttatgaatattactatcatatactggccttaaactaattttcccatgtgttgcattttcttaaatctaatttaaaaatgggtacaagacttcattacttacagttcacgtatgaaaatcttggactagacaggaagcgactgtgatcctgccaagaggatgagtgatctaacccacgagtgtgggaaccttccagaaaggttctgtcaccctaaggaaaaaaaggcacagcatttcaatgattacacaaggtatggaccaaggctcatttaaacgtactgaagctgaaattaaatcttaatatacaagctatgttgtacatgcacaatttaatataattataatcactgtaaaaataaaatatgtgcatgttaaggataatttggaaaaaagaagaaatcacccattgctatagcaacatgacatatttctttccagtctttttcccccatgaatagaatttataaaactttgtgtttaacttaaacttatgctataaacatttttgaagtcattatttatcctaacctttagcttatgagttactcttatactatctagtggatatactatgttttactcagccatattttattggcatttaggtggcttcccaatgttttactcatatacataacactgtgagaaatatctttaaacttataaccttttccatatttaggactattccttatgacaaattcttatgaaaaaatactgggtcaataaaaataattggatgttttaaaatacatttagctagactgctttctagattatattcgtcttctcactcatttaataaatatttactaaatgaaaatgaacccagaaaaggtccttctcctcatgtattatatgaatgtgtccttctccacttctttcagctataactttaaataattttactaataaaatagatttaaaatacgtgtttaatatactttcctttgataaacagtaaaactgtactttcttcccatgaacgcttcctacttatttactgtacttgtggtttttttccttctttcactcattcattcattcattcacaataatttattgggcacctactatgtgctaggctaagagaaagcaagacattggggtctacagtcagaaagccttcaggcttgcagaagagaaaggcattaaacaaataaatgatataataaaaactgtaagtgctataaaaacaggtaataacaggaagaaccaagtttagatttaggattcagataagacccctctgggaggtgacagttaaggcaatatttgaatgttgaatatgaatccacgaaatcagccaggcgaaaatgtattggtggggcatgagaaagcagaaggtaaggagaaggatcagggagggcagtcagggaatgatgttccagactcaagtaagtgtggaggtgagaaagagtttggtgtgtctgaagaactggaggaagaccccacagcttaggtacactgagcctgggggaagcgattacagtgaggtccagggccatgctcaggatttgaaactctttttttttttttttttaagtacaatcagaaggcaatcaggagtttaaaggagaaggatgacaagctttgatttatttttttttttttcaaagatcacttgggcctctgtttggagaatgaattgaagcagcacaggattgaaggatgaatatcagttaagaccataactgaggataacagcagggttctagggagatgaaagaatcaagaaatgttggcaaaaattccatatctgtgggttaggtggcccagaaagatttctcaaaatatggtcccaacatggagtaaggcctcgtgtaacatgaccatctgatgaattagccatccttctctttaccaagtaccgactttatattttatttctgtgtcacatacaatgtacgtaagtgcaaaagaaagggcaaacattttaaaaatattttcaacaggtccatatattttgagccaaaggcacgaacataatcctcaggtggttcaagatcattagctttcatgttccaaagggagatgatatagttagggtattttcccatgccccaatctcatgttgaagtgtactccccagtgttggagatggggcctgctgggaggtggttgggtcatggaggtggatccctcatggcttggtgccgtccttgcaatagtgagggagcaaccagggagatctggttgtttaagtgtgtggcacctcccctcagctcttgctgctgcttttgccatgtgaagtgcctgtgcctgcttcaccttctgccatgagtaaaagttccctgaggcctccccaaagccaagcagatgccggtatcatgcctgtatagcctgcagaaccgtgagccaatttcttcgtaaattacccaggctcaggtatttctttacagcaacacaagatcagactaatacaggaggttagctagatttaagatgaagaccctgaagtttttaaccaagggattttcaattttcactaattatgggaatttcataagaaactcgaagtcattcactgcaggatctctggaaaggaaaggatatacattatgccccaaatatattccaacaactactttagaatgagctgacattgggcaactagaggcaggtaaactagctactgtagttcagatgtgacatactacaggtgtggctgaaattgcaagatgtatagatggagaagagggttatgatttcaaccaatgctagaaatctccactgaatcatggttttgatataaatcatggttttgaaagagaaaagcataataaatggtttcccactaaaagatgctttgatgattagaggccaataaggggaaagcaaacacacacttttactcactaacgccacaactgagacagacagtgagaggacaggagtagagacacaggtttgagtatcttgttgaaacagatggtgtaatggtggcttcaaaatgcgcctaccagaggaaggatgaattaaacaaagatatttaaatactattcattcttcctaaaaggcatggttttaaatttctaaaaaaaagtcaactggcatcaaagcattggttatatattttctatttagggaaaaataataatttaattttttttgtttatttttgagacagagtctcgctctgttgcccaggctggagtgcagtggcacgatcttggctcactgcaacctctgcctcccaggttcaagcgatcctcctgcctcagcccccgctagtagctgggattacaggcatgtgccaccatgcctggctaatttttgtatttttagtagagacagggtttcgccacgttgaccaggctggtctcgaactcctgacctcaggtgatccacctgccttggccccccaaagtgctgggattacaggcgtgagccaccgcgcctggcctaatttaaatttttaatgatgaagccagttacttggcatatgatagtcaaaatatggcactgacatatttcattctagcaaatttaaaaactatggaaaaattcaggagaaaaattattcaacaaatattttaaaataaaaacttattagcataatttaaggatacattttcccaggtcttacttataaatatctatttgtatggagatcaccttcgttgatgatttcgtttcctattttttcatgggaattttctctatcatgatcatcattatcattattagggttatatagtattttattttactaatttcctattgttcaaaatttacaattgattcctagtattctctgttataaataatcatttgataaacatcttggtacaaaaacttttgtccatatttttatgtatttaacataaattcctagaattgaaattactgaatgatacattttaaggcttttaaaaatatcattttcatttcagctgaaaaatttactggtagagtaattcataacatttactaaacatatgttgtcaaaaattacttaaaaactttttatgggtacagcacagttgtatatatttatggagtacatgaggtattttgatacaggcatacagagtgcaataatcctgtattaatctgatttcacactgtgataaagaactactggagactgggtagtttatgaagaaaaagggtttaattgactcactgttccggatggctggggaggtgtcagaaaacttacaatcatggcggaaggagaaggggaagtaaggacctacttcacatggcaccaggagagagcgagcatgggaaactgccactttgaaaaccatcagatcttgtgagaactccctcactatcacaagaacagcatggggaaaacaacccccatgatccaatgacctcccatttggtccctgtatacctagaagtgagatacctagctggatcatatggtagttctatttttagttttttgaaactcctccatactgttctctacagtggctgtactaatatacattccaaccaacagtgtatgggggttcccctttctccacatccttgctagcatttgttattgcctgtcttttgggttaaaagccactttaactgaggtgagatgatatctcagagttgtgatttacatttctcaatgatcttgagcccatttcctacacctgtttgccatttgtatatcttcttttgagaaatgactatccagatcttttgcctgttttaaaatcaaattattagatttttttccctatggagttgtttgagttccttatgtattacagttattaatcccttattagatggatagtttgcaaaaactttcccccattctgtgggttgtcttttcatgtggctgattgttttctttaatgtgcagaatctttttaactttatgtgatcccagctctccagctttggttgcctgtacttctggggtattcctcaaagtctttgcacgatccaatatcctggagagtttcttttttcttatagtagtttcataatttgaggtcatctatggctttaatccattttgatttgaattttatatatgataagaggtatacattctagtttcatttttctgcatatgaatatccagtttttacagtaatatttatcaaagagactgtcttttccccaatgtatgttcttggaaactgtcaaaaataagttcactgtaaatgtacagatttttttctgggctctctattctgttccattggtctatgtgtctgtttttatgccagcaacatgctcttttggttactatagctctgtagtataatttgaagtcaggtaatgtgattcctccagcttggttctttttgctcaggatggctttggctattctgggtcttgtggttctacaaaaatttttggatagttttttctatttccatgaagaatgtcattgatcttttcataggggttgcactgaatttgtagattgctttgggtagtatggacattttaacaatattcttacaatccatgaccataaaatatctttccatttttttgtatgtgtcctcttcaatttcttatatcaatgttttatagttttcattgtagagatctttcactactttggttatgtctattcctaggtatcttctttgcgggtattgtaaataggattcctttttttgatttctttttcacatcgtccactgttggcatataaaaatgctactaatttttgtatgtaggttttgtatccttcaaatttactgaattggtttatcagttctaatagcttctcagtaccagtagaagatcatatcatcagcaaacaagaataattgacttcttcctttccaatttggatgccccttatttctttctcttctctgattgctctaactaggacttccaaggctatgtttaatagctagtgaaagtgggcatccttgtcttgttacagatcttagaggaagggttttcagttgttcctcattcagtatgatactagctgtgggcctgtcatatataacttttatggtgttgagatatgttccttttaaaatccctctaaaacctgagttttttgaggggttttttttttatcatgaaggatgtttatcaaatgctttttcaatatcaattgaaatgatcatatggattttgtccttcattctattgctatgatgtatgacactggtggatgtgtgtatgttaaaccatgtttgcatccctgggctattatgaataatctttttaatagattattgaatttggtttgctggtattttgttgaagatttttttcatcaatgttcatcagagatattggcctgtgggttttttttttccttttttttttttatatgtcttcttctggatttggtatcagggtaatactggcctcatagaatgagtttgggagtattccctcctcctctattctttgaaataggttgagtaagattggtattagttctttaagtgtttgttagaattcagcagtgaagccatcaggtcccaggcttttctttgctgggaacctttttatcatggcttcgatctcattacttgttattggcctattcaggttttggattattttccatggttcaatcttagtaggttgtatgtgtccagaatgtatccattttatctaagctttcctatttattggcatataattactcattgaagtctctgatgatcctctctgcagtatcaggtggaaattagcctccattttcctctcagattttatttatttgggtcttttctctgtttttcttattctgggtaaaggtttgtcaatttcatcttttcaaaaaaacaactttttgtttagttgatattttgtatttttttcatttcactttcatttatatctactctgatcttcattatttttcttctactaattttgagtttagttttctcttgctttctgtttctttaagatgcatcactcagttttttatttgaagttcttctgcttttttgatgtaggcatttattgctataaactttcctcttcgtactgcttttgctgtaccccagaggttttgatatgctatgcttccattttcatttgtttcaagtaatttttaaatttctcttagtttctttattgatccactggtcattcaagagcatactgtttaatttccatgtgtttgtatagtttccaaattgatttctagttttattcccttgcagtcagagaagatacttggtttttcaatttttttgaatttttaaagaactgttttgtgccaaaacatatggtctatccttgtcaatgatccatgtgctgaggagaagaatgtcttctgcaaccactggatgaaatgttctgtacatatctattaggttcatctggtctatactacagattaagtcttatgcttctttgttgattttctatctggacaatctgtccaaagctgaaagtgggctgttgaagtcttcagcttttattgtattggtatctttctctctctttagctccaataatattggctttatatatctgggtaatccagtgttgggtgcatatatttttacaattgttatatcctcttcctgaatgcacccctttatcattatatgataaccttgtctatgataaccttgtcttttatagatttttgtttagagatctattttttctgatataagtatagctactcctgctgttttgggtttctgtttgcatgaagtatctttttccatccctttatttttagtctacatatgtctttataggtgaagtgtgtttcttgtaggcaacagaccattgggtcttgtttcctttttcaatccattcagtcattctgtgtcttctgattggagaatttagtctatttacattcactgttattattgataagcaagaacttactcctgtcattttgttattcattttatgtttgtttcctggtcttcttcttcctttctgtcttcctttttgtaaaactctggtagtatgttttaatttcttgctttttattttttgtgtatccattgtaggttttttgatttaaggttatcatgaggtttgcaaataacataacatgttattttaaactaatgataacacttcaagaacaagcaaactaacaaacaagcaaagagaaaaccaataaaaacactttaacttcacccctcccacttttaaatttttgttgtctctatttttatcttacgccatttatgtcctgaaaagatgtatttgtttttatttttgattggcttatcttttagtctttctactgaaggtatgagtactttatacactgtaattgcagtgttataatgttcagatttttctgtgtacttaccattaccagtgagttttgtaccttcagatgatatagtattgcttgttaatatccttttacgtcagactgaaggactcccattagcatttgttataggacaggtctagtgttgataaataccctcagcttttgtttgtctgggaaagtcttcatttccccttcacatgtgaaggatatttttcctggatacactattctagcataaaagttgtattccttcagcaatttaaatatgtcatgcctgcctctcctggcctgtaagatttccactgaaaagtctgctgacagatgtatgggagctctttgaatgttatttgtttatttaatcttgttgcttttaattttttttcctaatacttgacctttgggagttacatgttttgaggtagtcttatttgggttaaatttacttggtgttctataaccttcccgtacttaaatatttatatctttcggtagttttggaaagttctctgttattatttctttgaaagactttctactctaatctctctctctctagctcctctttaaggccaaaaactcttgtgtctgtccttttgaggagaagactaagctctattttttaatcttgcccaaattcctgtctaaggggtctggagagttgtgccctacaaactatacattctcatcagatgggttttatttaattctatatatcgtgacttactttccaatctgactctggcataacagtacaacacaaggaagaaaatcaaaatattttaccccaaaacacgtttttctgccatatcttgaaatggccctgcaaagccatcctttgtgtgggaaaatctgcgtctgtgaagaatctctactaacatagctagatctttttcttccaggccctcccaatcctgaagagattaactaaaagcctagcaccttttaacgatctgaataggaaatacttgtcatctattgtctctaagggcagccactataagacttcaaaaagaccttggtctccacaatcttttatctttacctgaatatttcctttctattgatcccaagtctttagataaactcaaccaattgtcaaccagaaaatgtttaaatttacctatagcctggaagcccctgctttgagttgtcccacctttctgaaccaaaccaatgtatttgattgatgtctcatgcctccctaaaatacatataccaagctgtaccccaaccaccttgggcacatgttctgaggaccctcctaagggctgtgtcatgggccacagccactcatatttagctcagaataaatctcttcaaatattttacaaagtctgactcttttcatcaacagaggctattttctagatcttataggtgtacttcattatttttttttttgtctcctctgactgtatattttcaaatagcctgtctttaaacccactaattgtatcttctgcttaagcaattctgcttttgagtcactctgatgcattcttcagtatgtcaattaaattttttagctccaaaatttctgcttgattttttaatattatttcaatctctttgttaagtttatctaataggattctaaattccttctctgtgttatcttgaattttgtggtgctatttaaacagctattttgaattctctgaaaggtcacatatttttgtcactccagtatcagtctctggtgtgttatttagtttgtctggtgagggcatattttcatggatggttctgatgctgggggatatttgtcgatgtctgagccctgaagagttgggtatctattgtagtctcggcagtctaggtttgtttggatccatcctttctgagaagggtttccaagtattcaaagggaattgagtgttgtgatctaagtctttggtccctgcagccatgtctgcattaaagggcacctgaagcccagtatcactgtgagtcttgcagactcatagaggtattgcgtggcggtcttgaataagatccatgagaattccctgggttaccaggcggaatctctttttctcttcccctaatttctgccaaatgaatgaaatctctctctccatgacaagctgcctggagatgagggagaggtgatagaaacatccctgtaatcatcaccactaggactctattgggtccatgatgactaatgcctggctgctggtcatgttcactcaaggcctgtagcttcttcagttagcaggtggtgaatccagccatgcttgtggcctttccttcagagtggtgagctctgccccagcccagggcagatccagaaatgccatccaggagccagggcccagagttggaaactttatgaatctacttggtgctctgttctactgaggctgagctgacacataagccacaagacaaagttctccctacttttcactctcctttcctcatgcagaaagagtctctctctgtgaccaccatagccccaggcccatgatgagtactgcctgactactaccgatgttcgctcaaacaactgtcaaccagataatgttgagggctcttcattcaggttgcggtgaatgctgccaggcctgggcctctcccttcagggcaacaggctcctacctggtctaggactggtccagaaatgttgtccagaagccaagatctggaatcagggtccccactctgcctgagctgttgcccaagctgcaagacaaagtcccctttactcttctctttcctttcctcaagcaggaaaagtctttccctgtgacacctacagctgagaatgtgctgggtcacacctgaagctagcacaggcctgcgtcttacctaagacccatggcgagtactgcctgggtaccacttacgttttttctttctgagatggagtttcgcttttgttgcccaagctggagtgcaatggtgcaactgcggctcactgcaacgaccacctcccgggttcaagcaattctgcctcagcctcctgagtagctgggattacaggtgcacaccatcacacctggttaacttttttgtatttttagtagaaacagggtttcatcatgttagccaggctggtcttgaattcctgacctcaggtgatttgcacacctcagcctcccaaagtgctgggattacaggtgtgcaagacctacgggctctttagtcagcaggtgataaatcttgtcatgactgggtccttccttcaacaaagagggttctcttctgacccaggatccatctagaaatgttatctgggagctatgtcatggaatgagggcttcaggactctgcctggtgccctattctactatggctaagctggtatccaagttgcaaaacaaagtcctctttactctcctcctttccccaactaaagctgaagaaaggagtgtctcctggagctgcgagctgtattgcctcagttgggggaaaggtgatgctagcactcccttgacagccctggctgttgtcttactaggtcactccaatggctccaagcccagcatagtaccaggcttgtccttgtgggctaaactgcctctcaagtttattgagaatcccacagtgctttagtccatggtgatgggtctagctagaattcagattccaactatcaggatgcatgattcccttctggctactgcttgtctaaatgctccctccatgggcatgactaaattctgccttgtgttgctttccactgtgacagggtagcactgagttcccatgcaaagttccacaatcactgttctctctctccccaaaacacacagattctctctcccaccacgtggctgctgccagaagttgggggaggagtggggaagtgtaggcaatttaagatagtctttcctaccctcttcagtgccttcttccttgatatgatgttagaaccaggtactgtgattgctcgccttaagtttgattcatataggagtgcttttttgtcttgatagttaattgttcaatttggttttcctgagagatagggggacaattgctggagggttctatttgaccatcttgctctgcctcctccccctaattattcttttaatatcattaggagctgtagtaatgttcttctttcattcctaatattggccatttgtatcttctcttttttttttcctaatcagtctggcaagaggtttttaattcttattggttttttcaaagaacctgcttttaggtaatttatttattttttaaatttcattgatcttaaatttactatatccttgctttgacttactttgggtttaatttgctcttggtcttctagatttctacaatggaaacatagactattgatttgaaacattttttcttttgtaatatacccatttcatgttacagatctccctctgagcactttttagatgatctcacaaatttgcataaattctgtattaatttttatataggtaacatattttctaatttttcttttgatgtatttcttgacatatccatggattatttgaagtatcatgtttaacttctaaatatttgggaaatttttaggtatctttctgttattaatttctaatttcattctgttgtggatagacaacatatattgtataatttcaatcattttaactttactgaaatttgttttattgttactgggggtccttgttcttagagctcccaagatggcggcaagcctcttgttctctgacctggggttcttggcctcacagattccaaggaatggaatcttgggccatgcagtgagtgttatagctctactagaagctgtgggtcatggaagagaaccgtggaacctagcaactagtgttcagcttgattaggatgaatctgggcactgagccgtgcaggaacaatggcgagcctttatcctgactgggagtggcaatgggcgcctcgctggatcaggaggagcacagtggacaccctgccagatccagaggggtggaagtcagtggcaggtctgtgatggcagcaaacagcagtggtggacggtgagcgaaagctcagcttgagccgtaacaaacacggaccagaagggcgtgcagttgcaagattcaatagagtgaaaacagaactcccatataatgggaggggacccaaagggggttgccattgccatctagaatgcctgggtttatatcctgatcattgtccctccctctgtgctctcaggtgatagatgattgactatttatttacttcctgcttttagcctaattggtattttagtgagctctctttactacctgactggtcgggtgtgagctaagttgcaagccccgtatttaaaggtggatgcagtcaccttcccagctaggcttagggattcttagtcgccctaggaaatccagctagccctgtctctcattatgactcagaatatagtctaccttaggaaatattcaatgtgtacatgaaaaatatgtgtaattagctgttgttggggaagtattctataaacgtcaattaaatttacttggttaatagtattgttcaagtcttctgtgtctttactgactttctgcctactgttttatgaattgctgaaaaaggaatgttaaaatctccaactgtaattatggatttgtctatttttccttacaattctatcagttttttcttcatatattttgacactgttaataggtgaacacacatttatgactgttattccttccctttacaattgttgacttattcatgattcaaccactcacatttatttctttcacttttggaaaatgaggaggtttaactctattatatctttaagttctaatataagtcttcaaaatattgtcagaatttattatgttaccttgaaacaaaactagccaagttaaccctaaaagactaccctaaaataaaaatatttcaaaatgctttgaacaatcaacataacagagtatgaaaaaaataatgtcatctcctctaattctatactgataattaatttgtggaacttctataaaagtaaattttataaggtgaccataaaatgaatgtttgcaattcctagctatctttgcaccaaaagcttaagtattaaaaaggaaatatttgttaaaaaggaacattctttgcaattctaataatcccagcttttgcttcttaccaattcttacacacttagcacaaggacctattttcattgctgtcctaagtctcaacaagctagttagccagaattctctgcaaaagttccactgggtgaagggacttgcattttctaatatttttcctgggcttcttccacttctctttcataacccacattgtaattggtttttaaaaagctgttccaacctgactaaatgtctttgctaagctgatctctaatgatgaatatttaatgatacccaccaagtatttttctctctggaatattataagttcaaagtgtatgagacaaatgatacatttaattttttaaaattttaatttgtccagcccttcccctggagagaaggaacaaacacgtatgtatttcagattccctggcaaaatattttcctgaatttgtctctagcctaataatgcactgtccttccatttctgccctattctgaattcccagttctctatcagtgctcaagaaaacttaatctcttcctcagtaaactgctttattcctatctgaaagtttaatctgggcagatgttttacttaaagtctgccctccatgtctccatctgtgtggctgctattttacatttttaacctccaagagggtgaggctatgattgtctccatctacccatctttccatctactcatttttccatctacccatccaaatactccacaatttagcactgtgccatctacactaaagaactcaataaatggtcatatgatgatcatttcttgaccaaagtgcagaaattaaagtttgctgtggtggaagctgggaaacaggaaattactgttctcacattctcagtctcttgatgtaaaaaaattatggggctgcaccagatcatctctaagtcctctcagcactaacattttatgattctaatctatccagacagaaacagtgaacaaccagtacttctaactatgcaaactatgcaaatttaccattgggaatccaaattgatagaacaatattaaaaacccaaagcaggccagactcagtggctcacacctgtaatcccagcactttgagaggtggaagcttgcggatcgcctgaggtcaggggttggagaccagcctggccaacatggtgaaaccccatctccactaaaaatacaaaaattagccaggcatagtggcgcatgcctgtgatcccagctactcgggaggctgaggcaggagacttgcttgaacccaggaggcagaggttgcagtgagctgagactgtgccactgcactccagcctgggtgacagagcgagattccatctaaaaaaacaaacaaacaaacaaacaaaaaacaacattcatttaccctattaacagacttatgaaaatactattctagataaatccatttgaatctctttgactagttttcataataggactaatagctaattgatattttattgtataaaattatatattcctagtgtgtcaataatgaaaagattttactcaatttttttttctttttacttacttcagacttggcttcacatgactttaatccattttcagaaaccaaatccactcatagtagataaaaatttgccataaacaagcatactcaaaaaaatgtgccattgacataagaaataaaggcagggatgcaaagatgtttttaatgatggttcataggaatcagcgcttagtttcttaaagtgactttatttatttatttattttttgagatggagtctcgctctgtcacccaggctggagtgcagtggcacgatctcggctcactgcaagctctgcctcccaggttcaccccattctcctgcctcagccacccaagtagctaggattacaggcacccgccaccacgcccagctaatttttttttttttttttttttttttgtaattttcgtacagaaagggtttcaccatgttagccaggatggtctcgatctcctgacctcatgatccacccacctcagcctccaagagctgggattacaggcatgagccaccacacccggccttaaagtgactattttaaaggaaacaatcattgtttggatgaatatattatgatgtttgttaaaaactaataaatttaattggtatttcttttgtttttagtacctagaattttgaattagagattattaaaaatggcttctatagctaaatttcttcacaatctttcttttcttaatattcttattgagtaaattatttggaagggtaaaagcatgtggcttgctgagggaattgggtttgataaagtgcagctctaataggttaaaatattaattatactcatcgaagtacccaggttgatttctgaataagcactttagatccattacgattttcagattttataacaaagaaaaaaataccaattcaactggcaacctttcgtttaattttgaagagcaggatgaaattgactagttaaatatggcttgcaggttagtcttgatcacttcaagagaataaacatatcttcatatttcagcatgatttgattgcctataaggttttaaatgtgtcatgtaagcattactggaaaaatagcaattaaatttttgttagaattttagaaaggctgaaactagaaaatgattttttaagaagtttttaaaatcaccagtttaacatgtattgtacactcactgtgtgttctggagtcccggcagtgcttgccttcaaaagcccatacaatctagtagaagggcatttcccaaacatcagtgttcacctacagttttactactgttttctcttacatttacttgttaactttgcactctaaatctctgtataggggaggcttaaaagatggagagaagcacagagctgtatttgcatattagtttacatatgacttcttatcaaagcatggagtagttattataaatgagataattggagtattgtagagttaaagctctctcaaatcctcccatggttgccactactattcctaagcaatatctgtaaaaatcaacgtaataatccattagtgatatatatttacagtcattaaaataaaaatgtttatgcatcacctacaaacttgaattgtaccaggaattatacacagcatgctttagaagctactgttgtagaagatttaagatatgtacagaaatagctgacttgaacagccattaattgctgtgagcaaggtataaacaaatcacaaagattcaatgagagagaaatgagttcaaggaacaaaacatgtacttatatcacacacatgcttacattgaacaaatatgacagggctttggcaaactctgcttctgtagactctgctgaaagccattattaatgcttcctcacctacctcatcttatcccgtaaaacatctgtttgtttaaaaagaaactgtatactaactcttcaactacaagttaaaaatcatgacttttctttcaaggggaagaaggatggggaataaacatgccttctgcaattttactaaaaaattccaatgttaattaaaaccatatatttagtatgggtaaaggtaataaatggggatgtcttggacaaaaccatgctcctctgtgaattcaaattagtaatgctgtgttactggctgacttttgaacattctgttctatttgaaacagctgagacaggaaggaagcctgtatgtcctacagaaacccaattaggcttgatgaaagagaggccatgaaatgcttctcttgtctaccaagacagagaaaatgttgtgttaggttcagctttgaaatgaattctaactataagcttttagatcaggcgttgtccagttagcttggtcaacttaagacaatattacattatgctctcacaattgtggatgttggtcctgctcaaaatcttgacaggcttctagaaagctgatcctttttgtcctggtgattgccacaggaataaacagaggagatggctctagccttggattgattgaaagagaacctgacttgctcacttcctgctaacccttccctacaccagcagtgtggtcatgttggatgtttcagtgccttcttacaacagcaacaacataagagaagccagctgccaacatggtctgctattccaacagttatttgtctgtcaacagtaatatagtcagaatctacaactgaaattctaatagtgatcctctcccaaactgagatgtggataaatgttttcttgtgctttgtccttacaaacctcttttcaaaagactcttgagcatctttctttcctctgaacccccaatgcagtttattggggccacttttttggggccacctttatagcatttagcccttttcatttttgtaccacagtaatttgtatgaaggatttaaattcctaagggttggtaatgttttttcttatgatgccattctcctgagctcctagcacagtgccttggtttgcattagaaatccaataaatgtttgattaatgctgtgtttagaaaaacaacaacaaaaacatgaacatcctccaactacaacaaaaaaggcagatatttttgtttcattttgttcactgatgtgagtcccatgcacctagaaagttcctggcacacagctgacactcaataaatatttgttgaatgaataagtattatgactttccaaagagcttggagagtatctatttgattggcaaatacagaaaaaggaaacatgtcatataatgtgtaaaggaagaagtagattagtaatttcttcttcctctagaccagaggttggaaaactttttctatagagggccagatggtaaatactttagtctttgtgggccatatggtttctgtagcaactattcaactctactgttcagtgcaaaagcagccaaagacaatatatgaataaatgagtgtggttgtattccaataaaactttatttacaaaaacagttggcaggcaagattggacccataagcagtttgccaacctctgctctagagcacctgtgtctgttagaagtaaggtaactaggtaactattctctcctttaataccatgctttctgcatctttatacatttgttccccaaccccacacccacaggtactgtgttttgcaacatggtagctgtacagtatgtttgttgcattaaactgagtcttacactgatttcctggaactgtagttttcagtagaaccagtgaactcaagtccctgtaatttgccttttctttgaattctgtcttagcaaaggtgggtaaagttaatagctactgaaataatgtcttctgaaactgatggagtaaggggcacattctctcttgagttcctatttctcttatctgaagcattttcttcaggatgtcagtgatgtatcagagctggctcttctgattatccatgaagacaagaaatgactaacacaactttctcactactcatttaagctcactcttcttttaaagctgcctcctctctcagtcttttgtaaaaaacttattttcatgaaaggaatatgagaaaacgaccattggtatctacaattggcaaaaatgtgttcctatattttcctcaccaatgactaccaaaaatgttatattcctgtgagttttatgttaaataactatattatttcagaacaggaatctgtgacatatggtgatagtcaataaatgcattgctaaaatgtatctgttttaaaatatttaagtagtattaatgtggaacaacaccatcataaaatgtgttctgcaggtctattctatacttgcactatctacttgcaaaattttcaaatttgtttttcattttgctaagtgctggcccctcttatgaactaggcctgattccctcttcagctgcaaatgcaattttaaacagaactccgatgagattacttgctgaacacgttaaacattcatagctttgccatatgctgttatggaaattgcattgatttatagcaatttgggtgccaccagatagcaccgattcacctgataccaactctaagtgtattgggaaataatgttttaaatgtttcatttgcatctagacctctgttgaactaagaggcatgtactatgtttatgtatttttggagaacactaatttttacacattgaaaattattcctgcatttggtgacttccagaaaaaattaggtatataaggtctaaatttatactgtaatggcacagtggtcaatgacataaattactaaagccaggcagacttaggttttcatcccgattcaaccatttaattattactctacagccttgctttcttcaatggcataagaaggaaaataatcacgcctatctgagaggatttctgtgaatgttaaatatgataaggtatataaggcatgtaacacctacaaaaagaaatgtcttgtggtttgttctaaaatatgctcaataatcattagctctcatagcctaaactttgtatttctgtataggttagtggcactcctttacatgatgcagaaatgcttgagtttgtaggacttgactgggaatgttggaagatgatttagggaacttaaaaattgccatacgagacaaggtcaccactatagtgaatatacggatctattaaaaacaaaggtaaaaaggaacaaagtcacaggatgctctcttcacagtaagggtatcaataacctgtcctaattgtgttaatttttatttggaagggaggaagtataatactcattttaagcatgctaagaaggagttatggaaatgaacactgtctttatatccactgagcattctatccaattacattcagaggaggaaagacgcttcttagaattaattatatttcactgtaataagtgaatatatacagtgtaatgaatattcatacatattcaagtttgtaagaatataaaaaagccagaaaacctttagcttttttttaattgacttggagtgcacatttgaatatagatggactctctctgggtcagcattctcaacagggggcatctttgccctccaggggacatttgacaatgtcaggagacatttttcgatgttacaacttgagatgggagatgttactggcatctagtgcgtacattttagggatgcaactaaatatactgcaacgcataagactacctctaccacaatgaattaactggccccaaatatcaagaatgccaaggctgagaaactctgctctaaactgagagctgcccaaggtcaaatggatttaaaatcacccagatcccagatggatactgggtaggctctagagaatgtatgctttttgttaatacggttaagtcttcccagtgtcctgtgctggctccacggtaataaaccaaaagctgaagtattaatatggagttcatatcccctctagaagaaaatgactagaattccaaagtacaatatattatctgacctactgcagacttcagtgtggagagcagctagacttatacatagaagaaggtgatcatcacactaagattttgaccaaccaagtgaccaggggtttcttggctcttaagcagcaccagttcccgtaaacaagtaacatatcaagcagtgatggcacagacttaaggcttacttcccagacaaaatgtggtaggcacaaactctggatttttattctccatttccacagaattgaaagtctatttaatatatcaaggaaaatattttctttcacaagtgcccttacacaaacactgcagaggctgcttaagaggttgtagccttaaacatggatactacttaaagactaaaaaagtatataaagaaaattactttgaaacttttggttctgtacttggtgtcatcttggtgatgctgaagagaatttctgcgaaccctgtatttggaatatcttccatcagttctctcagatgaactgcaggaatcctggaaaaaaaaaaaagcaaagggtctgaactggtagatgaaagaaaatcagtgcttgaaattagagtaagaaagagtctatatgtagataaaaatgaaaataaataattacaaaaatttagagatatataggagaatcacaggccaccatagagaaagaagaaggctacacacagtggctcaaacctgtaatcccagcactttaggaggccaaggtgggaggatagctctagtccaggagttcgagaccagcctgggcaacatggtgaaacctcacctctacaaaaaaatacaaaaactagtcagatatggtggtgcatggctgtagtcccagctactcaggaggctgaggtgggagaatgaggattgcttgagcccaggaggcagaggttgcagtgagattgtgctactgcactacagcctgggtgaaagagcaaggctctgtctaaaaaaaaaaaaaaaaagaacaagaaaaagaagaaaattgtcactgtggataaaaccataaaaatacaatgcatcctacagtggttacctgaattcttttaacaactagtccctatgcccatctacagtgactgacaccctttagaacaaggttcaagtagcaatgaactgtccaaagatgtcattaatgacacatgccacatttggatgctgtgtactatcacttgcattggtacttagcatcaatatattcttgttttaaaaaattgctacctgtaaaactagagcccttttacttcacttatccataaacaacatcccaccttttaactattatgtcgcatagatttttaaactggaggatagctcctttgcttttaaaaacataaaaagattcaggtaataaaaaaaattaagaaaacaaaaatttccaggcctgccttttttcttttttttcctcttcatttcttgggggaagaaggaacacagcaaacagtcactatagacaattatttagacatttctattattatttagggagaaattagaaaaacaatgaggacaactgattttggtatgtaaaaaaaaacacgtacggatttagtgtccctcaaagtcccaagaaaccttaaacttactgagtgttcaagctagaaggggtattataattccaaagttctcatgcttagtacaaaaacaaaacaaaacaaaaacctctaaaaaactagagcccagggaagttaagaatgacttgcccagggctggacaatttgtggcagattggacttagaactcaatgctattccctttctacctaatcaaaaatgtaatgtttaaatatggaattatagagctgaaacaattcttttttatttttgagacggagtctcactctgtcacccaggctggagtgcaatggcacgatctcagtgcactgcaacctccgccgccctggttcaagcaattctcctgccccagcctcctgagtatctgggattacaggcatgtgccatcacgcccagctaattttgtgtttttagtagagacgggctttcaccatgctggtcaggctggtcttgaactcctgacctcaggttgtcagcccacctcagcctcccaaagtgctgagattacaggcgtgagccactgcgcccagccaacaattctttcaaaataaatatgaccgcatttaaacaagaataaagtcaggcctatctaaataagatgaggtccgtactcacacttaaaagtcataggctatggtactatcaagaaatacgtatataggaacccagagataatattgttcaggtgcctcatcagatgaatgcggacatatctcctgaggcattaggtgatttttgtctggtgcatgactttggaccagaacttaggtctttgtattcttgttcacgccacactgatttttagaaagttgaaagggtttgaataaatataatccacatctaataatctcaaggctttatgtattttcatttaaggctatatctagtcatttttattaacttgattaaaatcagctctttttaatcacatagagggctttagagtacatgtagaacggattttaagctaaaagcagcagggcgaagcagatgggctctgctgttttacacagaattagatcccacctccagctagtttatgggctccaagcttcagtgtcctcatctataaaatgggtgaaaataacacccatctatagagtatctctgaagattaggaaacatgtaccataaagtacttagcacctgctaagtatcatgcactgtgtgcataacacttgctaattaactctttcccttttcaagctaaacgtttcaatttcagtatattgggaagtacaatgctgaactctgaaaaagactctcccaaaaaattttactatttaggcatcttcatatgtgagtctgtatgtatatgagctagacttgtagatgatcactagctcataggattaaaaataataataatgagccttttggtaatagtagagaatacaacttttaaattgtacttatgaacattctgttcattgtagacaactggggaaaaagtgatctgtcactggaggttaaaatgtatatttttatgctggtataagacaggtatctatttctcagtgacaagtgcaacctgtttcccatattttctcttgtctgcccttcatttacttggataatttagttacagagaaaaaaatgaaaataatatgggcataacatattgtctcctatcacactgggttgtttaagagtaaacagaaattgcactgttttggatactggtttcataattctttgatagatatttaaactgcaaatatataatcaaatcaaacacttggttttgttcaatttgggatagtctagctttctagattcgtcagctaaactggatctcactcaaaaatgttagttactgaactaccaaaagatgcttaatgcaaggtaattttaagacagtgtagaccttgggaaccacattatatcaatgcttccaataaatcaatatggcatgatctggccattttcctatccactgtatcttcaaataatatgtcagatctaaacagaacctaaatataacataagttatattttaaggccaatgtgaaatatgattacatggttgccaaaaagaaatccttcccattgttagcttcagctatacaaggtcaataaattataaatcattaaaattttacattgcatctgcagccctaaggctatatacgacgttcttgggaccagaccttgtctggcaggactggcagcagagatatttgttttgcatatctcctctatgaggaatttaaaaaactacacaatgtaaattaacacatgtaactaattggcttgataatgaaatgctttgtggttagaggtctatcaataaatggccatgaaatatgaaatgtgaaatttacgtggatttgagttcatatgtcatagtgtaaagataacttgggaactaccatatctctaaaacaaacagtacccaaataattcacaaattaaaattgctaaccaaaaaagttatctattgtcagtgtaatgtgtaactccctttaattcttaggcttttctaaattatcattaaagttttaggggcccaactgagcttctagtagtacagtgaaagtctatatcttcctatcttgtgctaatacataagttgcattgttttcaattctaacttcacaaatgtcaataaaccctgataaggtggtatgttaaaagttcccaatgttttttggtccttcttccttttctatacttttctttgcacatcaggaagatgtcaagtgttctcactcagataaaatactgaaagagacaagccaactctttctcactctgaagtctttgaaatcttctagtaggctcagtttctcaggcacagactccagatggtccaaggccacttgggtactctgaaatagaaaacataaggaaaccaaacattataaaaaattgattaatactctcagaatccacatactaaaaatcagatgcaccactgtaagaagcagttcaaactgtagatttagacagtcaaataagaacatatataatagtattttcaagataaatgtatcttttgaaaatagaagaattatttccttttaaaaagtatatgagatgcatttgcaagactgactcagatacaaaaattcttcctggataattgctttcaactgatatgctatgaaactttctatagactatttcatattaatattaatttacaaacctgcttcagtgaacatcagaaatagactatgaggtaatactgagaaacagatgaatctgcagttacttatctatggagtatattagagattcttaaatgttgccattataaagaagaaaagagttctcagcaattatttcagttaaaagggaaagaggagtggttctcaagatttgggagaaatatctgaaattaaacatttgcttcagggacacaaggtcctgttgatcataagtcaataacttattacacagtctttaattagctgatcactgttacacccacctgtgaacattaagtgagaatgatatgaaaattatttcaaagcaaacataaaataaaaagttaaatggtaaaataatcttgagactagagactgcatatatattataggcatctctgtatcctcagctctgtcacaatgccagacatattaggtgggtaacaggtgctagctcttaaatttaaaatggattttaattgttcaatgaaataaacaataaaccctatggctgacgcatgggaagaaagagaagtgtactgcaagaacctagacataaatttgcacaaagttgcagggaagttagtggcccctcaatattccatgtgcttccctacttctcccctgtgaaaggttctgaacaatggactctgagagtgtcacttctggaatgagacagttgaacctgagcgttcccccttctatcccagcccctaccatgaggaccctgatggccacatgctccagaaggcataactacaagattaagatgagagctgcccaccatattggatttcacgtgagtcacacaataacctctactgtgttaagccataagatttcagagttagttatcaatgcatcatatagcattaattatcatatataatacctaccctgagaattaaataatgaaattgtaagctaaataagtagtcaactggctcattttgtggaatggggaatctctcaattatgagtatatatatatatattttttttctgagacagggtctcgctctgttgtccaggctagagtgcaaaggcacattcacagctcactgcagtctcaacctcctgggctcaagggatcctctgacctcagcctctgaggacctgggactacaggcacacactaccacacccagctatataattttttctcgggaggagttcattattttctcagttaactttcctatttgaaatctcccatctccctgaacagagagatgctgttctctgcctggcatatccaatccagagcctcactgatgcagtttcccccacagcatatactttatgtctttcacggggttcagggtagaggcacatatggagacagagggctgagggtctaacccttccttacagacactttcaatgtacccatccacccctccttccacagtaactgtgctaattactccaatgcaaatggctttccagaattctgcagggtgaatgatatttgattgctttccattgctatccccttggcagatccttgagtttcaccttttctgttctgagtcattttactacttttcaatgttctgtgacatggagttacagatgtcttctagttttgacacgtgtaaatcagtttttctatttcttcatatccttatttttgtaatgagatttttgagaagggcagaaatacctttactctgccattctgaaagggaagtctacatgctgtttcttcaagttcataaagttctctttttcaagttccattgaaaggatttagtagtttgttccttctgcttaacatttatattattgttagtctttaggccacatgtactcacttacactgccatgcattttaaatgacttcatctaattttttcatgtgtaggaaagattcatcaaaatgatgtgtttcttactataagccacaacatgtaggcttaggagcttgcagttttagccaccgtatatgccatattcatttaaataataaaattataggttttcttaggaatttattgactcttgaacaataaaatacaaagcaatgccctgatgattttaaatcaaaattttatgcattgcataaaatcctcttcataaacacactccaataatatctgtagtattaaaactttatttcctttttttgttccataatttttctcattttgaagtgatcttctgaaccaaggttaagtaagtatgtaaaactcattttgtgctcaaaataagtaaatgatctcttaccctactgtaaaacgcagcatgttaagtaaatagttttgcttaaaattttcaatcaaccaggcgactacatgaaaccattcttttccttgcatgtgtttacatactatttttgacaattatatgatggttttggatgtatattcaaacggctatgtttttgtgagtgaattttgaaaaactccttgactccttcttttctcagtgcagttatttttattctcccctcccttgccatcccccgctgcccccatctcccttaaccaatctttatacttcctcactatttatttcacttgtggcttattttatattccatttatgcattgcttataaatatcttcctcaatatcagaaacactttctggtacacatacctttcttttcatccttatattctagtcaattaacaacaaatatgtatctcggatatcatagaaagatccacaaacatagatggcatacgtcctgttcttcaggagcatttagctcacccaggggaacaaaagatgtaataattatacaaagaaaaaagttatttgtacttactttaagggaattgcatgcacaaatgctgaactaactagggcatttgcaacaacaagatgtgaagtaatgaagacaatgagtccaatcttacaggcgtctcaggtctcataatttcatgattaagtgatattttttgggagaaaaatgtattttctggctcttctctctctctctgcatgtatgtgagtgtacttaaaactgccactttggcatacaaactcaagaacatgaataacattgcaacttttttttttttaatttaagattggctgggattctgtgattagaatcttgtcacattacttaagatttcaaaattattttcaccccaaagctcacagccagagagacaagatccattagcagatgaatagtttaaaataagaaacttgctgtatttcagagatgtcatgaggacctatgtcatgttaattcccagggcaaaatactttgtgcagagtcagggaaatattttgttttctaagttggttaatttttttctgccttacattatctcatgccttaaagggcatggacaagtccccactgttaagggagcagggccggacgtggtggctcacgcctgtaatcccaacactttgggagtccgaggcgggtggatcatgaggtcaggagattgagaccatcctggtgaacacggtgaaaccccatctctactaaaaatacaaaaaattagccgggcgcggtggcgggcacctgtagtcccagctacttgggaggctgaggcaggagaatggagtgaacctgggaggtgcagcttgcagtgagcccagatcacaccactgcactccagcctgggcgacagagcaagattccgtctcaaaaaaaaaaaaaaaaaaaaaagggagcaaagtttatttcaataatgtcaccagcatatgacacgtgcttaatttgtctttagttgttttcgagaataaataaatcagatgcttacaaaggggtttaaaattagaaaacaaagaaaagttcacaattaagattccacttcataaagggccagtacattgtgtatatttggtttatctcagaggctagaagagctggacttccagggacctagaagtagggtcaaagcagatgatcagttaatcttaatcctgtttagtagcaaaatgaaagactgaaccatgaacacataattcaaatttgaatacacttcctaatccctcacaccaccataagagataggtacgtattattgttatcatcattatacagataaggcaattgaggaccggagagtgtaaataacttccttgcagtcagatggtggcaaagctgggatgcaaatccaagcagtctgaatgcagaaatggcaaggttcttattaggaaaatattttcatggcaaattgccagctaaaacggagtacattgcaactagaagctaaatagtgagtgctttatgtaaattcctaacttccctctagctatcaactcttagcagctagactttgaagatgtgtccttgataggcttatttctggaagaaaagttttaagatgaaaccataaagaatgtaatctcactggtgctaaagagtctgtactcaggaccacgtgtctaaacacacttgtgtgcacacacgcgcacgcatacatgcacacactcacacacacacacacacatggggtctggatagtgtttctgttgattataggatgttaaatgtcagaggagttttatgatactaacactgccttttctttttttcataacatttaacactagtgaagcatactacctggccactaagaggtgtttcaaataaatgttggctgaatgcagacaaaggtagacttaccatgttctaataaacccactgaatcttgacctctttattaaaaccccagaagcacaagtttgatgttttatgtatttcctctagactaagggcaagatcaagtggtagaggcaatagtgaaattcagaaatcttgtctaataggccctgtggcttttgcacctacagatgtgtttggctatctgttgacaagggcaaagagtaagctgtcagttttgccattctgaaatctgcaacaacaccaaactcctatgaagttcagctgtctgtactgttccacagtacatttttccttagtagttcctttatttctgactgcagggaaaccaaataatatagtatgacaacataagtagcagcaattaggaattaaaaggggggaatgcattgcaattcttagattcctgtctcctgtagagaaaacttaaggaacagatttaaccataaatatattttagtatttatactgctctttgaaaaaaaatgcacatttattttcttattaacatgtaacaactaccattttcttatagtgttattgaaatcatatgtgttttgaggtttagatgatgaataaattaaaggagatgatatctacatttttattttaaaaataaatgtgtgagtttttggcactgcacacatgttaaataaataaggctatgaagcagtttatttgggttcaaaaatgcaattctatttcatttggaaacagatccactgcaaaactttcctgacaaatggctgaaaggtggtaaaaggacctgagtaaacacgtttctgggagaggaagggtgagatcatgaaatggatagactgtatgccttttcacttgtggtaactcgatccagcacagctgtattggcttcatagggccctgttttccaaactgtataagacactcactggaaccacaccaaacagtagcagagaataggccaccgaagtcacggtgttgatgcacattctttatgagccccagtgttcaaagttgtgtgtatttcttgggatatcagaggagtcctctatttctagactgtattttatgagcggtctaaaaaatcagatgcccacttagaagtgtttacatgtgtattggggtaagagggtacataaggcttgttaagtaaaaatgcttgttaagttaacatggcactatgacatcagtgtctacatttgggctaacatctaaaagagtttttgtcaacaacaaattctatttgtcttcatataacactattgtagtcaaaagtggtagatctcctttaaaaagcaatgataaaatttgagaacaggtaacatatcttcactgaaaactgagatacagaaggctttctaggtattttccaactcctattcacagtatttttttttaagagaggaactatatgaaatacagaatctgccatttcaaattactgctttcttatttctacatgtaagtgaattatgttacagtcaacccattatcttactattagcttaaaaagatgtagtattttctccaaatgagtgatttgggttttctttttttcctttcaatacgaaaacaccaagaatgatttgatggagaagggaagacagaggaaataaaagaatcatctctttcccagaggattcttgaaattgtcttctttcatatcattcttgccactccctgatataaagaaaaaataacacacaaagacaaatgaggactagtttaatgttctctgtgtgctgaacaataaactaggcacttacaactgttttacaagaaggagggtcttgagatctacaatctacttaattgtaatcacttcatttcttaaaactgaacataaaatgtactcacaagggaaagaaatttcagagcgtttgcaaaaaaacaattctttttaagtgattgcatgttaaaatatgaacaaacagtataagccaaggtttcctagaagatactgtgtttagcaatttttgctatggtgacaggtaaagaaactatgcttctagatacacaggtcccaaacacgtgtaaccagctgaatgatgaacagaggcggaatatatgctgcattggaaatcagcatccctaatttgtggatattcatagttccagtaatgttacttacttgtgttttgtgattttgggaatatgactttgccctgcccttctaagcttccgtatcttatttgcaaaatggggatcaatattaatggtctttattattctacgcccacagaacaatacattcacattcactctcttacttgtgactatcaagtacttacttgtgataggcacaagtaggacagtgaatgtgaatgtgaactgaaaagtgtcaagtacttttcaaacagcagatttttttttttaaagctgaatctctgaggtaccatcaactctagtaacttctaaaacgtgaagaggtcagtgaccatctaaaattagagttaataaaaactagtcaacagagcacaaagcagaaaaaagccaaacttaattaaaactatatctaacatttagaaatgcatttactattctacaaacatcatctaagatgttaaagtaatagaagtgtaatagcacaaaaattacttttgtacatattgtgccttccatggagaatgttccttccaatttccttatccagttaacacttttccccacaatgctataagcatcttcaagcatacaggaaatgtgaaagaaatttacagagctcacccgtatacccaccacctagattcaactattaacattatgttttatatttgctttatcatatatcaatccatctatccatcactctgtctatccttcgatccaacttatttttggggtgcatttcgaagtacattgcatacattaatacacgttccctcacctaattcagcacgcatatcatcaactccacttcattatttttttaaatgtagaatttgcatgtaatgaaaagcacaaatcctaagtgaactggttaacttttactttctttcgtatgtcagcttagtcatcacttcctcagggaaggctccccggctttctctgatactgtgaaacaatctctccattgcctcatgagcctcacattggcaacacttactggagcactaatataatattaatttgtgtgacctattaatgcttgcattagcagtgggcaataagcatcatgagagtagggaatatatgtccccagcattccaccaaagtgcctgacccaggagagctattcagcaaatactacgtaaacaaatgaatgaatactatttgatgaaggaaagcttttcacatttattcagtctgcaaatatttactgaatgcctcagacactgttctagaggtgaaaaggtaaaaactctctgtcctcaggaacagaaatgggagagaaactaacatgttcataaaatatgatgtcataaacactctgaagaagtgtaaagcagggtaaagtggtagtgagtgatagggtttctattttagacacaggggtctgtgacagcctctctgatgcaatggttttggagcagactgagtcatgagcattgccagaggaaagcaatggggacaggatatgttgcgggaagtcagggacctcgaacagagggaccggctggagccgcggcagaggagcataacttgtgaagatttcaaggacatttatcagttcccaaataatactcttataatttattacgcctatctttactttaatctcttaatcccattatcttcataagctgaggatgtacgtcaccacaggaccactgtgataattctgttaactgtacaaattgattgtaaaacatgtgtgtttgaacaatatgaaatcagtgcaccttgaaaaagaacagaacagcagcaatttttagggaacaagggaagacaatcataaggtctgactgcctgcggggtcaggcaaaacagccatatttttcttcttgcagagagcgtataaacagatgtgcaagtaggagagatatcgccaagttcttttcctagcaaggaatattaatattaatacctcggggaaggaatgcattcctggggggaggtctataaacagccgctctgggaatgtctgtcttatgtggttgagataaggactgagatacgccctggtctcctgcagtaccctcaggcttactagagtggggaaaaactccaccctggtacatttgtggtcagactggttctctgctctcgaaccctgttttctgttgtttaagatgtttatcaagacaatacatgcaccgtgcaccgctgaacatagacccttatcaatggttctgctttttccctttgtcctgttccctcagaagcatgtgatctttgttagacccttagtagtagttctgctttttgccctttgaagcatgtgatctttgtacctactccctgttcttacaccccccccccttttgaaacccttaataaaaacttgctggtctgagactcagggagcatcacagtcctactgatatgtgatgtcacccctggcggcccagctgtaaaatttctctctttgtactgtctctctttatttctcagccagctgacacttacggaaaatagaaagaacctactttgaaataatgggaacaggttcccccagtaaggataaactcagggccaaggccctaaggagggcacctgtgtggcactttgcgggaatgaatagtgaagagcctggtgtggccaggtaggagcttgcagccaggtgaggccaaagatgtctggggcaagaggttttagagcctttttggccacagctaaaattctgtatttaattcttaatgagatggaaggtcttttgagggtttgagcagaggaatgacatcctctcatttactctctaaataaatatcaggatgtcatttggagagcagactgctagcccctcacccctaaccaggagaaggtcttgtggagtttgggagtgctgtgtgaggggaagatgggcatcttactcctaggctggggacttgctgaacagtagcagaaactctgagacccacctcagggtgtcctttgcatagaggtctgtgaaaaatttacagggagaataggcggaatccccagaaggccaatggtaccataccaaatgctcccgatttaccccaaacactctctcaccccaagagcatgcattttggctgtaaacttctgaaaatgtcatatatgtccacaaaatgttttctctaatcatatttttatttgtggtaaccttctgattaaggacaggcagcaagacatagtaaaaaagatcatcaataagaagaaatcaggagatacaaggttatagctcagctttgacattaccagttgtatgaacttgggcaaacaatttaacccatggttctcagtttctaagtcaggaaaatgggaaaacagtatctgaacatctctaataacctttttggcactagccatagtccactgtagcattaagttcttcctatagcaggttaggatctcctttttaagcttaaaaggctggaaagagtatggagaaaaaaagattttataaagaaaaagcaaactaaggaaaaaagtagatatggggttcttggagttaatatttacccaagaatacctatggagtggaaaaaccttcactcttctatggcagaaagtgaagctaatgactgtgttaaaaaaaaaaaaaaaaaaaaaaccaggaaaaaagacatttttgtttccttgggtgtttaccccatgaaattaccaactccaaatatttgtcatggtgtatttttagaaaagatgcttccaaaagcaggcaatgaacttgcttttcatttttttcaccttataactggcctaacttaaaaaaaaaaatctcacaatcttacccttatctaaatactgctaattaacttctcattttattgccacaaatcttactccatacttttgcttctgtcctgaaagcttctatgccatcgtgactttatacatgaaggtctatctgtctgaaatgttctctacacattgcttaaatgagctcactgattctcctgcaagactgggcttggtcaatacctcctgtaacatgacagttaagagcttgggctcttgaggcagtctacctgagtttaaaccctgggttagtcacctactggctatctgtctatagaaaagttcctgatccctctacactgggactcagtttcctaattttgcagagttgttgtaaggatcaaatacattaacacatgtaaagtgcttagagcagggcttggcatgcggtaagcactcaataaatgttagctattactacaatgataacactagttattattctctgagcctttcctctaaactctgggttaagtgcccatccttagtatttcctatgtgtatatgtacctcccatcctgtgtgtaattattttgtaatgtgtgtttacttgtctctttcattacactgcaaattccttaaaggcaggatgatatttttacctatatttccaatgctgagtacttggtatcacacatgaatacatttcaattttattaaataaaaccttatcataaacatacataaagatacatttagaacttagaaatattgtggcaagaaaaatactgcaagattatattttaaatgcagaatttaaaaatcgactatctttgagggacagagaatatttctcaacagactcaaaattaaagaaataataaaaacaaaaaacagaactgaaagaagaatgaggggatggtaaagttcagatagacagtatagaccgagttaaagagaggaagatgagaaccaagtcttctgtggacctaatgacatggcataggagtgagtgctctgaagagcaacatgtttcctatggatgagtctataggagcttggccctgctggacaatgatggggacacccaacacagggcagatactgagaaatgctaatcatttccctgaatcctgcaaagccctggccccaagtcctcaagacaccctcaagtaggtaatcacatttgtctcttccatatttaacctggagcagagggtcctgatagagagctctgattaggaatgatcattgttctggctaaggtagggtctaggttgatttatttaaaagcgccttggtgaggtaaacataattaatcttctctgtcctcaaaataaagggctattttcttttttagagatgtcctgtgttctcaaagagaatgacaaaataaattaatcattttccattactccacacacagcacttggatgttgaaagaccatgtgaacagctaatcctcctatatggatgaatttcttgtgacaggcagatcagatctaaacagaaatccggcaaggtattttatttttaccattgtggcattgagatttatttcaaaaataagtgagatcaactatgcctatatttttaaagtttactttcataattaatccttttttgaacacttagaaacactcttctggctcttgtagcaaagtgtttccctgacgactgctgccaaagcagacggaagcagagactatcaggtatatcttaaaaccttcaaaaatccagctgcactgtctcaaagaatcctcactgccaaaccatacttagttaaaagtaccaataatctgaagttagagcaatatattttgacaaacaatttatctagacagctaatgttaaaggttaagtatgtttgagatgctctattaggctaaatggctgaacaaaaagtattaagagggtacatatggagtacatgtgagcacaagtatatatttttgaagttggcctgatgctgaatcttcaaccactggctgtgaaaaatggatcatgaaaaccagtggatacaatacagctgacaatgttatttggtgaacacattcatctaagatttgccacaaccaattgctttcttgaaactccaatagctagaaagtccttcccttccctgcccaaatgaaagccatgcattcattcaactggacaacaatgaagctttgtggctggtagcaaataggaaaaagagttggtcttgccaaaacaatttgaagttttgaactcaggccccctcccctacttcattttacatattcaactaaaatgagtaagtcctgcagcctttaccagacacattagtaactaaaagtagccaaaaccacacaactttggacacttcgagtgtgctatgaaaactctagaaaacatgcaatactccgaaaattaggcaggatttcacaaaagcttattaatagaactggatacagcatccagtctttcctgtactcaacaagcatttactagcacctactatgtgcaaatcaaatctacgacatcactataccagattttattctgctaaagctgaccagattcagctcaagaacattctttgggtttctgaatgaaaataggtcaatagagataaacgtgtatactatatcataatttttcattagccatctttttttcccattaaattgaaaactcttaaacatagggactctcttagtttggctgctaagtaataaaataagtaataaaaataccataaagtgggtggcttaaacaacaaacatttagttctcacaattctggaggctgggaactccaagaccaaggctccagcagatcttgtgtctggtgaggacctgcttcctagcttatgtagacagccccctttttgaggtgtcctcacatagccaggagagagatcatctctctagtatcttttgcttcttatatgggcactaattccatcatgcaggctccaacctcatgacctcatgacctaataatctgccaaagggcctacctaccttgccggcttgcaagttgtgcaaaatctcagactcctcacggacatactttgggcaatataatttaaaaaatgaagtattatgtaatagtgattatttagttctttgattctaacatccttctatgtgattccatcattcctctattttcatattattttagttctttctagcacagttagaaacaattgatgaataatgataaaataatttccagaatgataaaatagcaaaatacttcaagaatatgagatcaccaagatctattatgtatctgcaagacagaatgggacttactatgttttaaaaataaggaaaatctctatttgtgtcttcatagaagatctttttaagagggataaaagttttttatttgattttaagaaaatcaatacttaaaaaaattttaaaaccaagattgggttcagttgaccctgatagtagactgagaagtaaaccacccttgaaaagctctcaaccttttaccatcattctcagaatcctcttcatcctcttagtctcaagtttctcctccctgtgagcctactcaaaccacttctgtggagtctgataggacttcaaacaagaagtacttgtcccatgccaccctccagtgcagtgcctataagaaggaaccatgcttcctactgaatccattgcatggagtagttggttatcacatgctgaatggagaaatgaatgaaaggcaatgagtgtgatgcaacaaaggattaacacaagagtagtaagaggaaaaattagaaaaggaagatgagagagccagtttacataatcttaatcaatataccagcaattacactgatttaccataaaaataaacaataaccactaatttgtttttaactgtttatatagtttccaaagataatggttttgtaaatcagtcaatttgttgtaatttgttaaaataagagaattggtcatttggcgagttcatgactgagcaaactggtccttgaagttagatctgacaaattttaatgttaacaaaaggctaaaatgaagctcccttgatccttggacagttatggaaaataatgtgtgagaaagaatcttacaactgttgtttcaatagattaaaaagaaaaaatactggggagagaagacatgatgctatcagcagaaaagacatgaaattaagtctgtgttaatgagtaggacaaaatccaggaaagcagagtaacaccaggttttaggggacacactaaaggcaattcttgaaggacatgttgaagatggcataaatcagtgattctcaaccatagttgtacattacaatcatctggcaagctttaaaaaatactgggtcctaccccgggtcaactgaatctgggggtgagggtgtgttgaactaaaattactggggttattaaataagaactctaaatctaaatttcttagagcctacatgtaaaataactgagctgaattttggaggtaaaattaacataacacagagtgctaaggcacataaccagagtggcaatactaggacagaatgcaaatgtcctgattaatgggccaaacctttccagtccacacactgctgttgtggctggtaaaggtaatgcatacatcggggatgattatttttaaaatttagaaaaggactttcccatccattgtctcatttgaccttctgagcaaaactgtgacacatgcaggataagaattagtcccatttcctagatgataggaaacaggcttggagaggttaagtgagtcgcccatgtgaaaaagccagaattcacaatcaggtcttctaactcccatccaacagagttggagagtatcaggcttttaccttaccctgtcacttaattcctacacttctggaacaaacgtactcttcttcaagcaaaaactaatgtagaagtaggagctttgaagtatttcacagaaaaatgaggtttgagttagaaatgaaagggataaaatgaaaatcagaagttcttggaaaagaagatgtaaagggagtacttcatagaatccacatactttaagtcagcgagtctatctatgtttcagtggctttctaaagccactatatagttaatgcctgatagcaatcaaccaaccatgtcaaggcctctgctgtgatagaaagcataggtagcagtgagatgctaggagagaaaaacatcacaaaagctccagaaaatcatttatggaagaccagctagcaaaataattaagaagtgagcctaaagagaataacaatggacaggctattttgacagtttggccttttactgtttgatgttcaaatgtaatgtaattggggcatatgataggatgaaatcatatattagtgttaaataattaacaagagaccactttgggtatttgtactaacagtgctaatagaacaagttatactctctccagcctttcatctgagatcaaagtttaataaaagctctaaacaaactttataaaatcttgtgtaagtggtattacagctgttatgcagatgcataaaaaaaggtcaactgaggtgtttaatatcactgacaaagctcaagatagaactagtaatgcaatctaggggcaggccaactcttcaacattcaaaaggaggaaaactagatcaaagttgttgtatgaaactccatttaccagtgagcttagggcatattataacaatcttaaatatggtcccaaaatgtccataccctatttcttcttaccctgctcaaggtaaatatgagatttgattgcaaattttcttcctcttcactttgtatcatttactaaatacttgcaaagcgttctttacgcatatcttcattactctcaccagtcacaagtgaaggatgtggaatagaaagaatgctgtgttgctaatcaggacatctgaattttagccctagttttgtcacatttagaaattcataaactcctctggcctctagacttctcttgaatagggtgaggggtattgacaaggatttctagcatcaagttctaacattatctaaaatgtgagaaccatggcagcaggaaccttgtctgctgtatgctttatgacagtgttgagacatagtagggacataataaatatctcatacataatataatatgattaaactagggtaagttgtttgatagtaactactggcaacatagaaattttgtgaacaccccagatttttaattcctcctatattagacaaaagcctacaagggagaggaattttttttttttttttttgagacggagcttcgctctttttgcccaagctggagtgcaatggcacgatctcagctcactgcaacctccgcctctcgggttcaagcaattctcctgcctcagcctcccaagtagctggaattacaggcaagcgccaccacgcccagctaattttttgtatttttagtagaaacggggtttcaccatgttagccaggctagtctcgaactcctgacctcaggtgatccaccctcctcggcctcccaaagtgctgggattacaggtgtgagccactgcgcccagctgggagaggaacttttaaagatgatctagtccagcccaatcatgaaaaaaaaataataataattgaaattcagagaggttaaataatttggccagggtcatgtgcctggctatggtggagacatgaccagaatctagattttctgactattaatcagatactattttttctcatatcactttccatcatttaaaactattcatataataattttcagctaaagattgaaggtaatttgttaaaactagatgcacaaaatgaaaattctccatattagtttttcattaaagactttaaaatgtgtataaaatatactattccccccactatatattgtgagtgtaatacgaatatcttattttatggttaagttaggatcttaaaaagatatcaaatatactatcattactctgagctttcacccagataggctctcttaaagagagcagaaagcatttcttacatgtgttgtattttacagaaagatactgccattgtgctttacaatatacattcatattatcttcacaatataaagcaagagcttttacccagagaatgtgctgttcttaatattgtttagaacaggcctataaaacacattatcaaccaaggaagttagaaaggcagtatgactacttatcggcatcaaatacgacactgtcagtctgacctccaaacactgagcaattcaataatactaagttcatctgctggtgaagctgcattcattatgcaatttcccagtgatacctttcctatgttatcatgtttatgaaaaatttgacagggctgtagaaaacaatttttataggctgaaagaaacctcacattttttaaattggtcatcaccttttgccacaaggttgtacctctgcataaacagcccacttttttagcagtattttctacatttgaccataaacagtcatgtttcagaagcttaaccctttgaagatatccccattgttggaaaacgtacatagcttaatactaacatagaatacaggctgtgtattttgggacaaggtggagaaaggagaatgtctagattgtttcacccaagatccctcatgagagattcatgaggatatttccgtttgccctcgatgcgaatatacagaaggtagactaacattagagcagtgggaaacttggcagaacgggctaggacagggtttgtgcaaaacctttttccggtttcagtttgaatgggttcccaggaagtgtcaagtctgaacaaatccaaaattttacaatgtagctcagccaaaactgctgggattcacctgattctgggtcaaaactgtaacagagcacactgcgttttatttggtgtaaagccaattggactgaacctttcaggcaacttcaatgagaggctcatagccttggcaaaaccaaaaatgaacctagcttgatctttggttttaaaacagcaagttctggctttgtaaagagataaaggcaagttttccttagcgtcaagattcttacaaatacttaggagaagcattgcaaataattaacagttatttggccagatttacattatcaagtcagttgtttcctgagttgtacagcggcactttagtaagtactctaactcatttgggtctatatattcttaagtgccctagagcacaatttagtgtcctaacaaagagtgatggctcttcttcaacttcggtgcctgtagagtgatttgcacatgcagtaggatgaagcacaattagtgttagatccagggtaaaaaggaaaaataattacaaataaaaaccccaacagcaattgtctactccaacacagacaggtgaagtaagtgtctatgacattacttagtctgtaatttccatagagacacatgggcatcttctcacaatcttggacaccaaatcttgaagttcaactagtgtgtatagttcaatgactctttcagagatatgcttcagacttcacagtgtttttaaaagaaaaatcatatttctaagagttttccagtgttttgtaatatttctcaatataggcatttgagtatatatttttctctatacagctttaggttaggatttaccccattttaagttgtgttagctctgtaagtatgttttgaaaataagggagataagattttttaagtatttgggaagctgattaaatgccgactaattgcaactactaattacacatttgctctaagtcaatggttttcaaaattaagttttaaagctatgtatctctctcacacagattttaagttatctaaatgtttttaatcataagcttaagtagttgcaaaggatgacattttctcacaatattgtaaagaatgacattttcaaataaaactcattcatataaataatataaacttatccagtaaactttaaataactcagtaatttgttgccaccatttatccacttataaaataaatatgaccctcgttaaaagacagattttttcttgttccttttttccctttagtttatcctaatataaaatatatttatgttcataagtgtttttatcattttgccatacttcatccttctctgtaataatgtatatatatgaatatcgagaaaaattggtttttaaaattccctgtgatcataaagctctgtgttatacatttttatagactggattagcattacaattaatattaggtatattataaattttgagaaagattattaaatgtgaaatgtaaaaaaaaaaaaaaaaaatccaaagcttccaaaaagtatatctcttaatggaatgaatatagtttcctcttctcccacactgaattagttcacataatcatagctaaatgctaatttttgtttgaataagacagggtttcatttcatttctattcccattatttctatagatttaatcacaaatcttgttcacataaaaagtacatgagaatgaaagttttgttataacaatgttactcaattcttgaatgttttcctactcttatggtaaatattacatagtgatctgtcatcaaaattaattttaataatctatcagccctacaaagttctcttttgactttgttgaaagcaaagaatgagaaaccacctgacttaccaaaggactataatgtagttatttagaccatttagttcctatttctggaaggcatgccaaaaaggctttatttgtcaagatttatcacgtaactgtttttcttttgtttaactcaacatatacagaaagggctgagacaaataaaaatcttgctaactttaacactattcgattactgtaatatttttgatatatttatcttagcattaaatatgtttccatataaaccccagacctacagattggcaaagccagtccttactgtcaaaccaatcagacaaatcacacttgctttatggtataaaaagagtctgacttcctttctcaattcagtggaatggtgttaatgtgtgtccctgtgaaaactgtctcacttttgaatcataattctaaaacagatacataggtaaggcatggagctctgctagagtttgtcacctggatgaaataaaatactgctgcctttaatgatttcttatcaacactctcttagctttgatttctggagctatacactctttgattatagtagagtagtggaagaggtgaggttattaaataaaaatgtcttcacctccctccccaatcaacagtatacatctaattcagaacacttcaaccccagtatcccatatatcaaacacagctctttgttcttaacaaaaatatatgtgcaactaagaaggacaagaagccttaccccagggcctttactaaagaaggccagcaggcacaaaaatcttaaattactcctttgcttggcaccttaaagtgcctgggaaaatttgcctcatggaactcgggatgggtgagaagtagtcctgtttttgttgttgttgttgttgtttgtttgttttttaaataaagtgggagagagtcaattatgaaaggtaagatgtcatttcaaagcagaatcattttaggagaaagtgtatctagaaactgaagctacaaaaaccaattctcagttagctgggcatggtggtgggcacctgtaatcccagctacttgggaggctgaggcaagagaattgcttgaatgcgggagatggaggttgcagtgagctgagatggcgctactgcacctccagcctgggtgacagagtgaaactccatctcaaaaaaaaaaaacacaaataaaaacaaaacaaaacaaaaatataaaccaattctcttaaaactatttgtgcctgactacctcttggaagatctttgtatactcccaggggcatgctaccctagttagaacatgctgtaatttaccagctctctttgaacattactgttggggtcaggattaatcattttgcagtaaaaagcttttaaaacgttctactaacatgtttcaattccctttagttttttaattttttttggtgaaatatgtcattgatacaaaattttaagtaaaatatatacatacagtttaaagaaaatgacaatctgtggttttaattagtgcctccctgattgctgatgaaaaatgtcttctcacatgtttctttttcaatagagatgcttgcttatgcactttgcccttcttttgtcccttttaaaagcttggatacctttttctaattgctttttaggcaataagatttggacacaaattggtagtcagttatatctgctacaaatatatcctatgtgtggcttttcttttcactctttttatgttgtatttttatttggtttacagaagttcttaattttaacatggtaacttgagtcacttcttttatatgatccattattccaatgccttgtttgccttttttttctcttcagaaatctccttcggttccagggttatgaaaatactcaacaatttttttgttctaaaaatcttacggtttaccattcacatttcggttttctttctttctttctttcttttttttaattatactttaaggtctgggatacatgtgcagaatgtgcagatttgttacataggtacacatgtgctgtggtggtttgctgcacccaccaatctgtcatttaggttttaagccccacatgcattagatatttgtcctaatgctctccctcccttacccccaaccgacatgccctagtgtgtgatgttcgctccctgtgtccatgtgttctcatgttcaactcccacttatgagtgagaacaatacatttttgcatctgatatgagacagaggttcagtttaatatttttaataccatctatggaaaagttcatccttactccactggtatgtgatgccatttgtgtcaaacatcaagttttcatatgtacgtatttccgtttctgggttctctatttgattacactgaccgacttatatattcctttgccaagacaacaccattttaatttccatagctttaatacattttgatacatgtttaagaaaactccccttaccttgttcttcttcagaagtttcttggctagagtgtcttctctataaagcacttgtaattctttttaaagttttttctcttatgtactttgaattttttgttacttttgcatgggtatagttttaattacattttctcagtaattgttgcttggaggtagaagtaaaatatcctgttttttatcaaagaaattgctaaactctgtattttttcataatttaactatgaattccttgggcattttatataaacaagaacagtatttgcaaatatcaattttactgcactggctaggcccttctgcacagtgtctaacagaagttgtggaatagcacatcctttgttcctggtcatagaggaggacgtcagcatttcagtgctaaggtgatttacccatagaatttttccatatgacctttatcagattaagaaagtttccctctattcttagtttaatagaaggtttatgatgatgatggtggtggtggtggaatcaatgcttcttattcatttatggggatggccttttcaaattttatttctctctaatctgtcactatgctataaattacattgattaattttctaatgttaaaccaacttgtttaacttaactgaactgctggaacaaactcaacttgttcatgatgaattattctttttaaacattcctaaatttactttgctaatcttttgtatatatttttgcattcatgttaatgactaagggtctaaattcccttacttactcttatgcttggttttagcataaacgctatgctgactcaggatataaaatgggcatgttccctctttatctagtctctggaagagttttataaaactgaaattatctgcccctagaacattcggtagaacttatgtataaaattatttgggcttggtagcccttttctgattaaatttcaattgactaaaaatagttgattaaaattatttatttaaaatttagtcatgctatttcttcttagtttttgaaaattatatttttctaggaatttgtttatttcttctaatttataattagaaaattattcagaacactttgttatgtggttaaattctccaagacctgtagctatatcctttttttcaatcataatggacaatggtcttttttattatgattcgttggtcaaataacagactttactttgttagccctattgcatgtttttttctatttcattaattttcagtctttatttttcccttcttttgttttctttaggttttactcttttaatttccttttaatatcttatgttgggtgataagctcattaatttttatcccttgattttgctctttccgaaagagccaccagaaaaaaatccttcccaacagaatgtttcagtaactagtactgaccagtatgaactaacatttgggaaggacctatttagatcctgatataaaagatccctgatgtaaaacatataaaaccctgatataaaaaaatcaagtctaaactgcttggtttgtatttcagaacgtcagaatgactcctcttactctctcaaactgttatctatctctctatacattatctcctatgaaccgacaggggaaaaaaatgtgaaaaggctttgaaatggaacaaaaacttactaggtatcttcaatgaaggcctagtttttgcctagcacatctgtctgggcttcctgattctgtgggatctctgtgctcttattgtctttcagtttttataactttatgagttgcagacaactgataacaaaaatgcaaataatttttgttcacagacaataaattttgtctggtagggttccactgatcttccttcctcattgtagaagaagccaattttgcctttatttaaaatacatttcagcactctgtagtgcctatatatgtgtggttctttaaacactcctttaagtcatttgtaacttcttgttcattccctcattaattaatgagttaaataaacacatttgtcacaagttaattttatatgtgtacgggagtcatgattttaccttaaaaaatccttttaacaaacccttttgttcattactgccttagacttcgataacatctccaatatgaaagggcttctggggctctttctatctcactactgattcttcatatttcagaaataaatttaagctcctcttcatgtcctcaaactgcaaaatctatcattttcacaatgaacccagatcacaatgatgcaatgatgcctcaattctctttacaatgatcttttcttcaaaatagcttctgaaaatgcattatctttttcattcatggactgtatttttttggtttttatctttcatcatttaattcatttaaatgaatgtgtcttctttactcaaatagagtacaaattccttgaaggcattgatcacaatttactttccttttttcttccttggtgtcaacacaatgcctcatattgagcccaataaatttccactgctgagtcccatccttggcccatgagcaggggctctcaatcaaagttttttcccatgtaatcacttagctttatttagggaatcaacccattctattttggctgaaggtggttccatcccaggaaaatttacattaacatttagtgaagatggttagagcttctgtgaaacaccaaatagcatatagcactgaccaggaattctaggaaataaagaatacattgccgtgcttctggggaatttctcacaactactggactaatgctatttattcctgagcacagtcttatgtgaggttgagatacatgcagtttaacagtcattctttcattctacaaatgtttattgattgtctactatatatcaaacatttctgacagaccctggcaacgcatttgcaaataaaatgcagtttctaatccaaggagcttacctgctattaaagaaagagagggaaaagttgaggaagacggggaaaaatgggcatgtgactgtgacctaagcagatagataattggtggcaagctaaaccaagtttcttattatgatgaaaaggtgatcttcttttcaggtattataactactgcactgctaaaatcaatctactgtaaatactcctaatggaatggtgaaatttcaaacatttgcatattgatagcaccatgatatatgctctacatgcaacaccttctgtactgttaataacaactcaaccaaatatggaccaacaacatttttctaagttttaagcactgacttgggagagaataataaatgatcttgagatagctttcagcatatttgattttatgaactataaagtactttatcagttgaagagtctaccaagttcattaaaatctgtcccttaaaatgtcatatgaaatcaaaggacttcataatatttgatcgttagcactattactgagcattttaatttttatggttttatttataatcatttcaaattgaaactatcaaaaaactactgctgtttaaaatctagtcctttaatcaattttatttttcccatggtgactttttatttttacctttattcttacgggaacctttaggttaggacatttgtgattctattcctctgtacttcgttagtgaagagattagataaaaacaattaacaaatacaaataatcattgttgctgatataattttcagttttgcatagtatataggtagaattcaaatgattaaataagaagtaacaagcaatcgtggtaacgataacatttgtttggtcctaaatattttcacgtgtattttctctcttaattcttagagaaaaatgataaaataattttaatcacaaccattttacagatgaaggaaacaagaaagaagtcatttgctaaatgttgcataagcggcattttgtacaccaaatccaggtcttcaaactcaaaaattacgtttttgtccagattttttaaaaaagcatttaattcacaggccaaattctgttggcaagacactttctaagggtaagtaaaatatatgtggaagaacactaaacattttattcaccaacaatgtcatcatactgaaactgagaatagtgtactttctaaatggcccagtgaaatctcaggaagaagttatttatccatagggtctggacatcgtcaatcaaaatcacttgcttgcatattactaaaatgtggtctgtaaccatctttcctctcttcatactcacaaataaacatttcattttttattaaccttattatctaaagatttttttcctgcttgttaaaaatataaaaagaaaaaaaaatcactacgactaagatacttctaatattttatgtattttcttagcctttttaaatgtaaaatatgcacatttaatatttttatcactctttatatatctttatatatcactttttcatatattagcacggcaatatttacttttttgaaaacctgactgtttatggttgcatagtatttcatcaaatacttgaaaaacagaaagaaataaaattaaaatctataattcttatgtaactgatcactgttgtgagttttgcttactctcttctgttctttttttatatgcctatatgtcatcattaaagtacacaccattttatatcttgaaatttttccatttaatattataagcctttgtataaccactgtggcatgttgggtgaaaattccatactctataaaaccataattttattgacagtaagttggttttcctttactttttttttttgagacagagtcttgcactgttgcactggagtgcagtggcatgatctcggctcacggcaacctctgcctcccaggttcaagcaattctcctgcttcagcctcccgagtagctgagattacaggctctcaccaccacacccggctaatttttttaatttttagtaaagacggggttttaccatgttagccaggatggtctcgatctcctgaccttgtgatccacccgcctcggcctcccaaagtgctgggattacgggcgtgagccaccgcgcctggccaatttttgtatttttagtagagacggggttttaccacgttggccaggctggtctcgaactcctgacctcaaatgatccacctgcctcggcctcccagagtgctgggattatgggcgtgagctactgcgcctggccaaaaataatttttcaatgaatattgtatgcatgtagtcttgacatctatgaacttgaaaaattatttcttaatagcacattcctacaagtaagattattcagaaaaagctggcatgcttgcattattctttttgtgacactggtgaaaataatgtttataaaaacaatgaatgttaaaatcttagacttgaaagaataaatagcaaactgatctcagtttcttatcaaccaatcctcttagtgattgtgaaatacagtagaaacaccaagtattgactatatttaatatatttttcataaattagtacatcttgacatcagaaatactgagagatgtgaccacttaagtatgctcacatttttatttaattttttttcattttaaagtctatatccacataccttttagatacagtttagcttgttttcccctttgacatcttagatgtagttttcgaaatgatttctgaaactgtttcctttggtgtgctgtgaaatccacatcaggagacagcagtaattctgataaaaggagaaagaaaatgccccaacttaccgtttctaatgcaattacacggtcctgcaaagaaagcataatatataattataaaacgaaggctgtttaaaattgtttcaagtttacttaatttacaagtattctatttaccatctattattaataattcattttaaaaatgtaaaaaatgagaactattcagaatgatctctagaacagaaaaatagtcatcaaagaatgaatgtatcttttttcatctcatttagtgctaggactacagagtttaagagtaaatgctacaattctagtacagttaatgaaaggaatagaacctaccatttttgtaatggtaagattatttataagatgtaaaatgttagatttgattatatgaatcacaactagacaagagtagtgatatagacaaggaattaagcacatattctagctcttaattaggtttacagcgaaaaatgtggtctccacaacaagctgaaattcagacatatcttcatcaattaaaataaatgagtaaatcattattgaaaacaaggcaggaaaataaatgagaaagatatggcacatgcagccaatcctgagcccagataggccttcattgtctacagcatcttagaatgtttatagaaggactggctttaaaaggggtcattgataacgatgcatcaaaagctaaatgattaagaaaatgtttgtattctcaactccatagttgtattctcaagtctttccagaggtgacatctataaacaggaagtcttcaccaaataaagactgactctgagacaaagcagagtgtgaagatctaagaaaatgaaaaaccatcctttttgaggtggaccaaggccatttgcctttgttttctcttattttaagaactggaggaggtcaggtgcaatgcctcacacctgtaatcccagcactttgggaggctcaggtggacagatcacatgaggccaggagttcgagaccagcctggccaacctggcaaaacactgtctctactaaaaattaaaaagtagccaggtgcggtgccgcgtgcctgtaatcccacctactcaggaggctgagacaggagaatcacttgaacccaggaatcagaggttgcagtgaactgagatcaagccactgcactccagcctgggcaacagagcaagactacacctcaaaaaaataaaaataaaataaaagaactagaggaaatatgtggaatctggatttttaaaaataaaattaattaatcgtctaaagaagtgtaaaggtaaacactgagtgtcaacttgactgtatacacggatgcagggtgttgatcctgggtgtgtctgtggggtgttaccaaaggagattagcattttagtcagtgggctgaggaaggcagacccaccgttaatctggtgggcacaatctaatcagctgccagtgaatataaagcaggcagagaaatgtgaaaggggagactggcctagcctcccagcctacatctttctcccgtgctggatgcttcctgccgttgaacactgtacgccacgttcttcagttttggggcttggactggctctccttgctcctcagcttgcagacagcctattgtgggaccttgtgatcgtgcaagttaatactgaataactaccctttatatatatatatatctcctactaattctgtccctctaagagaaccctgactaatacaagaagtaaagagagaaaaatggcgcacagaatgactcagcccaggtctcctgtggtcctgcagggacccacatagacctatgacacttagaagcagaatgaacttggcccctactggcattctctcagtatcacatgaaatagagggctcacttataaagacttctgcaaactaacttccagcagtcagactgggaaacagttgcacatttccaccctgtaaacatttggctatgtgggcatgagttaaatgaatacattatgcaaaattagcccaaagcagactgtttctagcaatataatctgtttaattgcattttgttggcatagttaagagggcctcacccttaccctcataattttcataaaataactgctatgttgttggtgacttgtatattgtcacatttgagcacttcataataaatgcgtatgatgcctcaagggggctttgatctattgttgccaggcatctaattcattgtgcatctgggacaaaaaccattcagcaatactttaatatcctttgcagattgaacagaacgtcattagatgccttatacagagagaaacagcctttgggcagtatcatatttatatgaaccatcttggaagactgaaaatatttacagccctatttgggccttaagttttccctataccatgggtttgagggttgctattagttaagattaacgtattttaaaagcatacctagaactgacttgaaataggcgatttcatataatgtcaaaacagaacagaattaaactgtctgtcctaattcatatcttagtgtttagcagagataaactgatagcattataagttgtgtatgagtaccttcattttacttaattttttattttaaaggaaatatgtgcctagtttatgtgactattgactcaaatggtcaagacaactccattttgttgaaatacgaaggtctatatatatatatatatttgttttgttttgtttttgtttttgtttttttgggacagagtctcactctgtcgcccaggctggagtgcagtggcatgatctcaactcactgcaagctccgcctcccaagttcacgccattctcctgcctcagcctcccaagtagctggaactacaggtgcccgccaccacatccggctaatttttttatttttagtagagacggggtttcaccatgttagccaggatggtctcgatctcctgacctcgtgatccacccgtctcagcctcccaaagtgcaataaataaatatatttgaatccactttagttatgtttgtttgcctataacctactctattccaaaatggtactgagacagctttcaataaaaaaactgtatgtcaaaaaacatgaggaaattagagaaacagaaaatttagttcattaacctttcagtaattcaatatgccaatcaacaatagctaataagataccagccattgtagtcaattactgattttgtctaaattatagttttctgtctcaattgtaggctgtaaataaagagaaattactagtcttcatgaacttcttatttgattttaaaatttaagaaatgcattttgaaaacttaagtggttatggttgacactgtttttggtaaacaaagttagttatatatctttatataaaaaattatgctactgtgtatcattattctcaatggaaaataagccaacaacagtgtagcttttcttttcttttttttttttttttttttttggagacagggtctccctctatcattcaggctagagtgcactgtcacaatcagagcttactgcagcctataccttccatgctcaattgatcttcccacctcagcatcccaagtaaccgggagtataggtgtgcaccaccacacccagctaattttttttttactttttgtagagatgggatctcactatgttacccagggtggtcttgtactcctgggctcaagcaatcctcctgcctcggcctccccaaatgctgggattacaggcatgaaccaccacacgtgggccaatactgtcaaagctttgatatgcttcatgattaaaaaagaaaaagccagtatatgtcctagaatgaacatataattacaacaaaataaattatatctccataacctctcccagtttacccagagctgcctttgtaatttttccctttttctttaatctataattttcatttaaacagatttaagttcaacctgcaggttcattactccacccacccttccaaaccaccaatccctgaaccccactctcaacacactcgcagggcttaatcctgaaaagaaaagtaagcattgctagaacaatgaaagggcattaggaggtaggagaagtagacaagggaagaccactcccaggaagtaatgaagatacttccatgctatttcagatggttttaataaatcagtggctcttatttttgtggtaatagactttgagagtctaataaaacttgacattctccctaggaaaatgtacattatatgcaacacacatatgtaattttatatatactttttggggtaatgcagactctctgaagcctacccatgggcctccaaatcttttttttttttttttttttttttttgagatggaatctcactcttgtcgcccaggctggagtgcagtggcacaatctcggctcactgcaacctccacctcttggatttaagtgattctcctgtctcaggctcccgagtagctgggactacaaggcgcgtgccaccacacccagctaatttttttgtatttttagtagagacagggtttcactgtgttagcaaagatggtcttgatctcctgacctcgtgatccgcctgcctcggcctcccaaagtgctgggattacaggcgtgagtcactgtgcccagcccaagtctttttactccaaataaaaacacctaaaataagacataagaatatcataaaaataaattattgtattacactaaatgtatttatttcctctttatgaaacatgtctagatacataacctcagtaacaaagaaataaacaattatgactataactaagggctcttatagggcagaagtaaaaatgtaaaattctaagtgggagtgaagggttaaacaaaaaacaaaggaaaatttttcttcaaatacttggaagaaaagagttttctgggaaaaagcctgttttgttgctactgtttatatgtgattggatagtcccttttctattattctttagttctaagaaagggaaagtttatgaaacacctaaattgacataaatatttttaaaaatgtttactcttaatgactgtacatgtagtcactgcatagatattggattacaatggagcagtgctaatagctgttcttaccaataagtgaatattacactttctaagtaaaaataatgtggctagacatcatgttttaatttgttctgggtttgacagatcaggtaaggagaagccatatgatataggattccctcaatatacaaattattttgggggaagcctaaagcatgtatacaataaaaagatgtattttaacttttgaggttaatgaggttttgaaactgcctttgcaaaattataactgaggaaattatgacagtgacagaaattaaacctaattgactctatcttgcttttttctaaccctgaagctgtccttgttcactcctgggtgtaggctgaactaactttgggaaggaattcagttcatggtttgactctgaaacaaaattgataaccgccctttcccaaaaagacctgcttcttgcctggggtccagtctgcctttgcaggactaacaaattagctacaagattagaaatttagggcaggcgcagtggctcacgcctgtaattccagcactttgggaggctgaggtgggtggatcacctgagatcaggagtctgagacgagcctggctaacatggcgaaaccctgtccctactaaaaatacacaaattagtcaggcgtggtggcaggcacctgtaatcccagctactagggaggctgaggcaggagaatcccttgaacccaggaggtggaggttgcagtgagtcgagatcacaccattgcactccagcctgggcaaaaggagtgaaactccgtctcaaaaaaaaagaaaagagaaaggaaattacaatttagaggtcatgcagcctctggcttccagagtctgaacctccccaaattgctcctggtgataacatcattattgcaaaacctaagatcagtgcttgagatagtttgcagaccctgcactggatggatcagctgacactacccacaccagtaatctggcccaaccagttctgccatcccacccaaaaacagaagacgttaagataacctaactttaaccccctatgattccatctccaacctgaccaatccgcactccccacttcccaagattttaaaggtaatttggcaagcgcctgcttgccaaattatctttaaaaactctggtccccgaatgcttggggagactgatttgagtaataaaactccagtctcctgcagagccagctctgcgtgaattactctttcaccatcacaattcccctgtcttgataaataggctctatctaagcagctggcaaggtgaacccattgggtggatacagtttgtaactagccttaagctgtacatattcatttgctaccacaatgaagtgtactttagaatttaggaatggaccaaggcaaattcattagtatcactggagatgagcaaatatttgtaggctgttaggaaatgagcattaaatggatcatttgttatcagaatatctaatcattaaaagtttatttgattcagctgagctaatcagccacatcgattcatccatcacatctcagagatgaattagaaacttataggtctaaataataataattcttctgcctctggtgagtacagttgaaaagtctagtgactttattttatcataataatgcagcattttccaagaatgctttaaagatatcattagcatatgaaaaagcataacactggcataaaaacgtaagaagagtcttctatcttttccacatcttagaagcttgaagagtatagaataattctggcaacttctctgggacttagggaccatgatggacatatacttttcaaaaagaaaaacccacattgaggactccctaccatcactattgtaaaatacaaagcctgtcttctggaagaaaaatccactcaacttcacccaaagagaccactgcatggcgttcttccttccaaagtcaactctgtttaatccacactcacagtttacctgctacttcctaaataaaccctatagaatgaaatacaaatatatatattttttctcctcagcatttccccatgacaatccattacgttttaaaaatttgtcagtcattttaaataattaaaagagctagaagtcattttatttgaaattatttgaatacatttaaaatagtattctttgccaaactttaagataatgaaaagggaaaggctttgattaatcatcacacacaaaaggtcagcatttcttacagtgatttaaaaaaaattcaaacaaaatcaagacaaaaatcactatctcagtgtagcaacatcaaaaaaagctttaaaatgtagcataagttggctttgaatataccaaatgcatctgtgatttatatataaaattgtatgctatctattaaaagtcagtgaaagaagtttgtctatacatcaaatactccaggatgggtggcattggagcagcttgcactggtttcccaatcatcctgtgttcactgtaaccatcattagatacctgtagtcaatttctgttcattcatttcactggctgcttatgtgccttttcaaacaacctacttcagcgtctaaaataacacaacacacatattgaagaaaaaaaaaacagcgaggcttaaagattttgtctgaaaagttgtcaaggaaaaaaaaaaaaaccaacattttgacttaggaagaaaagccaatttaaagtgatatgtcatgttctagcctacagggaagcccaataatggtccttgttgcctgattttcaacctgggtgtggcaaatctctgatagaaccagaagcagaaacaatcacaggatttaaaaacagactcaaggtggttgatccacatttccaatatgttctgtcatttactactattgccttgacagagacctgagggcagccagttgttcttctgtagctttcttctgctgtgttctctggtgggtgttttagtttgtggttttattatgaggagattattgaccattatacttcagttttgacattgttcaggaaaggctgcggttgtatttatattgaagtggggtatgtgtacgggtttgtggggtgaagaatacaagtggggaaaacaaagaagatgaagagaaagatacagaaatgggggtctattggtttgttgggacagatttcagactggaaaatgcagcctgagcggcaaggtagggttttatttaaaatccctatacatacttctaggtagctatatgaaactgacaccaaaaattctgagactaccctttaaatttcaaatcacgaagcaaagctatgagctttcttttccttattttcctttaaaataatcatttcaagattcttcctttaaagcacaacgtaatgtggtacataggtgtgtgctacagaatatcactacagacaaaatgaagggcaagagacagaattatctttctccagggactgtcaaattctccagtgaaactgctcgtaacaggtaacaaaggtgagtgacatctggactggagaacaactaaagattatttgcagataaaataaagactatgatggtggctaggggcaatgcaaaggacaaccagtgcaatttcagatgctgactgtccccacaaagagatggagaaagaggaattgaggagtaccaggagaaggccaacaactcagaaaccagcacaccatatatttttcaaggatttacatttaaaaaaaaaaaagtacacgacaccagtcgtgaggttagtcatgtatcaatggcatatgccctgaactcctatgcaaatcatattgcaagaatgattatggcataatttatgagcaggcttgtgtcatgcagaacttgtggaaaataagagggtatgctttcattttcaggtacacaaagggttgtgtatctgactgccactgaatatagttggtctaatgagactccctgaggctgacatctcctttgtttccccgaagggcacatatctcctaggcttctaggtgaaaaagtttacagagaaacccatataaccacagaatccttcctcccacgccgtgttctcctgagtctttaaattacagcactggattgttaactatcatgcatgtcacacagctgagtcattaaatgctacaagtaaatagtccacctttggaattaatgacttacctttgggcaattccagtaatccacatcataatttacatgcagagtcatttacaggaactaatgcacaaggaacattgtaatggagactctttcttgcccgtcactctcatattctttctgtgtgcttctgtgttcagttacccctcagcattctacactagaggggctgctgatgaggatgatcaacatcgaagcagaaagtcttaaactaatacaatggctgagatggggtagctttttcttgcttcttaattcagtttgactgagattaaaactattattaatctccatttcccaacacacacgcgcaggtaagaagggaaatgtagctaaacaatttaaagtaaccagattatctgccctctgattatcattggtacactcttctttctaagaacaacgaggggaaaaaaaaaccaacaactaagtttttagctgcacttctgggaagcatacatgaaggctgacttatcctatatgcactaaaataaagcagatgtatattaactgttcagtcccaaatatcctaaatattcctacctatgaaatacttaactgctttttcttcaaactgagcttcactctgatttctcactgcagtctgactagcatcttcccaaggtggaagtttaaacagtagcttcggctgtttgagagagatgtgagttatgaaaaagagttggaaagctctattatcttaaagtaattgaaaatgttataaatagtaatagctataaaaacagcactaatttgactataataatttcaaacaaatttctaaatttctgcatttagagaaaatgatatgatgtagtacttttaaaatggtcccccaaataattccttacccaaattaaagtcacaaatttcagggacattattactttaaatctaaaacattttacttttcaggactataaataaagagtagtgatttagctcaaagcatcctcaactgtattgctttcaaaatcatccctggaagtaagtgatcttaaattccaaagtctatgaaatgaaggaataaattggatgagagtttgttaatagcctcacctgggcagttttcgccggtaatgacagctactcacaaccttacctgtggataatggaatgctgatacagtgtggttgtaggagttcagaaaagtctgattactcaaaattatactttctttccatttaccaaattatttcaaattctaccaacagaaatttattctttgaggaaaaattcaaaaaaatattcttattagactctccctatgccagttaacagttaaactagttcattctaaagcaggggtaagcaaagtccaggcaggcacctgtttttataggcccatgaactgaaagtggtctttacatgtttatttggttgaaaccaatcaaagcaaggataatattgcataacataaaaatactctagacaggttggtcagcttacatccctatgaagaggtaacatttgagctgaaacctaaaagaaggaaatgagccagccactgaaagagctaaaggaaaagtattaccgagagaggcagatgcagagatcctgggataggaatgggtttccttaattttaagaacaaaagggacactggtatgtgttatggctattaacgaaaacatccctttatattactagtaccataaaaatcaaaactatttattgtaagtttaattgccaaaactgcattgggtacttttaacatatgttctttttatttatttatttgagatgaagtcttgctctgttgcccaggctggaatgcagtggcacaatcttggctcactgcaacctccgcctcctgggttcaagtgattcccctgcctcagcctcctgagtagctgggactacagatgcgcatcaccacgcccggctaattttttgtgttttagtagagatgaggttttaccatgttggccaggatggtcttgagctcctgacctggggatccgcccacctcggcctcccaaagtgctgggattacaggcgtgagtcatcgtgcccggcccatatgttcttatttttaatgttcatgaaaacttccagtaggaggatatcattaatttcactcatttaaagccaggaacatagacttcaaagacattaagtgtgttgaagtccatgttgtgattaaatgtagggggtcggggaggctggtctgtaatccagctccatttgactcaaaacagtctatactaacctcaaaaacaaattaaaaattgtgagagtgtgtgtgtgtgtattttttctacttaacagcccagcaaaatggaactaatggaaatatcatatgcatacagtgaggttttatgagcaaatagacaataaattcttttttttattagcatcagggtgactttgtggttttccatggtagaggttaggggatgcactgggtaactgccctggagcctcttccttaaagtatgccaaaacagacttccagaacctcatttttaacaggcattaggtaacagtgtaataaaacatactatatcaataaaatttaatgcccaaataaaaaaattatttgtatacatttttatatttatttcactatataataaaggggctattatattgttgccatatgtcttttctaagtaagttgcaactccttacttatctgggtctgacatcaggacagctgaagcacatggcagtcaataccactgcggaaacagcacaagaaaggattgaggaaagcaaagacctaaacttaattagctgtaatattgtgcagctaaatgacacctatattgtgctggtcccttagattttttggatctggaccgcaggggttagattcatcactgagatcatatctggcctctgtgcttcaatccctgtttcagtcgtgaccaatgtattggttcttttctcacagtgaaataagaactagggatttctattacaaccagaatgtagtaaaggcatggaatctcttgtaggtactattttctattttactttatgggcaaatacagaaatattacttacagacattacatgttatttattaacatgctaataagccttcacacatttaaaagtaaacattaaacttctaacaaattaaatctagaatagtacatgtaatgcagagacactggaaaaggaatgcactttagaatcaatttttaaaaagtaaaataatcaactgattataataaaagtaaaaagtataagaggagatgcttattagtcatttttgcagctcattttagttttgtcactttttgcacaatttaaaatttatggaaacgttctaatgttgcctttaatttttttgccagaattattttgaacttggttgaaaactgaaattgacgaagaaggaaaaaaaatggaagaaattgaaagaaaaagaggccaggatcctaaacaaatcagaacaaaaaaaaagaaaggtgaggagattctgtttttcattgctcttaagtatagtagtatagaagccaagaaagttcaaaaacaagtactagttctctcaccggctgaggaagtatgagtctcagcgacattatccatacaattacaatagtagttacgtaccttggaggattgttgcgagtaataatttacatagatttagcagttttaccacagtgtatgacacaaagaattgcttggtttcatgtgtgactttttccctctcctttgacatacagaccatcaccctttgggctgatttagcacaatcctgacgggagttagcaagtgctaaataagtatttgttagtagactgaagcataaaataagtgagtttttaagatcccagactggggaaatcctctgcagtgtttctgtatattctggaaaatcagctagagattgggtggggagatggccttagaagtgagaactacagtttcttttaatcatgtattattagtacttaggatctcagagatttgtttcatgagtcaatgaaaatgtgtttcaaccagaaaggtattattgctgagcatttatttccaaatctgttgcacactatagtcattacccagaatattgcttttcacaattctcattgttatccagagatagacgataaaatggattaacatagatatttgcccaaagtttgaggtctgtctagggatgtgctgtgagaggtataagcaatgtactgtaaaatattaaggggaatgatcttgaagtgatcacttatgttctgtaacacaaatgagattgccccaaattacagggtgcccactgactcgagactggcaaaaactcccagataaacttaagactgaaacatcataatgtgttgagatttgaaaacaacaaaaaaaaacacaagaaaacatacactgctatctacataagccccaatgcccatggagctcagagctcagactcttgacagttgagccaaggtatgttttctggaagcgttgcttttcacaaagtcaactgtaaaggggatagtgtatgaagatgagtcaaatcatcttccccctggtgggaggaatttacctattctgtaaaacacacccaggtcactgttttttgttttttgttttttgatggagtcttgctctgttggccaggctagagtgcaatggcgcgatctcggctcaccgcaacctctgcctctcaggttcaagcgattctcctggctcagcctcccaagtagctgggattacaggtgtgggctaccacgcctgactaatttttttttttttttagtagagacggggtttcaccatgttggtcaggctggtctcaaactcctgacctcaggtgatccacccacctaggcctctcaaagtgctgggataataggcatgagccacctcgcccagccttttttactactaactttttaaataaactttctgtcacagagaaatatttgggcttttgagctcaaagactatgctttgattttccattttaacaatgtttccaaatgatgtgtgtgtttttagaagcttttttagaagcttgattcaagcagactgctgagtcttgaagtcttgcgcttttcatcccattggataaacagaaccaggcatgtttttatatttcttttattctcaaatgaaaatgacctagtcaatcaacttcgatatattcagacacaagaatacttctttcgtagggtattctattttcaagttttatactgtcataaatttgggattaatattaagttgcaaatttcaggtaaaacagagtgacaaggtttaatgagcactacaatttcagtggaatcctttttactgagagtgggtccctgctctcatgaggtctcttgatgtagtaaattgaagggtgtaaacctaattggctgagaacctgtttgaccccaaggcagactgctaatgcgttctttctggtgtaactttgtaccaaatttaaggttggtaagcctgttcacctttcgagaaaatagagattttaatgagctgttaagttacctctgcctgaaagtggcaaagggtcgcccaaccttccatccccacaacactgtattttgttttgtttatgccattgcttagaacaattatttttaaatcacatttcagaagaagacatagagatacgcagttatttgcctaagctttgaggaatgcaccttgagaagaatacgtgggtatgcattacattttggtttccagaataataaaaattctgttataactctcacgagtcatcttagggatgagtagggactgtattactttctagtttaatgaaaccttaaacagttaatcctaatttatcaatttattcaaattgagatttctaaaaatgtactttagtatctcccaagaaaatgggaatttctggggaaatgaattgcttcagttctttctgagatccagtgagagagcagagcattccctgtcaccctcatccttctaaagcaattccgagggaactctaaaatggactcgtggctgccccaccctgcatttctacctgcaatctctaaaagtactggttatgggcatgctacagttcggcagaaaagactgacagcaaaaccacagaaattatccacctggtcgatcaatagcccagtttctcacacggtttccttaccaggaggattagccatctactgggtattgagaggttcatgtactatcttgccagcttccaggagggtaatttatttgctaatgacagtcgcattctttggtggcttttcctgcccggtttatctccaacagttgtgcctgacaactctacactggcattctttatattataacaccctaatattaatatttattacacttgttccaaaagaaccaagaaggtatattctatttttttcctcgaaagactgtgttgccataggctactccataagtagctgaaataaataatggctggggaagagattattttccccttactgctcatttcaaatgtttttgcctaagcactattgaggtgacaaaaacaaaatctaacacctgtccctccacccctaaaacagtactaaaaagaaaatcgaacccttcaactgggagattccagactatttttcaaagccaactgatagacaacttaaaaatgattatgggtcatctgaaaaacagcatggcactaatgatatttaatatccttcaggcagagcttctggaatgtctcagaaaaatcagtcacttaaatatatatattcaagattgtacatatttttatatattttattatagatttatataatacaatattatatataaatctgtaattaaaatctattatatagtatatgaaatattcatatacatgtatatatacaaaatctgtaaacccactgttagaaattaacaagattgaaaaggattcagttcatttctaataaaatttctaataataccaaataatgtgttcaaaaatacttatgacaacatttagattacaggtcctacaactaaaatgcttcctttctcctcctaaaataatgagaatgatattcatatgtagcccaataatcaattaattattgccacatcatgacttttttttcgatttttcattatatttagcagctggccaaagacataatactactttcttcagcataatctgatgaaaatatgaatttaaatttcagagttgaccatggcaggggggaaggtaagagaaagggcaagggtagaaggtggcggaagagggaaggagaagcccgatgggggcagagacctctgacttgtttattgctttatccctaagcatgcagcatcatgtctgacacatagtaggtgtaaacagtcactgtgtggaattaatatttattgcaacctgtcaggcaccaaagttttcacatttcttatggtagctaatcctctcaagagtcctatgaaatcagtattattattatccttaatttacaatatctatatattgtgctgacgcaaagtaacctaccaatggcttagtatgaaaggaaaatgaatagtaaaaattatgttcataatcatctagttttaactcatttcaaataaaatgaagagagatgactggaagttatctcatgactcatttcaaataaaatgaaaagagagatgaccagtaagttatcatatgagtaagggcacatgagttttgcagatactctgttcagtgactgtcataggtaacactgtgaagctttcataactaagcatgatactaactctcggtgtgtgctgtattttaggattcagaaagcaacatggggaaaggtgaaccaggtagactggtatttaaaaaaataaaaacactaaacagcagcaacacctaccgctattagccatcacgagcaaggtgtcaagtcactgaatgcaattcaactaaattgaggaaaaatggattaccttgtgtgtctattttaaagtttcagctgatcttgagaggaatgaaaaagggatttgcttgtttcaatgtatctcaaactcatatgcaaataaaactctgatactgcactacacatttatagtcaaagacaatactttaagaggagtagcacacaatgcaactgcaaatgaatgtcacacacacacaaaaataaggcagacaatgttaagctccaatgaagaattttggtaattacaagctgtattgttaaaaatcactgtcaaatatgtttgtctccattgtttgtgattcctcttaagattgaaaacactctcctccctgaggctccaccccccctgccgttttatccttctccactgctactaccactcatgtgaaattactccggcgtgtgtgtgtgtgtgtgtgtgtgtgtgtgtctgtgtctgtgtctgtgtctatacaggaatggcagaatttggatgtctctccccaaaacatttaaacaaaaaatgaactctaggacaggacagggattggtgttgttttttaatgggtggatcttgaggagacccaggaataggggctatataaataagagaccagtagggtggcatttgtttgtttattcagtaaacaaaaaattattgagtacccactaagatgaggcactgtgctaagtagtggacatccggaaaagtgaaagacatgagagttgattgacaggtatgacaggaaattacagttcgttgaaaggtaaatttttgttttgaaacctaaaccccatagctaaatggattcaagaatttaacaaatatttattcagttctgttgatgatctttcccttgaaatattcttttgctaaacttcataacactatatgttcctgaaattatttcctttatgtcttagattcctttgcaagattttcatccttagcctgttgtttaaatgttggtgtttcctagggttctggcctaggatttcatttctcctcattctaaatacttcccctgggaattcacattcgctatatgacttttagtatcattcttatgatatggacaacagacatgatggcatcaaattctgcatgttcagatcaaacaccttctgagctccagactcaaatgaacctcccttaacattaccacctggacatttcaaaataccaaaaattgaactgatcaacttcctcctatatcactgaagagcacaactatctgtgaagttgccgaatcgagaaacacaagaatcattcttaactccttcctttttacttcctaacaaccaatctcaaagttccatggactttatattctaaaacatattaagaagtcacccactcctcttcatgctctctgctgccacccaatccaggtcaccatcatctcttgccgagagtctcacaaatgtctgcttaattggtctccctgatttcaatcttgcctgcctctaattatttttcacgttacagccaggtatctatttaaaatgcagatttaccatattgttctcttatttcaaacccttttccaatttctcatataccgaaggtaaagtccaaactcctccacgaggtcctttagatctctgtttacttaaaaaattcttgttttgctgcccctctctcagatgctacattccaacatactgaactttcagttccttaaacatgaaactgtgctcttttatcctaggccttcccctatcctttccactgctaactcctagttatcattccaacattggctttctttgggaagcctacttggattgccaccccactccagtttaacctacctcaatcgtacttaattccctgtcagttctgccaacctacccttacctatgacaaacaaggacagatgttcttatatgttcccacagtcacttatacttttcctttaatatgaattttgaggattttattataaacactgatttttatagtcttcactaattataatatagagggtaagaagacatctagtacacacagcttgcctttgtatccctagcacctagtacagtggtgtgcacagaattggtgcttgataagggtttgttcaatgagtaaatggagtacctcatttataggaaattggaaagggtttagagctaaataaaataccccctacccctaaggagaatgacataaaatgcagaatatctgttatacataattataagatgataatgagtaaataaaattgactccaatttggatacatgaggatgtgctaacattgtaaattggaattaaatatttagctctcccttctgggatcatctaatccacactaaacacttctggaagacagttttatgattttctattacagatgagaaaataggcacagcaaagttaattgagttatccaaggttacccagtgaaccagaaacacagccaggtactattgtgtcattgtaggatttcagcctatatacttgaatagtattcttcaaactatcacctctgataatcatatgtgaatatagaaactcaggaatataggcacttttccaaggattttcctctagcctttaacattaaaggctttctgtgatatgcttctggactcttgtgcattccgagagttccttctttattcataatagagtgttaatatcaggcactagttaccattacaaagtgtcaacatttaactcttctgctctgggacatcatattacacattctccaactataaatgtccatagctagttggttggtgcattctattgcactggatggacatttcagtagaaaatgctgccagtatttaataaacatttgagaggcaacacaggctattaaatttaatgagattactagttccaacatttgcactgtgaaagaaaaaactacttgtgctgccatttcaaaaggccagacatatactcaataagtatgtttatatatgttattctgggtaaacacaacacacaaccacaatgcctaaaaaagactttctcaatatacacatttagtgtacaaagagctatgctttttataacaacaagcattgctgatattagtttcacagagataggcaggtcaagtatacacttgagattcttcctagccccagactggactaaccaatgctctttttttttttttatacctgaatatagtacaagatgttaaaataatctaatctgtacaaaactgaagctaacatgtaccacttttactggatgtataaactatgcttcctttgcattttcagatcaattatacaattttctcttaatgggtataccatcaggtagaagaatccccaatcacagaacacttctcttgctctttggactttatgtggcctatctttcatttgccaaaagcaaacatctttacccgtaaagcactcaaaccagctcatgacatcactctccagtcttgccttgtagctccaggcccatgaagaactctaaatgtccaaagtatttactgttcttagtccccaacctgacattaagtgaattggttctatcatgggaatataactgattatgtttcccctaataaagacagacacttgagttacccatttgtaagttagcccaatgtgaaaagaagagagaacttctgtcagatgccaacttcacatccattgctcatatcacagaaatatcaactaaaattcgagtggaatctttctaacaccattttccagcccaacaaatgtgaataaacctgtactgaattgagaggctgtacaaggcaaccttaagctctatttatgtgttaattggttggtcattagtagatgacacccatggggtcagaatacttttgactttcacttgaaaatgtagattccatgaattcatcttcattcatcagtcctgttttgagggaaatgactatgaaaggatactgccttcatttcctaatgctgcagttcctattatgctataccaaggaataaaatttcctatcaaaagtagcatagaggctgatttggcttcctgctttagatcagtgctctcagagacttctaaaggaagcaaattccaactttatagttctgacattgtccttgtcaccctatttgctataccagtgtgaatgtgacaataataaaggataaaagagtaaaaaacaaatgttttcataccaagcatgcttgccctatttaagaatttacctgcagagatcccatttcttcatcttttctttgggtctcttccagtagatctgtaataagaaagtaaaatacccatcaaaatacaatgtaaaaacgagttgcctcttatcatcaaatgcaattcagccagtagcttgtataaactgttgcctgagaagagaatttaatgtttaagtgtgagaagccatgtaaaagaaacacgctctgatcccaactgaggacatggcagagcgcgggagcctgccaactctaagctagccaagaagccctgggacatctctcagctttacctgacataccaaaggatgacatcaaatcaattaaaaatctgtaatcataccaatattttaagaatttggtctcatgcttatataactcaatgcaacacaaaatttcctttagaaaaaaagaaaagcctttttcttttgaaagaaaaattaaaaacaaaccatttgcccttaaaacaagctcccaagccaagttccacccctacagtcaatttttataaccaaattaaaacaccctggaataataggtgttattaactggaagtggaacaccacctcatccataaagtcttattaattatcatttcacactgagagggtgggatgcattgaagctacatttgactaagagtttggcaccatcccagagaaattagtggttggaagggaaggtcgtcaactgaagagagctctgtcttaatgcatgtatacagccatggtgtctcagtgccctacattaatttatgaacttgctattaagaaaacatattttctgcctgcagctataccaccctgtgctatgatcttattatatctcacaaacctaaagaggactaggctgagtcagaacttggatgaaaactggcaaaaaacacctacagcagtgtatattaatatgagtatttgccttactctctcattgatatagcttaccaagagactatgttacataaaaggaaaatataagttacagaagtctaatatgtatcccagaaaggcaaactcaaatgttttaccaagtgctatattagatatagcaggaaacagtcatatagtagagtgacaaagtcatgctggtgtgttgtaactgggcaggcaatacaccaaaatttcaggagacctggcagatgacagaactgattgtgatgaccctttgaggccgcacagctaagagggttacagatgagtggtaagcaatctcctgaagacacaacatgctgggattaaggataagagattgtttctattctgtatgctatagaggaactgactttggctcccaaaacctcccttaatcaggtacgtcaaaaaagtaaaaagagcaggccagtgttttggggtgtatttttaaaggggttttgattggcatatcaggttctgtagctataagatacagaaaccaacttggtgtatggaagattgtttaagtgccctcaatcattcctcttcctgcatcctcactcatttgcattgtggcattgtagctacttccatcaagaggccatgcacatctgcttcacttcttgcatctgggctggcctcctgacttgatttggtgaatagaatatagctgaagtaactctgtttcagtccagactgaggctttaagaggcctcacacatttccactttttcacttggaaccctgtcactgacatctgaataggcccaggccaacctgctagatgacaacagacacatggtctaggactcttcccacttctgtcaccctgcaggttgccccagctgccagccagcaaatgcccagaagcagagttgcccagttgatctaaggatgactacagatgactgagatgggagcccaactaagaccagacaaactacccagctgagcccagtgtcaactccaattcacagaaccaggagctaaataaatggaattttggagtggtttggtacccgggacttgccaactgaaagcaatgagatgctatttgaataacatgtatttagaaattattagaaggatatagagataactaatagatgcactggaaaagaggatcccaaatctgaaggcaataacaactagagcaggtctggatgggacgagatataggtagcatgagctaataagcattttattctgggctcctctaaactttatgtcattccactcaagatgaaacttcataaagagaacagctactgagcctagcttagatctcttgcctactgcttggctaggggaaagtatggagtactttcattgttaatcccaaaaggattggactaagaatagaaagaatagtttccaaatgcaaaattagggttagagaaggaaggatggacatcagacaggccaaaacaacagatttctacaccatctggtttcagttaactgtgtccttaccccaattctcttcaatatttgtgagatataagatcactcctgtgttcctatgaggatgtggctacttagctccattacttctggatattaggaggttctcagagctgggcactttgtaatgaattagattgtttaatggtgcagtgtaactggagtgatacatagtggggttcatcaaccacaaaagaaaactaatcttgttcctccagagtcaacttagtatggcaagtccaaactccttagataaaacttactggatcaataatgagtgtcagatcttttatgcagccaaacacaactcactcatctgataaaatatagaaggaaagaagtccagtctactcacagaacttcataaaattataggaactttaaaattatgttctcagttttctccaaatacatacgggtcatactactcttccaacaaatctgatgccaatgacaatgcttgacttgggatggctgaataaaaacaaccgaagaattcctagaattttaaattttaaataaatattctccctgactgaccatcttgtataaagggtataagcagacacctgttttggtttttattttttttttctttgtgccacatatcttccctttgagaactcctgttcctcttttccacatgatttccatgaaacttttggtcaagaggcctaactaacctttcctgctgcagaagcaggtcatggcccaggctagcaagtcagagcatcttatccccctgagcatatgagctaagcaacaccagaggtgtccttttagaggattaatgtgaatgccaggaaataaattttctccttctgaagccacaccttatattagcctggtgtttcgaagtctgtattttctactatgttgaagaaacttattaagcaatgaggctggcaaagaagaaatgagagccaagaaagagagaattgcttgaggactacatccacccttgactgaagcccacaaacctcctggacttccaatacataattcttcctctattctttttcttaaattagcttttgttggattactgccatttttaaaagtctccagggatgtagttgtattgaaccttcttatctctattcagaaacctagaagaactttctagtccaccttaaaatgtttcatcctacaacaaatatatgaagacatgagactcaaagaaatgcaaatggtttggctgagatcacctagttagtacaaagccacttctacagctttgctctcctatcatcctgctctgtctaatcatgctctcatttgtacctctcaatacttaattgcacccttcttcatactgatttaaaaataaaatacacacttgtctgtattcttctgacctgctttaaaagttccctgaatcagggcgtccgtgacattttttttttttttttttttttgtttgacagcgtctcatccgatgcccagactggagtgcagtggcgccatctcggctcactgaaacctccacctcctgggttcaagcgattctcctgcctcagcctcctcagtagctggattacaggtgccagccagcacgcctggctactttttacattttcagtagagacggggttttaccatgttagatgggctggtcttgaactcctgacctcaagtgatccgcccgcctcggcctcccaaagtgctgagattacaggtgtgagccactgcctctggcccatccatattttacatccatgttctccttaactactgcctttctatctttgatatttaacttatatccccaaaattgctcactccacccacaccattgctgtatgccactgctcactcgttaggtgcattgttcaagcacatgcatttggaatgatgaacacggttattaacctgtgctgatgaaatatggctactgggcatcgctgagaagcaccactctatgcaaacagacaaaacacaagagaatataggtgagacccctagatagttaaagtgacttaatactgtgataacagcgtgattagtatctttcattataatgaacaatcttgttgtttgttcttatcagcatggaaagagctgaagggctgctctgctcttcttatcagcattgaaagagctgaaggtctgctctactcttcttatcagcatggaaagagctaaagggctgctctgctcccttgctcaccactgacatgttcgtgttttcttttattactctctggtttgctgttccatacaaatagcaactcaactaccatgtaaattgctgtggtgaaatttgcttccatcaacattagttaatgaaagatctttggtaaaaagggcagcagccctgtgtattttccttggattggttccaattttttaaatgagctgatactcactcattatgacataaagtcattagagggagaaaaagccatataaaaaagcagaacatcatggatgagaattggatgatccagctgtcctgttttgttttgtttctgctttacatttctctggaacacttagggttaatatatcacgaccaagtttttggctaagatagttttatatctcttcctctgcagtctttgcaaccagtgatctggctgtttaaggaggtttgacactttttaatgttgattttggtttctggtagccaagaagcagatagattgtttgtttatttttcaaaggtgagtcatgtccaggtgtgtatgagcaattacacccatctagtaacttgaaccttcctagggagactgaagatcaaattgagaaatgactatatttttctttaaccattcctataaaatgcctcatccatattacaactaagcccaactgataatggagagaaagttatagaaacagaggcttctgacacagcaacatttataacaacagcactggacagagtaacattggcagcagaatatgttgagttactgattgcagtttagagaaaagcatttagctctggctcttgtaacttactataattcagtgctcctgtccagtgttactctgtgtgtctcgacatttaccaaacacaatagataatgcaaattctcaaaataattcaatattttattaaaaagtaaatttatgatatttctatttgtgaacagattcatatatttaaatatattcatatatttgattcataatttcatataacaaaattcatcagataaagcagcacattacaacccttatgagcctataaatgatggacttagccttctattattccattccagatactcaagacattagctacatgccagagataacgggtcagtttctctttttcttccttagctacccagttattggaatcattgacattttagagacaagagaacacagaaataatctaatcctagggttgcttttttttttcctaaagaagtacaattctgtcttataagggaaatcatatatactttctaatgtaaattataaataggtaatttaaaaagctgagaaggagctgcttttaaggaaacagaagtggagggcctgggggccagcccaccaagctccttcctatccttgggcagacccctgtggtggcatggtgaagctgcaaagctccaaattatcctcactgaaagctactgatctaatctagtgtcctggggttacacagtggaggactgagttccgagatcaaatgcctctgtcaatgtcacatagctagttaatggtgtatcaatctgagcccagggcttttgaattggaccagggtccagtactttttttttctttacacaaaagtgactgccctgctttgactttcaagatttgtattgaaatgacacagtattccaatgcctatatattttctaatgcctctccaaacagaaacaaaagaaaacttcattaaagcacttgtgtaacatcgacaatctgtgggaagacccacagttaccaactgtccacgttaaaattcctcagttttgggagatgacgtccaaaaatatggctatgatggaaagcaaatacctagacacttgagaaggcagttgtttcagcaagatatattcaatatacagcacacagaagatttcacaaaatcaaacagcaacacaaaatctgtttcaatgaatgacagtttctcagcttaatataacatttaccagcaaacatttttcctattttattatactagtaaagaaaaattgaataaaggtataacaatatgactatattagctcaaatacctaaacaacaatcaaatgtgttgggctttcagttaatatatgtaaaacatttaaaatagtgcttggtatataagaagcattatatacgtattagctctcagtattttttttttaaatcacccttaaatatctctgctaaaatcaggaaaatgtgcaaaacaaacagttgtaatttaaaacaaacaaacaaaaaaggcctattagtaaactgcttttagacatcatccattataagtagctacattatttagaactctgccatatctactgccacccactggtacatatctggatataccgcaatgagttaagagttttctcatccggccttaccacagaaaacacacaggttaaaatgaagaacaacattcaaaaagtatggctatcccttgtggtttgtctcagacactgaaacaacatgctggtctacagatggagcccaattggtccaataaatgaaaggtttacagttcactgtctgtcttgggtatgtggtaaaacatccaaatacaggtactcatgtttttctttgatgttaattcatttctggtgaaactttccacttcgacaaccttagagatttaaaaccacttgccacaaaactgtcacagtacagaaaatagcataataatctaccccattccacctcatgcttgagtctggcactgagaaacatcctgatatagaatgaaagttctgactcagtcaactattaagttttctgtcatttctattggtaacatgagcagagaaagtaagaacatattcagtaggaaacacatcactgttctaaattggcctatgggctgtcttggccaaaatgagaaagagaagtttatgatccattgtaaacattatttcaagaataagtttcatatgctgaaatccaggcataaaatcatttttctccccacatgtactctgcattacactcacataatgggaagtttgctttcatttaaattaattgggctgggagaaagtttatcctatgctctgttcttgttctagactcataaggtcaactgggtatacattttggggctcagagaagtgctgggtatttgacttactctttgatcacctcttctttacagaagctacaaaagtttgtgctggtttcttgaggtacctactactgaaccagatctacgcttcttaggccttgtagattcctgggtctactctagatcaaaatgaaatttgaaatttttagtgaattttttttctagtttctgcaattcttacattctaagagtaaaacagacctcagaagtggaataatggtatgatatagatcagtgatgtgcacttagttacagagtacagctcaatgtcaaacaccaactgtttcctctggcaatccacacacagacagtacgtacccatgtatttatatctggtacatcacaatgtaaatatatcctgggcttaaatagagacattttatttcaacttattcctcataaatatcagtatttcctaccaaatttggcctagtatgttgatatattctctcagggaagtaaatgattagagatagttttaaggtatatatgatatacatacaaaacttttgacagtaaaggagatacaactgaaaattttgaaaaattttgaaatttaaatcttcagttttaaacttgattggtcaacaaatcttaaactactaaaagaagtccaagttcagacatatggtgtttaattgttgccccatcccctccccactttgaggccattttaaagacgaattattacagctcagctctattcaaagtgtttgcatcttacaaatcctttccttaaaaacttaatgttaagatttttacataaaaacattatgttttcattcagtgagcttttaaaaaaagcatgggactttcactaaattttagaaatatttttgctaaacctccaggtgggcaaatggcttcaatcctctttgtctcagtctcctcatccacaaagcttcaaaacacattgagtgttatctcacttcatgaagtagccatgaggaagaaaatgggataagaaagaaagtgggaattaaggtagttaatcagatatctttaatataaagattatccttaattacccatgtgggtccaatgtaatcagaagacactgtgaaaaagactcaagtggtccttactgattttgaatatagaggaagggaagcatgagccaagggatgaaggaaacctctagaagctggaaaaggcaagaaaacagactcttcaagagccttcagagaataaggcagcccagctgacatcttgattttagcacagtgagatccattttcattcctgacctccagaggtatgttattttaagccactaaatttgtggtaattctttatagcattaatagaaaactaacacaccttagaactttcattaagtaataaattcaactctaagaaaatttaagggttcataacatctaccctcaattctggtatctggtaatcaaaatgtactatacatggtatatggtatgccacattcaatgaaagccttgtgaagaaacctgtgattaggtaggaacagtgaagaggaggtctttcatggcaaaacttgaatgtaacatgtcataagctgtgactccaaaattgttagtttcctcagtgaaagagtcatgcacacctgcgtttagctcctcaaaaatttcttactgagttgcctaaaattatccccacttcgcacctatgctggagtgtaattatgtagaccaacctataaagtttagtcatccctataaaaggcatgtgctgatattaacattcaaggtacagtttggtatgtaataccccaagggtaagaactgtttaccactatatcctcagtgcctggcaaatactatttctctaagtatttttaaaataatgacaacatctataagaaactagttaataactctctgacatgcaatatgatgtcatttaccagaatgtagatgccaataaattagtttaatattataccttattaaatttttttctggactgaatttgaaaattcaggtaacaagcgttttacaattctccttcacacagtggaaaataatgccaactcaggaatccgcttcacatataaagagcaagtccagaaagatacccagtgagtaggcagtaatgagacacaagaatgatcacctgcagcatggcttagagtaaatctgtgttgtactgaaacaaggacatgaatcctcacagaactgggtattcatcttgaaatggcaagcatgtgtttacacacctgaaaatttccaaattttcataagagacgtaactcttggattgaagaacctatgtgaacccgaaagaagataaatataaggaaatccacatgaagatgcttcatagagttctaaaaaccaaaggaaaagaacaagtcttgaaagcagtaagacagaaacaatatcttacttacagggggaaacaattagaataataataaaatgctcattagaaaccacacaggccattaaaaaagtcacattttttaaaaatgctaaaaaacaaaactgacaacccagaatcctatatctagtgaaaatactgtttaggaataaagatgaaggcaagacattcctaggaagaaaaattaagataatttattgtcatcagacctatcctgaagaatgactaaaagaaattctctaaaaagaaaggacataagagaaagaatattagaagaggagaaaaaaaagaaagaacacaatcaaaaatacaggtacatacaatagatatcttttgaattttctagactatgtttgatggttgaagcaaaaattgtaacaatatcttatgtgctcctaaaagtatttagagggaacatttaagactaacagcggatctcttggcagaaaccctacaagccagaagaaagtgggggccaatattcaacattcttaaagaaaagaattttcaacccagaatttcatatccagccaaactaagcttcataactgaaggagaaataaaatcctttacagacaaacaaatgctgagagattctgtcaccaccgggccagccttgcaagagctcctgaaggaagcactaaatacggaaaggaaaaaccagtaccagccactgcaaaaacataccaaatagtaaagaccatcaacactaggaagaaactgcatcaactaatgggcaaaataaacagctagcatcataatgacaggatcaaattcacacataacaatattaaccttaaatgtaaatgggctaaatgtcccaattaaaagacacagactggaaaattggataaagagtcaagacccatcggtgtgctgtattcaggagacccatctcacgtacaaagacacacgtaggctcaaaataaagggatggaggaatatttaccaagcaaatggaaagaaaaaaaaaagcaggggttgcaatcctagtctctgataaaatagactttaaaccaacaaagatcaaaaaagacaaagaagggcattacataatggtaagggaatcaatgcaacaagagctaactatcctaattatatatgtacccaatataggagcacccagatccataaagcaaattcttagagacctacaaagagacatagactcccacacaacaatagtgggagactttaacaccccactgtcaatactagacagatcaatgagacagaaaattaacaaggatattcaggacttgaattcagctctggaccaagcagaccttacagacatctacagaactctccactccaagtcaacagaatgtacattcttcttagtaccacatcacactatttctaaaactgaccacataattggaagtaaaacactcatcagcaaatgcaaaataatggaaatcataacaaacagtgtctcaaaccacagtgcaatcaaattagaactcaggattaagaaactcactcaaaaccgtacaactacatggaaactaaacaacttgctcctgaatgactactgggtaaataatgaaattaaggctgaaataaaaaagttgtttgaaaccaatgagaacaaagacacaatataccagaatctctgggacacagataagcagtgtttagagggaaatttatagcactaaatgcccacaagagaaagctggaaagatctaaaattgacaccctaagatcacaattaaaagaactagagaagctggagcaaacaaattcaaaagctagcagaagacaagaaataactaagatcagagcagaactgaaggagacagagacatgaaaaacccttcaaaaaaatcaatgaatccaggagctggttttttgaaaatactaacaaaatagaccactatccagattaataaggtagaaaacaggggagaatcaaatagacacaataaaaaatggtgaaggggatatcaccactgatcccacacaaatgcaaactaccatcagagaatactataaacacctctacacaaataaactagaaaatctacaagaaatggataaattcctggacacatacaccctcccaagactaaactaggaagaagctgaatccctgaataggccaataacaagttctcaaattgaggtagtaatagcctaccaaccaaaacaagcccaggaccagacggattcacagccgaattctaccagaggtacaaagaggagctggtaccattccttctgaaactattccaaacaatagaaaaagagggaatcctccgtaacttattttatgaggccagcaccatcctgatacgaaaaccaggcggagacacaacaaaaaaagaaaatttcaggtcaatatccctgaagaacattgcaaaaatcctaaataaaataaatactggcaaaccgaatccagcagcacatcaataagcttatccataatcatccagtcggcttcaaccctgggatgcaaggctggttcagcatacacaaatcaataaatgtaatcattatgtaaatagaaccaacaacaaaagccacatgattatctcaatagatgcagaaaaggacttcgacaaaattcaacagtgcttcatgctaaaaactctcaataaactaggtattgagggaacatatctcaaaataataagaactatttatgacaaacccacagacaatatcatactgaatgggcaaaaactggaagcattccctttgaaaactggcacaagacaaggatgccctctctcaccactcctattcaacatagtattggaagttctggccagggcaatcaggcaagagaataccagaaataaatggtattcaaacaggaagagaggaagtcaaattgtctctgtttgcagatgacatgattgtttatttaaaaaaaaccctgttgtcggccgggtgaggtggctcacacctgtaatccctgccactgaggagggcagatcacaaggtcaggagatcgagaccatcttggctaacatggtgaaaccccatctctactaaagaaaacacaaaaaaattagccaggcatggtggaaggcgcctgtagtcccagctactcgggtgactgaggcaggagaatggtgtgaacccaggaggcggagcttgcagtgagcccagatcatgccactgcacttgcactccagcctgggtgacagagcaagactccatctcaaaaaaaaaaaaaaaaaaagaaaaccccatcttctcagccccaaatctccttaagctgataagcaacttcagcaaagtctcaggatacaaaatcaatatgcaaaaatcacaagcattcctatacaccaataatagacaaacggagagccaaatcatgagagaactctcattcacaattgctacaaagagaataaaatatctaggaatacaacttacaagggatgtgaaggacctcttcaaggagaactacaaaccactgctcaaggaaataagagaggacacaaacaaatggaaaaacattccatgctcatgaataggaagaattaatattgtgaaaatggccatactgcccgaagtaatttatagattcagtgctatccccatcatgctaccattgactttcttcacagagttagaaaaactactttaaatttcatatggaaccaaaatataactcatatagccaagacaatcctaagcaaaaagaacaaagtgggaggcatcacgctacctgacttcaaactatactacaaggctacattaaccaaaacaacgtgatactggtaccaacacagatatatagacaaatggaacagaacagaggcctcagaaataactccacacatctacaaccatttcacctttgacaaacaggacaaaaacaggcaatggggaaaggattccctatttaataaatggtgttggggtaactggctagccatatgcagaaaactgaaactggaccccttccttacacattatacaaaaattaactccagatgaattaaagacttaaacataagacctaaaaccataaaaaccctagaagaaaacctaggcaataccattcaggacataggcatgggcaaagacttcatgactaaaacaccaaaagcaatggcaacaaaagccaaaattgataaatgggatctaattaaactaagagcttctgcacagcaaaaggaactatcatcagagtgaacaggcaacatacagaatgggagaacatttttgcaatctctccatctgacaaagggctagtatccagaatctacaaggaacttaaacaaatttataagaaaaaaacaaacaaccccatcaaaaagtgggcgaaggatatgaacagacacttctcaaaggaagacatttatgcagccaacaaatatatgaaaaaaagctcatcatcactggtcattagagaaatgcaaatcaaaaccacaatgagatacccatctcacaccagttagaatggcaatcattaaaaagtcaggaaacaacagatcctggagaggatgtgcagaaataggaacacttttacactgttggtgggagtgtaaatctagttcaaccattgtggaagacagtgtggcaattcctcaaggatctagaaccagaaatatcatttgacccagcaatcccattactgggtataaactcaaaggattataaatcattctactgttaaaacacatgcacacatgtgtttattgcagcactattcacaatagcaaagacttggaaccaacccaaatgcccatcaatgatagactagataaagaaaatgtggcacatacacacatggaatactatgcagccataaaaaggatgagttcatgtctttgcagggacatggatgaagtgggaaaccatcattctcagcaaactaacacaggaatggaaaaccaaacaccgtgtgttctcactcataagttggagttgaacaatgagaacacatggacacagagaggggaacatcacatactggggcctgtcagggggtgggaggactaggggaaggatagcattaggagaaataactaatgtagatgatgggttgatgggtgcagcaaaccaccatggcacctgtatacctatataacaaacctgcatgttcttcacatgtatcccagaatttaaagtacaattaaaaaaattaataaacaggaagggtaaaaaatataaacagagaaagtttctgtttcaatttgatgatatggtggtatcacatagactgataagccaggtgcatataatacccagaggaactactgaaagcttacacaaagagttttactcaaaaacacatgataaatcaaaatgtaattctaaagactattcaaataacccaaaggaaggaaggcatattagtctgttctcacactgctaataaatacatacctgagactgggtaatttataaagaaagaggtttaatgaactcacagttccacatggctggggaggcctcacaatcatggcagaaggcaaggaggagcaaagtcacgtcttacacggcagcaggcaagagagtttgtgtaggggaactccccttataaaaccatcggatctcatgagacttattcactatcaccagaacagcatgggaaagacctgcccccatgatttaattatctctcaccgtgtccctcccagaacaaatggaaattatggaagctacaattcaaggtgagatttgggtggggacagagccaaaccatatcagcagggaaaaaaaaaaaaaaaaaagaggcagaggagagaaaatacagaacatagacagaaaaaaaggcagacttaaatcctaacacatcagtaattatattacataaaaatggtttaaatataccaattaaaagacggagatcgttagagtgaattaaagaacatggcccgatgttatgctatctacagaaaactcacctaaagtgtaatgatataggttaggtattatatcgtgaaagtaaaaatatatcatgcaaatattagatcaaattcaaaattagagttagaaatcccaatatcactctctcaaaaattgacagaaaaacttgacagaaaaccatcaagaatatgtagaagcataaatataacaaaaaaacctataaatagaaactaaataaacccttctaaataatccatgagtcaaagaaaagttctcaagggaggtttaaaaataccaggaattggataaaaatgaaaacagctaggcacagtggctcatgcctgtgatcccagagctttgggaggctgaggcaagaggatcacttgagcccggaaggttgagaccagcctgggaaacacagtgagatcccttctctataaaaatttgtaaaaatgattagctgggtgtagtggcttgcacctatagtcctagctacttgggaggctgaggcagaaggatcacttcacttgagcccaggagttggtggctatgttctcagtgagctggttgggccattgcactctagtctgagtaacagtgagacactgtcacaaaaaaaaaaaaaaaaaaaaaaaggtgggggggggaggaaaagaaaaagaaaatatcacaaaaatgtcatatatcaaaatttgtaggacaaagctgatgcagttctgagaggaaaatttatgaaactaaatgcatgcatttgaaaagaggaaaagtctcaaatgaataccctatgctcccacctcaagaaccttaaaaaaaaacaaaaaaccagcaagcagaagtaataaagataagaacaaaaatcaatgaaattgagaacaggagacaatagagaacaagagggaaaaaaaagtcaatgaaacaatgagctggttccttacaaagttcaataaaattgacaaacctttaccaagattgacagagaaagagagacggggcagggaacaagggagggtgaagagaaaacacaattaccaacgttaggaatgaagatattcctataggtcctgctgatatgagaaggattttaagggaagactgcaaacaaccttacaaacataaatttgataatttagaagatatggaacacaaagtaccataacttacccaatgtaaaatacctaatttaaatagccttgtaactattcagaacaatagatgtgtaattttaaaacttgcagaacaaaaatctccaggtccaatggtttcactaataacttttaccaaatgttcaaagaagaattggtaccagtttatacaatttctttcagaaaacagaagaaaatgaaatatttcccatttattttatttagcctatttcaataccaaaaacaatagacaattgtccctcaaaaaaacaaagaaagaaagaaaagaaagaaaagaaaaaaaaaaaccgcagctttctcctgagcatagaaaacacatcttttttaaataattagcaaatagaatttagcaacttataataagaattatgtaacatgaccatgttgcacttattctagggatacaaagttggttcagtatttgaaaatcaatgtaatccattatcttaacaggctgaagataaacaaaaatcacaggatcatatcaatcaatgaataacaagtatttgacaaaattcattgaccatttatgataaaaataaactcagaaaaaggaactagaagggaattcctcagctacaaaaaaaaaaaaaaaaaaaacaaaaccctatggctagcattatgctaaatggtgaaagactgaaatgttttccatttaagatgagaaataagacaagaatacctactctcacaattcttattcatcatagtacaggaagttctataatacaatgaagaaaagaaaataaaggcatagagattggaagcaaagaaaaaaagtgtccgtatttgcagatagcatggttgtcatcatgaaaaaaaatcccaaagaatctacaaaacaaaacaacaataaaagcccacctcaaacaaccaacaagtgaattcagcaaggtcacaaaatacaagataaatatacaaaaatctattatatttctatacattaggagtgaatgtgtagacatcaaaatttaaaattattataccatttaaaatcactccatttgaaaagactcaaaaatgaaataagtataaatttaacaaaacatgtaaagaatttgtttgcagaaaacaaaacactgtcatgaaagaaattaaaggagacataaacaaattataagacgtactgtattcatggattagaagactcacatagtaaagacgtcagttctctccaaactaatatgcaagttccatacaatttctatcaaaatacagcaatacttttttgtagctaacaacaagattattcttaagtctatatggaaaggaaaaggaactcgaataagtaaaacaatttttaaaaattaagaataaattggaagaaataagtatacccaatttctagagttattatggagttagagtatcaagactgtggttttggtggagggatatgctcatagctcaatagaacagaatagaaaagtaattgaacagaatagaaaatccaaattatagaaatggagaacagattagtgactgccagggtttaagaatggaatgagggtggaagagaagtggatgtggctataaaaaatataaaaacatggtagatcttcatgttgatggaaatgttctatatcttgacaatatcagtgtcagtaccctggttgtgataatgtacaatgattttataagatatttccactgaaggagaataggtaaaatgatctttatgtattatacgatctctcttattatttcttacttcatgtgaatctaacaataacatcacaagtttaatttaaaaattcagaagtattttgggcacaatgacagataatggatcttaaattttaattggttaattaattcctctttgaggttaacacctcaacacttgcccttccttgtgcagttcactgcatctaccctagtacacagtcatattctttttttttttttttttttttttttgagacggagtctcgctctgtcacccaggctggagtgcagcggcttgatctcggctcaccgcaagctctgcctcccaggttcacgccattctcctgcctcagcctcctgagtagctgggatgacaggcacccgccaccacgcccggctaattttttttgtattttttagtagagacggggtttcaccatgttagccaggatggtctcaatctcctgacctcgtgatccacccgccttagcctcccaaagtgctgggattacaggcatgagccactgcgcccggctgagtcatattcttttttctagactactgcagttatccatatttctaaagcaaagtatatagttagacactgtactactttaaaaaagaaagaaaaaaaaacttggtcatactagaaagccccgatgttagaattaatactcaaacaccttaaataatttattttaaatatgtacaaaaaaacctaaaggaaatcatacccaaagaactgaggaaaagtatgagaatgatgtcttgcaaaatggaaaattttaataaagagatctaaaaaataaccaagtagaaatactggattgaaaagtagagaaactgaaatttaaaaataattaaagaggctcagtagcagatttgagcaggcagaagaaaaagcctgaagatatctgtgttttctttcacataccatgaaatatagaggtaggagctacaggggtggagcagaggctctacgatgtcatcagcaccccagattcattcttttttgtcatcatgtcatcctcagaagacaagagactgaagaaaaatgaacagagacttaaaagagcagtgggacaccttgaagtataccaacatatgcaaaatgacactcccataaggagaggaaaaagaaagtggggaagaaacatatttgaaaagataattcccaaaggaattatttgaaacgtaaaaattcccaaatttgattaaaaacattaatttgcaaaactgataagttcaatgaacttcaaataggataaattcaaagacattcacacctagatacatcataatcaaattctcaaaagctagagaaaaagagataatcttgaaagcagtgagagaaaagtgacttatcacatagaagggttttgtatcagaaatcaaggctagaaggcagtggattacatattcgaagggataaacagaaaaaagagagagaaaagaaactgtcagtgaagaactttacatgcagcaaaactgtcattcaaaatcacagagatattaacacattcccagggtctttcatggtgaaatgaaagtacagtagacaataagtcaagtccacacaaataaataaatagtatcagtaaaggtaactatatagataaatattttaaaaacagtataaatgtattttttctttgcttattttagatgtttacaaatatctaaacatagacaaaaatgtatttttttctttgtaactccttttatttccctacctgatttacaagccaactatttaaagcaataattataagtctgagttgatacatatacagtatatgatataatctgtatcacaataacaatacaaaggaaatataaggtaacagaattacggaagagcaaaaaaattgtatgctattgaaattaacttgatattaatccaaactagaattttatacatgaagaagaaaactgaagaatatacatgaagatgatatatgaagaagattatacatgaagaagaaaaatcattaaggcaatcctagggcaatcattaagaaaaaactcaaaaataaaaaaaaagacaatactatgctgggaaatctctattaaatatttacatacttaatacctaaatatgtatttaacaaaagaaaaggcaattataaagaaattgagggaaaaaaagacataaaacaaatacaaacaactagcaaaatggcagatgtgtttccttgtaagtatataagtcgtgcattgcttaatgatagggatgtgttctgagaagtgtggtgttctgagaaatgcatttttaggcaatttcctcattttgcaaacatcgtagaacaggggtgtccaatcttttggcttccctgggccacactggaagaagaattttcgtgggccacacataaaattaacactaatgacagctgaaacaaaacaaaaatcacaaaaaaatctcataatgttttaagaaagtttacaaattttggggggaccacattcaaagatgtcctgggccacaggttggacaagattgtcatagagtatatttacacaaacctagatggtatagcctactgtacaactaggctatatagtatagcctattgttcctaggcaatgaacatgtttgtacagcacgttactgtacagcatgttactatattgaataccataagcaaatgtaacacaatactaagtatttgtatatttacaaatatctaaacatagagaagataatgcattgtgctatgacattatgatggctatgacatcactaggcaatagaaatttttcaactctgttattaccttatgggaacactgtcatatatgcagtccatcattaaccaaaatgttcttaagtggcacacataactgtaattacattaaatataaactctccagttaaaaagtggagattggcagatttataaatgcatataattcaactttatgctatctataagagaaatagtttagattcgaagacaaaagtaggttaaaaaaggatgaaaacagtaaccaaagagagctagaatagttatactaatatcaaacaatacagacttttagacaaaacttgttctgagacaaaggacataaaataataaaagggtcaatcaatcaagactatataacaattataagtatatatgcaaataacaacagagtctcaaaacacatgacagaaaaatggacagaattgagggtaaagaatacaacaataatagttggagactgtaacaataccccaccttcaataatacccaactttcaatataggatagaacaaataaacatttgaagaaagatcagcaagtaatgagaaggcctgaacaacagtctaaaccaactagacctaatagtcatctatagaacactttactcagcaacagcagaatacacattctccccaaaggcatacattctccaagacaaaccatatgataggccatcaataatgtctaaataaattaaaaggaggctgggcgtggtggcttatgcttgtaatcccagcactttgggaggccaaggtaggtggatcacaaggtcaggagattgagaccatcctggctaacaccatgaaactccgtctcttctaaaaatacaaaaataattagccaggcatggtggcatgcacctgtagtcctagctactcaggaggctgaggcagcagaattgcttgaaccgggaggcagaggttgcagtgagccgagatcgcgccactgcattccagcctgggtgacagagcaagactccgtctcaaaaaataaaaataaaataaaataaattaaaaggaatgaaattatacaaagtatgtcctcaacacaacaaaatgattttagaaagtagtaacagaaggaaatttggggaattcacaaatgcatagaaattaaaaaacatactcctaaaaatcctatggtcaaagaagaaatcaaaagtgaaattagaacatactttgagaaaaatgaaaacaaaaacacgacatactaaaatgtatgggatacagtgtgcttattaaggaggaccagaaacttcactttccaaagggcttttaaacttaatgggaggaagcaattctgccatttctgaatgaggcctttcatttgtcctggctctggagtgtggcctcagcaaatgagacaatggcctttctggccagcagcattattcatgatagctgaaagatggaaacaacccaactgtccatcaaatgatgaatagataaacaaaatgtggtatttccatactatattgtatcattttattatatgaaatggtcagaacaggcaaatccatagagacaaaaagtagatttgtggttgccagaggctggagggagggatatgggagtaactgttaataattatgaggtttctttcagggctgataaaaaatgttctggaattagatactgatagctgcatgaccttgtgaatgaatacactaaaatgtacactttaaaaagctgaattttattttatgtaaatcctatcccagtttatttagaaaacatgggaagaccactattccttttataaatggaatacagagcatggactctgggatcagtcacatgggtctacaatcttgtccatctactcctccttcctccgctctaaaatagacacaattaatagcaatctctcaattaatagcaattttcatcattattatttcatcatgcctgtaaaaagatattgcaattattatcaattatgaatataaattatgtgttggtgattagagagccctgcttgccaagagagaaaataattgagtagaatcccatactgctaggataaagaccatcaatattctctcaggcattgtattctgctccaaaaagtgaaattctatagtaatattgcttctccctccccataccttgtaaagtggaaattaagtcctttcttgctaatttgagtatttaggaatcaattcagtgaaatgttgtgaaacgatgaagcttttgttacatctcaaaatgaatgttacaggtaaaaacaaaaagttattactaaaactttcaaaaaagcaatattttctagttctatacattctacttctaaaacatctcctgaaattctcccccaaattattataacagcatcctgttggtgtttcctaccaatgtttcccttacagtgcccagagtcatgaatctaaaatagatatgctcatgtccctctttgttcaaagacatcctctgactttgaactgcttacagaaatagattccacctgtgttgatacaagtgattgattggtcatggtttgctgaagtgtatatggtcaagtattctagggatatgcctgagctgaatgaaaagacattcttgaattcagttttaatatcctcgatggatatgggaatagaggagaagaatgaaatgtggctagtgtttcccatgctgagattaaggtcaaactccttagtacatgctttataaaggatctgtcaacaaatttacttccaagagtattatcttctgttatcattgcaacatctcctagcattatctgcaatgtccttcctgaccttcactacatagacaatatataacattattcgaatctcagcttaaaacgtatcctcggttagcttttacaaaccatcccgtgcccaaacaccactcatattcctggagatattgctgctgtttctgtttccagatcgctttgttcctacttttattatagtatttattctattacagttcattgttatgcatttggatctaccactatattcaaactctttggtaagtaccatgttcaggagattctagttcagaatattgtatatactttttctgaaaggttaggacttctgtttcaaaagtagttatcttctggcaaaagtcagaagactctagacagatctgaaattcagattaagttgacaattaggacaaaaaagacaaaactcatggctacacaaaccagtcagtaatactcaagtttctggacaagtttctaccaagcccattcaaagtatgcaatatggtgaaaaactatcagaatggaagtcaggagacctgggttctcattctttctctgctattagttagctaagtagattttcaaagatggaaacttaatctttcttggccataacgatcctatcaataaaaagtgaggttctattatctgctaaattattgcaaagatctccgtagctctgaaattttaggcactgtatctttgtaggttgctgcatggtctctaagtgttagttgttgcctcctagttgaatggctcaatgtgtatgagtaataattattcagaattaatatgtataacaattatctccctaaaaccttttaggaatccaaacagattcttagtttaaataattatttttgttgttaggactgtttatagataataaagacatgtgacaaattcattctcgttcacctcgaatatctatctgttttcttctacacccaggataaatacactttagataattgcaaatcttccctttttgttcttcaaatcctcacaattacagtaattcttctatatcttcttattcagactctttttaaattccaagaacaaattaaattactctatcatctggaagcagaaaaaagaacaaagtggattttttcacaaatggattacataacatgaatattttcatttgtcagatcactttctttcctgtcagtgtcaaggcaaaaaaaggccaagaatgtcttccaaaagacagtttttcctcaaaccagacatcagacagaccttccaaagggcagtcaagcatactaaatccagttcatgaatatgaaggtttgggattttagtggttttagtccctttctattaatgagaagtaaaaatgtgtgtctcatttaaacagaagggattcaaaaactacccaattggtaatagaaaaataaaagtaaaccaaaacagtttccaataaaatattatagtataaactttaaaaaattatttattttatttttattataattttatctttataaactatgaaaatttttaaattagtgttttctttggtgttatgttccaatagcaaatggttttcatggataatctcacgggtcattgcttcttttaattagtagcttttgctaaacataaaaaaatcctcaagtaatttttaacactgattacaactgcctagtccattaacaaattgtcatattaacactggccacattgtacagcttatctttaaaggctacttgtttcattttcatagattttaattaacttttcctttcctattagagttgaccattaagcagcaacaaaggtattttgccttttttgcttctggatatgcagattttgactgaaaaagagatctggaaaatgcaaaaaatatagataccaaattagatggtggtgagacttgtagatagaatcaaagaagccaggctctgtaaacactaccagcacattgattgaatcaatttcatgttgccacaatacttctggaagtctgtaaaatttccatcaacagcttctcttatttgcattagctgggaacagtacatataatcataactgacaggctagagggagtttaggcttatgaaacagagaaaggaaaggaaaatgctcattgtttagattccctaaagtagaaaatgttatctttgtttgggaaacagaatgtactgtacttgcagtctaatccctaaggtttaggaaggtctacaagtttagaacagacctcaaaggttctctcaaacaatgacctcttttcccaacactttcatatgtgtgcgtgtgtgtagagagcagaaaagcctggatcctgaacaccatgttatataatatataggtaatgtatataatatctgctcaaatatcactctatccaaaaggacttccctgatctaaaatgatctaaaacaagacacatactcttccctttcattattactctctaaactcttaccttgttttgatacacacatatatacatatatatacatacatgtacatatattttaatacatatatttatataacatatatacgatacacacatatacatatatgtacatatatgtgtgcatcgaatatatgtgttatataaatatatgtatgaaaatgagctacatgtgtttatctttagagaaagcctttgatattgttaaatgtgttatgtacatatttacgtaaatctatatcatatagacatatctaaagacaaatacatataactcattttcaaaataagtatgtactctaaataggtataaattgataaagactgaagctacataataaatatgaccaattagtgggtaaccaaaatacacaaaaaaagagagaggaaggagatggagtgagaaacaaaagcgaatgtaaaattagtaagaataattcaaaagaaaatataggctgaattccaagagaaagaccccttttggacacaatttataaaccttcatctttcaagggaagactttaaagtgttcacatgcacaaagctggactgaccatctaccctaggtgtgttacaataaatgtaaaagtcttgcaagttccttcaccaaattctacatggatcaagatactgttaatctttcagagaagcattctgcaacttaacaaagttgggcatagttccaaaaagctttcaggaacttcagagtaagaacacttaggtctagtatggcaggagcaggcaagtttgaaaagaaaggaagactctttcacaggcctagcttcttctcaaatttaccagtagaaaaggctatggagcatcaactaactttttaactaatagactttcaacaccattactttttatagattatacaatagcttcccccaccttctcctaaagtcgatttcagttttaagtcctaccctcagatatccaaccaacctttccacaccaccagaagtactctctctgctgtcacctattacaactctcctccacgcagtctcagctccagtcctgctggctttctgctcttcaaagagcctgtcattaacatcgcctcagggcctttgctgcaacgagttcttctgcctagaacacacttttcatttaatcttccacttcatttatgtatctgctcaaaggccatctatcagaaaggacttccttgatctaaaacgatgtaaagtcagcaccagcacccacatgtgtcccttctaccttactctgctttgattttcttcatagtactttttgacatgaagaacattatctatatatttgtttaattgttttgtcttttcgcctccactaggatgtaagcaccataatgttcttgagatacttgttcaggaactaaataactcaggcacctagaaaagtgctgggcacataggaagtgctcagtaatacatgctgaataaatgactcaaattctattcttcctgctaatgtaaaattgaactttatacaacacagacaacatctcattttacactcttactgtcctctaacaccaagctagtcttgcttaaaatcaatcatttcccattgcttttagactataatctacattcccggcaggacccaaaaagcttctcatggattcaactctgtttaattttccagtctcacctttcaccatccctttccatattctaaattctgatcacactaaactatttgcagctcttaaatgtatcatgctctcttgaacctctaaatctacatctgtttcttctgcctggaatgccctgcctaccctgtttaccctggctaactcttacttgtccttcaggatccagcaaagctttcccacgtggggttagatactgttagtaattgctctcacagtcagtaccctgtgccttgctttaacacagcactgtcacattatttctaaaaataataatggttttcttatttacctgatctccctcccctattaattgagagctctttgggaaccaccaggcatctctttgcacttattcaacacagtacctggaaccagtaaacacttaataaatattgactataggaatgcatattaaaaatgtatattgaagattgaagtatattacattttttgagatttgagagatttctgaaccatgacttgggactattagagacatactaatgatactgcaaagactaagattataaatttctacagtagagctttcattttcaataaaccacataatcaaatatttgttatatgtaatttcaaatataaagctgagatattttaaactcagtaaaagcatttggataagtaaatattatgtaattgggaagggctaggcatgactcattttttttttccaaaaagtaaccttggttaatatttcaagatttgcctataaactgagcttccttgtctgtgactgactttgaaccttttaaaaccaaaacattaagttagatatcttgaagttcactgcatgtatataaggaattttatattattaagatgtgaatttagggatcccattattatggttccctctggcccccacccccatccactgggtatttgggtgtccattttcccacatggtgatggatttgcactttgcttcatcaggtctcccttgggccaagaacacattttagccataattattggagcagtctgtggcagtggaaaaccaaagttaactgaaccacatggaaataaaacccatgtcattggtgtcattaccagtacaccctaaccaacagagttaacctcaatgtaaacagcaggcaaaaatagcaaaacactccatcttttggagaaatcagtccgtttggaaagaatgcaataagaaggaaacacctgaactcattttttttggactaaaatgagatacaagtactgatttctttttttttaaaattatatatgtatgtgagtcaaaaaaaaatcacacagttggaaaaaaaaatgttcacagtgaaaaacattcttcactctccagtactcaacactgactgcccatctctcaggtaccctcaagagtcaacttctattaccactgtctaaattttatttccatctcagtgtacttgtttatgattatgctatgtgtgtgtgcatgcatacagtcatctccctttaataaatggtagcacgttatatacccatttttaaaaataatatataaaactttcatctgaaatttattctgctgaaagcagcgcagtatgaatcatactttatctctttttttccaaataaatgtctattggtcaaaaccatttatagaattatcaatctttcccccacttatttgaaataaaatcttactgggaactaagctctgtatatgtttgagtatatatctaggaatgctactgtttttatcatctgtctgattatttactactatcactaatttaacattgttttatgttttgataacttagaagaggtataaacagtaacatatcatgtagtaagagacatagattgctaagtgtggtactgttttataaatactaaaaactataattcatgggatattttcatcaatattgaaccttaaatattaacacataatatgaggatcaaacctttggtttaacaatcaagtaaaaagcatgaacacaatattggtattatatgggaaaacatattttcattcactcttagtaagagcataaatcagtaccttatgggagaacattacacaaaccctaccaaaattaacaatccgtgtactctttgacttaccaattctacttctaggaattcattccacagccatactttcactagtgcaaaatgacttatgcatgttattattcactgcagtgttacagcaaaaactgaaggcatcttaaatttaaatcagtagggaaacttgttaaataaattatattcatacgatggagtttctacatagttattaaaaaagaacgaggaagttcattatacattaatatagagaaatctccaagaaatggtaagtaaaaagtaagatattgaacagcgggtggtatgccatcatctaggtaaaaatgaatagaaaaaaatgcattcttatttactcatatatgtataagttatgcctggaaggatacatataaaaataggagcatgcaacagtgcagcaaaggaatagaactgagagttctatgtatttttcagtaaatcttttaaagtatcattttagttttaaatcttgggattaatggtaaaacatatttattgagaacctattatgtttgaaaaactataagataaggagttttcacttttgttttaaattattcaattaagctttattaaacattcaaagactaaagagaaaatattaagaaccttacattgccatgaattattaaagaaaaaaaaaagcaaactagataccagcatcaaataacaaaaaaaggagattaaaaaaaatctaaggtcattttgagtttggaatgagaaaaaataattcatgtactatagattatggccaacttgaaatcagcagtaaaatctagcaagatacctcaatgaactacatagataattcaatttaacacaaatgtgttaaaatattgtaaataccacaaatcttagattatggctatttgaaagtaaaagagatgaaaaggataggagggaactctagagagtatcatcacacaagccaaagaaaagggtaagcctccagtataggaatgtggatagcagtgtcaaagctacagagatcttcttaaatttaaatcagtaagattaaaaattatagcttcactctaagtattcccaaagttaaatgataaagaatattaaacatgttaaacataagagaaaccagtaaatactgttcttaaaaacttagataggccgggtgtggtggcttacacctgtaatcccagcagtttgggaggccaaggagggaagatcatgaggtcaggagttcaagactagcctggccaacatggtgaaaccctgtcactactaaacatacaaaaataagccaggcgtggtagcctgtgcctgtaatcccacctactcagaaggctgaggcaggagaattgcttgaatccaggagtctgaagttgcagtgagcagagatcacgccactgcactccagcctgagtggcagagcgagactctgtctcaaaaaaataaaaaataaataaataaaaaccttagatatatgagtacccggtaataggacagcaatgctgtaatagtaaagcatgtatgtagtacgagccacaaaaatgtagtttgccttttaattattctgaaacatggtgtttttttgtcaaatattcttgatagattaagcattcttttattgtctctgaagaaattatgttaaaatcatctcagaaatctcaaaatgatttggtaaaaggggtgaaagagaaatgaatgtagatagatacacaatgaaaggatgaaaatgaaggattctaattctattctaatattaggaatagtatgaacaaatacaatgaccgtgttaatctgatcaacattcttatatagagtccttgtttattccattagatcttaccagatcagaacattataattcttattcacttgaaagtgccatgaattttccattcaaagttaaccagaatttcaattcaagaataacaaaggataatcacattatttgagagtacatgaattacttaataatactacacatcttggtaactgaaagaaaacaggtgtatcaaaatgctagtaatcaaaactaatctgaagagggaaaatagagttagcaatactattagtgaaatttaaaataacatcacattctgagttgtacttgacaatattgaattaaactgaatcctccaggctaaacctccaataggtccaattacattttaaagtaatttctaaaatccataaagatctcagaaaccagaaagtgtttttttgtttttgtttttgtttttgtttttttcatctcgctctgtcgccaggctggagtgcagtggcactatctcggctcactgcaacctccacctcccgggttcaagcaattctcctgcctcagcctcccgagtagctgggactacaggtgcacgccgccacacccggcgaatttttttttttttttttttttgtattttagtagagacggggtttcaccatgttctccaggctgctctcgaactcctgagctcaggcaatccgcccacctcggcctcccaaagtgctaggattacaggaatgagccaccacgcccggcccattgctcttccaaaagtttagaaataaaagtacttgttaagtaatgatggttttgatctcatagttatgttatttaaatcactaggacaaatatacaacaactgccgtccgctcaaaactcaaacaatggagagcattttttttttttttttttttttttttttgagacggagtctcgctctgtcgcccaggctggagtgcagtggcgcgatctcggctcactgcaagctccacctcctgggttcatgccattctcccacctcagcctctcgagtaattgggactacaggcgcccgccaccatggctggctaatttttttttttttgtatttatggtagagacggggtttcaccatgttagccaggatggtctcaatctcctgaccttgtgatccacctgcctcggcctctcgaagggctgggattacaggtgtgacccaccgcgcctggccggagaacatttttaaaatgtaaaattatttttccaaaattattattcaaatgacgctttataagagatggccttttccccatctccctatatgtacatatgctgtttatatttctaaatgtaaattctaactttgattctaattttgatgaagactcattatgaattaagatagcaagctaccaagagataagactagagtgaaacaaggggcagaagacagcaaatagggctttcaggaaacagagttctttatgatgggcaggttatatggaaatataaatatgtctatttactcaccataataaggaaattgtaaaggaagacatttaatgatttatgtaaaaagataaataccatttaataaagaataggtgattacaaaaatattttatgcataattttgcagaataaaattatctttttcttatttgacaagactagatttttaaataacagaggggaaagagtcaaggacaaggagaatgacatataaaaattaacaagcaagatacaaaaaatatacataaaattggaagaaaaaaattgaggtggttaaaaaagaatgaaaaaaagggcacctacttccaaatgataaaatgacttagaagtattacagctcattttgtttcacagaattatattaccattatcattacataacttccatattgttgaagccagtggacactcttctatttgtgtcttatttgggatctctgcagcatttgatactgctgactacattcctatacgccaggcttacccccttcctttggctcatgtgacaacactctctagaagtccctcctattcttttttatcatttcttctcagtgtcgtttgagaattccccttctatggctacatctcaaatattactattaatatatcctttaacttttcattttaacatctagggtctctgtagatctggtttcagaatataatttgcctaatttctgctctcatgtcctacctccaaccataaaaaaccctgtcccacccaggtagcctgctttatgagactctattttcatagtgctgctctttctttcctgagtgtctttgttcacccagataccttctactaaacctttgaaagtcaaatatcgtgttatctcctctaaatattttttaataaatccctagtgtacgatgacttttctctgtgcttctccagaaatctgctcatgtaatagcattcgtcttgctttgaaatcactaatttacatgtctgctttcatactagactataactccaggtcagaccacatcttcttctttccctaagaattataaaatgcatatagcaaaggttatcaaatgtacagctcaatgaattatcaccaaatatatacctgtgcaactattcccagaaagattacatcttatttgactttgtatcatcagtgactcacatataataaacacttaataaatacatgacaaatagtaagaaatggtattgattgggtttggagtatgttaatcattgcaagaaatcagctcagtgctatgacccaaaaaccagattttagacaccaagatcaaatatcacttataatggggaaactctacagtcacacaaactagtaacagtatagaaatgaaatttgcaataaaaaatgacattaaataacaatcttgctaggaaaccaaaaacatagagagcttggcattaatatccagagaatgataagggtccactatgtgatattaattttgccagcagatgaccctcttggctagccaggtaaatgagatagccgtagagtatctccaaaagtaaaacccagagacaggcagtctatcagcagctaagcaactcagcttcttagcagtgaacatgcgaaaaggattgatgcaaatagaacagctacaaatctgcctcatggtgaatggttgtggaagactgtaatccagagggggcagggaaaaggctacaaggccacagacaacacaactccaagaataaattgctaagaagtgacggcattgggaggccaaggtgggtggatcacctgaggtcggagttcaagaccagcctgaccaatataatgaaaccccatctctactaaaaatacaaaaattagccaggcatggtggcatgcacctataatccaagatactcgggaggctgagacaggagaatcacttgaacccgggaggcagagttgcactgagccaagatggcgccattgcactccagcctgggcaacaagagtaaaactccatctcaaataaataaataaataaataaataaataaataaataaataaataagtgacagcagcagaaaggcccaccagtgtacaagattgagaaatagattgtctcgatttatatcagcacagtctgtggcctgggaggctaaacagcagaagctcaaatacagaaagactatctaagcaatagcagcagctgctaaccaatgaaactaaaaccacatctgtgctttacttagaaaagagtaaaggtcgccggtggcctgttcaatttcactcttgctgatagacagctgcgtctctcatataattatttaacaaaacttaaaaatttgcattcaatttcagtattacatttttacttgcttgatagttcattcagtaagagctataatacaaaggaaagatccttaagaggaatcatcatagtgacaatgacaataataacagctaaaatgtatgagtgctcactgtacctccagtcactgtgctaaaggtgttcttgcattttctcatttaatcttcatgtcattatatagagatgattattttccccattttacaggggaggagacaagctgggagagactgtttttaccactgggaaatagcaaagttggacatctaattcaggtctgacttcagaacctgcacttttcttggttatgctaaattacccaaattcaactgttttttttgatatgtgaattatttttttaaatcaagtgttcccatttctagtcatgatgaaggatgttaacaagattcttaagacgcaaatagcagaagggtcacggaatatgtccaaacttactttagttctcccaatatcagcagtgatgtttcaaatttaccttgccatacctcagaaagtactatacggagtctcaatccaggaaaagtagaaaatttagaatcatcaaggtgtaactgtagttttaaaaaataaaccattatgactactggttttgaattagaatagcagagctataaggacatttagagatcatgtagtttaaaaacaaaaaaagagaaagctgaaatgcagggaacagaaatgatataataaaagttcccactgtctagtctatcacagagcaaagactagtgatattaagcagaccataagccaatgattctttctgttacatcatatggtcccagtggaaatcactcagtcctctaaagaaaaaaaacttctgatagttgggctagtaattctgcaagcaataaattgtattataaccacagaggaaaacatttggaactaagtaaaccagcccagttgccatataaaggatgatttggcaatttgcagacttgggctcaagttctactctctgatccattggggcaaatcacttaacctatgtgaatatcatctttttttttttttttttttttttttttttgagacggagtgttgctctgtcacccaggctggagtgcagtggtgcgatcttggctcactgcaagctccacctcccgggttcacgccattctcctgcctcagcctccccagcagctgggactacaggcgcaagacgccacgcctggctaatttttctttttgcatttttagtagagacggggtttcaccatcttagccagaatggtctcgatctcctgacctcatgatccgccggcctcggcctcccaaagtgctgggattacaggcatgagccaccgcgcccggccgtgaatatcatcttttaaagaacataaggtggggggtggactggtaataactactcacaagattgttgtaagcattaagtggaaaataggtgaaagtgcctagtgtgacacaaaatgcttgtttttggctgggagcattggctcacgcctgtaacccagcacctggggagaccgaggcggatggatctcttgagcccaggagtcggagaccagcctgggcaacatggtgagacccgcctgggcaacatggcgagaccctgtctccacaaaaataaaaaataaacaaacaaacaaaaagcttgttttccttttctaaaagtaagcatgtagtgtatttggttaaactataagctctatcgggctgcatgggttcaaatcccacttcacttaataaccatgtaagttagggaattagttaccttctctgcactctagctttttcatctataaaatggggatggactattttaaaggatttaattagataatgcacgtaaaacacttggcttacatcctaagacatggtaagcattcttgaggagaattatcttgattccattctgtaacatgcaataaagataagtatgcaacattcccatttatatctgtataagatactatgtcaatacttttgcttcaatttttttcgttcaattacctttccatcaattttattccatatcattttttgaagatttaaagaacgtgtgatcatcaagcaattatgatgttacaacaaacaatctattataacataaagaaaacagagagctacacatcgttcttgatcttattttcgaatttaaaacaaatctcggtgtacattcaccattcaagataatatcaacacacaacatgaacaatttagctaaggccttctggcaagaagatggctctagctacgctagaagccttcttacagtatacgtcttgaaatgtgggataaaacaaatacatagttgaattcacaagaagaaaggaggttcctggatgctcaaacagtcaaatgaaaatgcacaaacaagttattgctgcagtagactatgaatggaaacaggactggggaagagctccatgaaatgtaaagataggccgtaactgctggagttttagattttaatatccactaagtgacagaaaataagggcttgcatccattttgaatgagacaggacactggaactgagattcctatatgaagctgggaccctctctaaagctatagtacccaaactttagcaaccataacaatcacttggagggcctgttaaaacccaggttcctcaatccagccccagagattctggtccagcagacctgcgtatttgtatctctagtacattcccaggtaatgctgatgctactggtcgataaaccaaactgtgaatagtgttgcgctagctaaaggctgcatcattagtgaaaagggtcctaaaaattatcttccctgatccagggagatgataagaaacacatttctgacaaggactcctccattgtgtactggttaagtgtaaaaatgaacactgcccgcatagcatatgagtggtagcctaaggaattaaaactgaaaaattggccttgggttggagattcctctgaggcatatggaaaatgtaaacaaaagactgttctgcaggaaaactttcacaacccaaattatgtgaaatccccatttagataactcaaaaccaataattaaaaaacactcaaggaaatgtttatgagcaagagtctacaaaaataatagaaagactggtacaaccaaaacataagataacagaacaattgaaagcacttataaaatgttttaaatgatttaaagacacacagacacacacacacacacacacacacacacacacacacacaaatagaaaacaggcctggcatggtggctgatgtctgtaatcccagcatttagggagaccgaagtgggtggatcacctgaggtcaggagttcaagaccagcccggccaccacggtgaaacctcatctctactaaaaatacaaaaaaattagccaggtgtggtggtgggtgcctatagtcccagctactcaggaggctgaggcaggagaatcacttgaacctgggaggcagaggttgcagcgagctgagatcacaccactgcactccagcctgggcaacaagagcaaaactctgtctcaagttaaaaaaaaaaaaaaaagaaagaaagaaaatggaaaacataaaaaataacttctggaaataaaaaataatagcctttgctacaaaatttcaataggcaggttttaggtgaggcataggtggagaaaagaatgagtaggccaggtatggtggctcacgcctgtaatcccagcactttgggaggtcgaggcgtgtggatcacctgaggtcaggagttcaagaccagcctagccaacgtggtgaaaccccatctctgctaaaaatacaaaaattagccaggcatggtggtgggcgcctgtaaccccagctattcgggagggtgaggaagaaaaatcacttgaactcgggaggcggaggttgcagtgagccgagatcgcaccattgcactccagcctggatgacaagagcaaaactccgtcttaaaaaaacaaaaaacaaaacaaaacaaaaacaagtgcactgggagagcagaccagggaaatcacagacaatgcagtgcagaggatgaaaagataaaaggtactaaaaagctatgaagttacattaaggacaggatgagaaattccaacaggttagccacagttttagtggtcgactaaggagacaatagagagaagcaatttgagatgctacataatgactaaaaaatcttctagaactgtaatcctaggaataaagaatcacaaagagaaccaagcagaataagtaaataagtctataccaaatacataaaatagtaagactgcagaataccatgggcaaaaagatcttagggaaaataaaaaagaaaagataagacaattgatttgtaaaggaattagaatttggctgacagaagatagcagcaacaagagactctaagataataaaatatctttcaagtgttaataaaactcaactgtagtcttaggattctctacccaggtaaacaattacgtaatactgaagagaaaatgaagacaattccaagacagagagtttaccactcattgaaagaaccaggaaatgattttcagtccaaaggaaactgatcctaagatcctcttaatatctgagggtagaaatattgaggcattgtacactttaagtcaggtagatatgctatagttttaagagtgcctactaaaatcatacaaatagtatgtactttcgaacatgtagcaatgtacatacaaatagcatgtacttccaaacacgtagagatgaaaagtgtgcagaaaattcaaacaagttatgggtacatacacaaatagtaaaagtataaacacacacagcatgatatataccaaattcaggataattgtcacatctaaagcctgagggaaaggaaaggaatgtgcttaggatcctagcaatacacgacaccaacattttcatgcaaataaggcaaaatgttaccatctgctaaatctgagtggcgcatatatgaccttccatcatttgatttctgtatatgtttaaaatatctcataatttttttaagttaagaaggcaaataagtttagctaagccaacgtaagaaaagcttagttagttggaaaattacttaccatgaattcattttccaaaagaagtcaagaacaggctaaattagtcaggtagcaggcccaataaaagccaggtttaaaaaatatctaatatgtattgtctttcctcttgaatctgttctatttggtttgtctaagattctttgattgtgtaagaacttaagacaaaagctatatataacaaaacattgtgttcttatattaatgataattgtatcagtggttcaaaaatggaggctaatgaataagggatgatattaagtgagatttaacacaaattctacagatagggcaaaacgtcataaaattatttgaagggctacagtaatatactaaccagcttaaaatatacacattagaaaattagaaagactaaaaagggggtacggtctagattactctttgaaaatcattagctttctttttctcacatgtcaagctccaaatcagctatgatatatttttgtctttggcttcaaaggatctctctaacctcaccattttttaccgataactcaagtccactccgtttgtaaggggtttcttgtttctttttccactcatcagatgaaaatcatgcttgtttttagtgactcataccttaccgtatgttgtttattaattgcaaaacaattcctgttagtgactgttatgacagccccaagagaatgaaggctaaaattagaccttttggcttttggtttgtttatgagcaggtatatgcaggctgtgacctatcccctttacatctgctcatttcttataaagcagcagcataagggcaggagtcagagaaatggaattgcctccttaacttttagaattgaagcagacaggtataatgaagtaaaggaaaaacataaatgcacagatgtgggataggctttctggagctgtttttagcattctttatgtggctaaaaataggtatatgtactggagtgtttttgttttctaagttttttactttttgacaaaaatggcatcttcaaaagttttatttttcattgagatgaacctctaagctgtcctctcccctgccagcctcctttaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaagaaaaaaactaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcataccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattgctggatatatacccaaaggactataaatcatgctgctataaagacacatgcacatgtatgtttattgcagcactattcaaaatagcaaagacttggaaccaatccaaatgtccaacaatgacagactggattaagaaaatgtggcacatatacaccatggaatactatgcagccataaaaaatgatgagttcatgtcctttgtagggacatggatgaaattggaaatcatcattctcagtaaactgtcgcaaggacaaaaaaccaaacactgcatgttctcactcataggtgggaattgaacaatgagaacacatggacacaggaaggggaacatcacactctggggactgttgtggggtggggggaagggggagggatagcattgggagatatacctaatgttaaatgacgagttaatgggtgcagcacaccagcatggcacatgtatacatatgtaactaacctgcacattgtgcacatgtaccctaatacttaaagtataataataataaaataaataaataaataaacaaactgaaaacctaaaaataaaaaaaaatttaaagcatggtttcaggtttcatcagctctggtcagaaatataaatgttataccttatatttatattttacataaaaatatatatttgccaatgtcataaaacaaaaaaaaaggaaataggtccaattactattcctttgaatcttcaatatgtaaaagcagtatcattaaaaaaagcaaataacttaaaagcttgatactctaattagcaaaaagtggattttttaatgtaaaaaaagtcatttccttccagaagtagatttttccttttattttcagttgaaatgtaataattgtacacatttatgggatacagagtgatattttgatacatgtatgcaatatgtaatgagcaaatcagggtaattaacatatccatcatcttcggcatttatcctttctttttgtggtgagcattcaaaatcctctcttctagcttttttgaaaatatacagtaagttattgttaaacatattcacctgacactgctacagtactttacaatttattcttcccatctagctgtagctttgtctgttaaccaacctcttcctatcatccccttcctcaatcttcacagtacctcataaccactattctacactcctacaaactcaagtttttttttagttctcacatatgagtgagaacacgcagtctttatctttctgtgcttgacttacttcacttaacataaagtcctctaggctcatccatgttgccaggactggcaggatttcattctttttcatggcttcttttttatcccattgtgcatatataacacattttctttatccattcatctgttgatggacatttaggttgattccatgtcttagctattatgaatagagctgaaataaacattggggtgcaggtacctcttcgatatactaattttttctcctctggataaatactcagtagtgggattgcttgattgtaaggtagttcaatttttagtttttttgtggaacttccgtactgttttccataatggaggtattaatttacattcccactaagagtgtacaatagttgccttttctccacatccttgccagcatttgttattttctgccttttgatgataaatattctaactgggatgagatatttcactgtggttttgatttgcatttctctgatgattggtgatgttgagcattttttcatgtacttattggcttcttgtgtgtcttctttagagaaatgtctactcagacccttggcccattttttaatgattatttgttttctgttgagttgtctgagttctttacatattctgaatattagtccttgtcagataaatggtttgcaaatattttctgccattccacagattatgtcttcactctgttgattatttcctttgctatgcagaaaattttcagtttgatatagtccgttttgtctatttctgcttttgttgtctatagttttgaagtcttacccaagaaatctttgcctagaccaaactcctgaagtatattccctaggttttctttccctgtagtaattttatagtttcaggccttatgttaagtctttaatccattttgagtcaatatgttttgtatatggttagagacagaggtctggttttattctttcacatatggatacccagtttcccagaactctttattaacgaggcacttttgttaacactttattaacgagacacattggggaatgtatgttcttggcaactttgttcaaaatcagttagttgtaaatgtgtgaattcatttccggttctctattctgttccattggtctgggtattggtttttataccaatatcacattattttggttaatgtagctttgtggtatattttgaagacagggagtgttatgcctcgagctttgttcttcttgctcagtaatgctttggctatttgaggtttttgggttgttcatgcctctatatgaatttcaggattttttttctatttttatgaagaatatcattagtattttaataggtgttgcactgcatctgtagattgctttgggtggtaaggtcatttaaaaatatcaattcttgcaatccatgagcttgggatgtcattccattttttgtgtcctcttcaatttctttcgtcagtgttttgtagttttgttatcgagatctttcatctccttggttaaatttattcctataatctttctttcttccgtcctctccttccccttccccttttccttccttccttccttcatttctctttctttccctctccttcctctcttttccttctttcctctttttcttttttcttccttatttcttttttctcccttctttcttttttctctttctttcctttctttctctctttcttctttctttttgttactcttgtacagaagaaatttttaccatatcagattagttctctcattcatgccaatatcaagtgagcctgtattactctttaaaaagtcataaaatactaaatggtaacactggtatattgaataatcagccccaaagatagtcaggttctaattcctggaatatgtgaatacataactttacaaggcaaaagagactttgcagattttaaggatcttgagatgaaaaaattagcatgggttattcaggagatccctaaatgtaatcacaattgtccttattaagagtgagacagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccacagtccggcctgggcgacagagcgagactccgtctcaaaaaaaaaaaaaaaaaaaaaaaaagagtgagacaggggagacttgaccacatagaggaaaatgcaatgtagtgacagaagcagagattggagtgagaatggaggaaggggccacaacccaaggaacatagacaaccactagaagctgaaaagggcaggagaaagaattctcccctcagagctttcagaagcaaccaatcctgccaacaccttaactttaggccagtgaagccaatttcagattcctgacttcaagaaaataaacctagaccaagatggtgaaactccgtctctactaaaagtacaaaaattagctagatgtggtggcgggcacctataatcccagctacttgggaggctgaggcaggagaatcgcttgaacccaggaggcagaggttgcagtgagccaagatggtgcaccattgcactcccgcctgggcaacagagcaggacttcgtccccccatcaccacccccaaaatcaagcatacattttaaccacagttgaaaccctcaggattttctcagagattaatgacttttcttttatattccatacagtcctgacaagatacttattagacccacagcatatttagaaaaataagttacacatgggtacatggagattctgggaaactggtaacagaaaatgccctgatttttacaagaagcaatatctcagagtaaggaagggaagagacacagaaaatattagaacataatagcttagaatcaattgtgcaagagcagtgctgtatttccagttaatggtgaggacaattattgcattacagtacaatcatcaagattgagcacaactgtcccaagtcattaaataaatgctcagcatattctgcttaagaatgtaagtgaaaataaagaaatgtaagaaccttgttgaaagactcttagacgtgattaaaataaatattcatgctcaaagatgtaagaacgcatcacatgaagtgtccacctatgtacagtacctcattactaatgctgttggcaggacattgtaaggcccattgtagatgttcaattaacatttggtggctaatttcatgaatgaataatacattaaatgaatatcatttgttgtagatatactgctaataaggtcagcaagttatatgtttatttagattgtacataagagaaatatttagaaattattcacaggcaggtttggaagaataaaatgagatattaaaatactcagaaaagcaatttagaaagtccatttttatttttaattaattattattttcttttttttttttttttggctcagaaggtagaaagtccatttttaaaaagcctacttaatgaagtaaaaaccatgtctgctcactgaggtttttggtgttagatgtaatagagctagagcaataacctcattgggctataaaatgaaagtcccataccagagattgtattctaattcccttaaaagtttttcaagtgacctaacccattcatctcactcaggctgtgtgtgtgtgtataaaacagtttgaaatatcctcagcacagctctcttgaaggcagtctagcttcgggagtaagcgtactagtgaaaaagcttaaattgcaagaacagaaaattcagagaactttatactattacagacccatatggtggtttgacagatcaaactaacctccaaagggaaatttctatttgaatagtaagtagatgatttcagacatgtgcttgaagttttatttagaaacacagactaatgcatctgttatcctaaatagtgaaatgtgacaaaaagtctttcctttcctattcttagaaacatcccatatagccatctgtttatcagtttcctcactttttaaaacactactgtacattttattagcttgactggcatgtctttagatagagtgtcaagtatcaaattaggaaatggactttgcaaaattggttacatgcagtaaaagctaaagaaatgagtgtcttttatcatatttaaactaatttcaaactatgaactgacatgactttaacaagctaaattcccaacataatacatagctagaatggacatctgctgtttttgcctgtccatttccccctttctcctaaaaagcgtccgcacaactacctttctccctctctcgcaatatgaagttattatagggctaactacgctgtctattttagctttggacaaatgactgaaacctggtcaatgagagtaacacaatcttttggcaacagggaatggtttaagggtaacatacctgattaggtaactcaagcagcaacagccctggactttcaccggagctactgataagtaagctcttgctagctaagatagtaggatgtgagcctatagctcacatatatatatgtatagtcacttcttacaggcagcatgggtgaaaatgaagtttaagtcaagggaagctttgaatataaaagggctgacagatggtggggtaagcgttttagatgttacaaatgaattttcttgtgccacagttagactacatttgtatttttagttcctaagtgaataaatacctcccttactctccctttttaaactcaagcctgtttaagaaaaaaaaaaaaaacaaacgggtttaactcacttcaatcaagatttcaggccaatacaatagtttctacaattcactactttctttccaaatgactttgccattagcaacaattgaaaaaatggagctgtgtcttctcagtaagggcttgattctgatactagagatcagcgatgtgagttgtgtggtctttgacaaactcagtcttctgagactggtttctttatctgtaaaatatacataagaatttgtatcttgaagagttgtagtgaagattaacagtgtgttaaacatctagcaggtgaacacttgataaattgcattttcttttcctttttggagaaatagagggcttttatgtatttatttatatttcacaggtatgaaaatgacaaaaagttcctctgagaaggagttctcaaattcaaaagttaaaagtaatccttaacactccagtaatatattttttttttctttttaaggtaggaataccctctgttgggaaacataaaattttagaaatcggtcactaataaaggatctaagtaaaattatttcacaaagtaaagcctttttaaatgtacattaataaaaggtgtagtctctataggcctagggtttgcactgaagtttttctatgtggtttttattgtttgttgattttaattggtttgaggtttttggcccttgttttcatcttttcttttccatcagtgacttactcaatctgattttctgtaacttttgagtcacatatttctgggatactatagtcctaggaataacatgagaactaggtgccctggtaacaaaacattttgaattggttttaagtagaaaaatctatttaagagagaattgaatgtatataagtcatgtggtttgctatccactgatccaataaactccatgatgaattcatgtagcttgtaagttcctaaaatcatgccatctaacataaaattttaggatattttaatttttctttttcccttgaaacccaatctagatgatattatcatataactgttatttacccttctgctttgttcaattttgttctagtagtggtcaatgtagacgtatcggttatactagtggtttaaaagtagataaaaatcaactatcactgaaatattcacatacttttacaaactaaggtggatacttctcttatgtggcattagaaaagtaatgaatgaaaattacagtctataaactcaaagcaattcattgtaaattaacccactatttttaagaaatcataaaattctgtaagtaaattgaattgaatacttgttaccaagattaagtagtatgatgatgtggcataatatttcatatttaaaattttataggcattagagtttacacttagatgtgaggtaaattcattaaaatagtatttatgggtagtcagtgtaacggtttacattatgaaagattctttagcagaaaaagaagctctaaaaaaataccccaaagtctgccttggcaagaaattaagtcatatggaaaaaaccacaagttacaataaaaattcacttgatacagtaatatacattattccttctgaattgtataggcaaaaaaactccagctccctaagccaacaaccaaatatttctgttaagttcatatgatttgttttcagggcagaacctctgcaagtttttatagtgtaaggactgaccaatataacgaaaattagttatccaatctagatgcaaaaagacaaagccatatctctgttgtaatacagaatcacaaaagtcaccatcagcacgcattgtaatatgttactttatgtaatatgaacagaaggtaaacttacaaacgctgtcaaaataattgtccataacatgttttatttgggcttctgttttttacccatgggcaactgtaaaagaaaacatgcagtgcctactttctcaaagggtaatttttatctttgtattaagaaactaaaaaatactcatgctttttcgagtcaataattccacttggaggaatgtaatcagaaatgtataaaatcatatatatgcaaagactgtcattctattgttattcataataacatgatttttaaaagaatttaaagctcatcaacaaattagccaccatctccattgagaatctgatgaacactaagtagagtctttagcccagaaatatccacctatgcctatccacacacataggcacaatataaacatgatataaaaattacattgccatctaactttgaaaactattacaagactcagcaattgcatgatatataggaatagcttttagaatgatggaaggaagagaatgcagttttcagagaagtaaaaaaatgctgtacacttactgaaattaaaatgactggtctaaagaacttagcgagatagcagataaaattcaaatattacaggctatgaagagtcttacataccattaatatgcttatttccattctttatattcaaagataacactactactgtttgtttctatatgtgattcggtatctgcaaagatcaatgagtaaagaagtgctagaagtctaatctttgatttgatgttgtaactgaccgacaaagcctgaagcaatttgtattttctcttgttctatcaaagtgcaaagtaccagtcatttattcatgtaatacaattcaatttcataaacattctcatcaattcaattccataaacatatctactttgtgcaagacttaggtgtcagatattaaaaagatgaataaaacacagaaactgtattccagggacctcaccatattaaggacaattcttaagaatttattttcaatagttagaatgtatactgcatgaagacaccttttttccccctcagtgatatatccaaagtacctagaacaattacataattactaagacagaggaagaatctgaactaaggttgacctgactctaaagtccatattactagctgatgtgttattcagctcttctgtactctgaattcttaccagtcacctgattaaaaaggtgctgcttctataatgtataaaattatatacctgaaaagcaatagcaagcatattccataataattaacacagaagagtcacaagatagctaaatactatgacaactatccttcagtatttttctttttagttttctatgtatgcacacatcactaaataatacattgtttcattttcctgtcttttagtattgtatacatagaattatactatatgtgtactttgttgacttgctatttacattcaacataatactattgagactttaccatgttagtgagtttatatatactaagtataaatattatataatatactctgtatatactgcatatagtatatatgttatataatatggtacatatatatcagtatattattgtatattatacatatgatatatactatacattctagtgcattatacagattacatatataatgaaaattacaatgttatccttggagtccatcatactatatataatatataaaatctattatctatataatataacatgctatatatattatagtgcattcactataacagttttttagtattctgctctgtgaatatatcctagtttttctattcttccatgaatgggcatgtgggtcatttccaattactctgcaattacaaatggtgactacttatgtgcatatctcctagttcgggtgtgtaagcttctcacgggtgtatgtctgggagtggaattgctgagtcaagtggcaagtgcatacattcaattttttaaaatgatgtgagttattttccaacattcatgcaccagtttataaatacgcactaagaatgagtgaaagggctattgttttagtgctcactacgtgtgcatttaaaaattaaaaataggatggggtttgggattcacacctgtaatccagtacttcgggaggctggggtgggaggattgcttgagcccaggagtgcaagagcagcctgggcaacatagtgggactccgtttctacaaaaaaataaaaaattagctgggtatggtgatgtgtgtctgtagtcccagctattctggaggctgaggcaggaggatcacgtgagcccagaaggtcaaggttgccttgagccgtgactgccaccactacactccaatctgggtgccagagttagaccctgcctagaaacaaacaaacaaacaaacaaaaacaaaacaaaacaaactagcttcttttgaaactttcctcaagagagataatatacattggcacaggggtccgatatgtcaatagtaatactttccgttgtaaatatttcatatctctgtcctgcttaaagcataaaagttgtcactcacagtggccccatgatcaagttaataccccttgtagagctcacaagctctcctgtttctgttatggcctgccttcttctccagtgtcttctgccacctctgtctctctctattgctttcctccgtctctctcatatatgccagggccaaactgaagttctttcatttctccaacaagatttctaatcttaacaatcagttcatctgcctcttgcatccctattcccacacctaggacaagcaagacttcccactacgtattcccatccacagtttggactatggattttaaaaagtggggatcagacttatctcattcaccactgtatcttctttgcatagctcattgtctggttcaaaccaggtcctcaataaataattaaataaatgactacctgtttctagttaaaataaatgtgtgcccatgggaggtgtcccatccattcttggtattaaaaaaatgtgaatccctatgtctaagtatcaaaccctggaccacaatgaattcatcaagagctatgtacagggccctcttggaccatggagtctttcctgggtattcatgcctaaggtaggaagtacctaagccatgcatatcttccttaatatttgaaatatcaacaatttcccacgactggaaagccatatatgaaggagatgaggctagaaatttgggtcactagggatcctgcctgctgcgttactaagtttagattacatcctacagaaaatgagaattactataagatttaagtttaggcaagtcatgattaattggtgtttaagatgtacttgttagattgctttcagaggaataactgttgagaaacaaagattcttgctggaaagccataatgccaactttgactttacactcactacattctaatagatgagtgagtctttaatgttttcctcttgacaacattttttggattgatgccagattcccgaagggcatttctggatggaaagttttaaagcaataaaaatgttctccaaggacataagactatttttaaaagttttgaaagtggtactaatatcaatatagatgtttattggagacacaggtagaaaacaagaaaagcaaagtaatatttttgaatatatttttcaatattttgtatttcacaattggtgagttacgcttagtaggcattttttccaggttgtataaataagaaaatgtaactaacatgttattctccctttatcctggtaatcattttttcccaacttctaatttggagaagccaacctcgcaagtttagttaattttatctctgtgttttgcccccacttttccctattctcctacaattgtcactcacatgtctttttttccatttccacaggtaccacttcagcttacctcccgatgcctgaattgtaacaaaagccttccaacagtttccttctctacattttctctcctctctggtatattcccaacacagatgtcaggataacttcccttatataattttcatcacattttctctttcagataagaaccaccagttgcttcccactgcctggtttatcagtgtgcgttcaccataatgtttgtggtaggccactaatatatgaccttgctcccagacgaccaggcctccaaatttataacttagtacagtgtcttctaaaatatctcctcttttcgtagaagccagttctctctgatcaatccctttatttggcctgctcgttctagctacctataatgcctgcttctcaagagccttatagaaatgtttctggctttatctcatacacctctgatcacttccgcaatctgtccgtgaaaattcattgcaatgttctccttggagtccatactcaattatagatgagacacttgctaagtgaatttctctttgattttgaatgagaatagaccccacacacagaattcaatgcacagtacattataagatgaattgacatcatcactatcacgcagtcccaatgcatccaaatgccaactccactgggggtaaaaaaagaacaaaaaaacccccaaataaacaaaaaactaggtccttctagtgtcatcccagaactgaaacatgaccctgttattgcatttgttaacttgttatatagtccttgaggctaaaatttacgctgcaagaagagtttcttcttgtgtagaggatacagcgccacacaataacaatgactgacattagtaggttttcaataaattaatcaatccatccagttaataaggagtatacattatgtgtcaggtattgtcttatgtaaagcagatttatcagcgaacaaaggaacttaattctggtgacttgttagtttcctcctaaaggttgagcctccctactgtgaacatttgaaatccaaaacaccctaaaatctgaacctttttgaacactgacatgatgccacagtggaaaattccacacctgacttcgtgataggctgcagtcaaaatgcaggtgcacaacacacagtttattcagtgtcctcaagggaaaaatacagctatcttcaggctatgtgtataaggtgtatatgaaacataaatgaattttgtgtttagatttgggtcccatccctgagatttctcattatgtatatgcaaatattccaaaatccaatttttaaaaaatcccaaatctgaaacgcttctggtcccaagcattttggttcagggatactcaagtgtacttattgctacttatttgttcacttgttttctgaaatattctatggctatgactgcatcttatgcttttttgatattactccacagaatgggagctgtttgcatacatggtagtcagtgactatttgctaaatagttgcatggaatgttagaaacctaatgacttagtaaaacttataaataagtgagactactgccccctagcctaaaattcattccctgcgctcactcaacatcatagttctttaggaagacaagttgttctatagcataaagatacaacctatttagatagtctaaagattctcctctgtttctcaaatacagtcagttatgcagctcaaaatgcctctcattttcctgcttttttttcttctactattgttgcctccaggctttgcagaaacacatgttattctccccctaaaatctgttcctcttctagttttctctctgccagcaatggcaccacacagtcttttggttttgcaccagagaattagagatgaacccctcatctctaatctatcacaagtttcctcagatttaaactctcaaatcaagatgtttctcaccatttccattactattgtccccagctaatattatattcttcctgggactggaattagtctcctaaatggcctccccatttccatttttccccccaactcttctccacattactgaattttccattgaaaatacaaatttggccaggcacggtggctcacacctgtaatcccagcactttgggaggccaacacgggcagatcacctgaggtcgggagttcgagaccagcctgaccaacgtggagaaaccctgtctctactaaaaatacaaaattagccaggcgtggtggcacatgcctgtaatcccagctactaggaaggctaaggcaggagaatcgcttgaacccaggaggcggaggttgtggtgagccaagatcgggccattgtactccagcctggacatcaagagcgaaactccgtctttaaaaaaaaaaaaaagaaaagaaaatacaaatctgtccatgtattcccagcctgcttaaaaccctgcaatcagagctcttagaataaaactaaaatttttaacatggtccattctacccatggtaagcagaattttggcccccaaagatacccatatccctggagccatgttatgcaaggggatattaaggttgtgaatcagttgacctccagatatggcaatttgtcctggattaccgaggatgacctaatgtaatcaggaaaatccttaaaagtagaaaagagaagcagaagagccagagaaggagatgcaaggacagaaaaaagatgagaccttgaaaggagaattcaatccatctcattttctcaattttcatctcatttataaattctataaagttaagggctgcgtttgcttttttgcctaccaatgtatccattgcagacactcagtaaatagtttctaaatgcataaagaaactactccggataagaactcttacatttttatcagataaatcactgtattacttaaatatgcttatcttctttataaaaactgaatggtgcccctaaaaagagaccaggtcttaaaccgtgaaacctgtgaatgttatcctatcagtaacatctttgcagatgtgattaaattaaggtccttgaaatgaggttatcctggattatccagttgggcaccatatgtcatcccaagtgtccttataaaagaaaaagagagagagatgagacacagaaaagaacacagtgtaacaagagaggggcgtatgtagacgtggccacaagtcaagaaatgccagcagtcaccagatgctggaagaggcaagaaaagggttctcccttagggttttcagagggagtcaggtcctgctgacactttgattttggctcagcaaaactgacttcagacttctggcctccaaaacctacgacaggatacatttctgttcttttaagccaatatgtttttgataatttgttaccacagccacaggaactaaacgaatacactctcctttggatttctaatcatctctttcctttctggaatgcccttcttccttctcttcatatttcaataaatgtttactaaataaagaacaatgaatggccaaatcgtatagttcctccaagtgtcatttctttcataaagcattctctgaatactttaggccacgtaaaactctcccatctgtgtgcaaagataatacatgttatataattttgcaatctgggacttgtaaacccactggtatatttttcttattatcccaaagaagcaatgctgtgtttaatttttcctggtgtccctcaaactgtgcacgaagcccaatctatgggcacagaggacctggaatgctcttcccccgatgtgcgtagggctctgtagttcacttccttcagatgcttgctccattgtcaacttatcagagaggactttgctgacccctcatccctctactttcttaccgtactgtattctactctagaacacttttcataccacctgatttattttttatatacgatgtcttttacccttctacaatgagacagcgaattccaacacggtaggggcagtgactagcatatagtaggaattcagtaaatgtttattgggtgaatcactgaatataaggaaatgcctaaatctttctattgccatcagttgactaagtagtctgaacacaggtcattaaaatggtagctcctaacatttcaaatactatctctgaatttgatcaagactcagaatttcaactccagtagcccctttattaggttttagaagtcaatgactcattacgaaaccacttaggttaaaaaaagaagtctttttctttcatttggttacaaggaagtattgaaagttgagatgagaagaataaattatggaatgcagctccctgtctaatatttgcattattatgtttcagacatacattgcttaatacaatgttaagcaataacaaatcaacggtggagtgaactaacttaaaaaatggtatttaaccaaaaaaaatctgtattaatattatattctttattctatttccacaaatgagattcaaattcattttactttcaaataactaaaatgtttgattgtgaagctattatacaaaaataattcagataatcctcattctagcagatacatacaagatgtagctcagaagctgagttcagacaaaacaattttatgcaaaggctaacaaacatatgggataagttaccaaaagagaattgctgaaacaagaaacaccaatatgttctactgagaacaaggcgggtatttacatatgatccaaatgaggggtgtggaagaagagtaaaataaaaatttaagaccactggaattctccccagcaatgtgtgcctgaagtaaactcattgtctttactataattaaaagacaataaagtattctatgaccttcttaaatatgtttattgttgacatttgttagatcccttataatgaaatctgtggaccacccaaatcctgttattctaatataatttgtctaaaattaacacattattgaaaatcatattcttagtttgtacatcttagaaacagctgattaccctctttctgtgatgactagtctttaccttgtggggtaaaaaagagaaattgaggagataattcaaacttccccactcctttgagcagaactataatcttaaatggagcaacagtttgttttgatgaaggagtaagaaggttgactagcaattatttcatgctgtcaaatttgaagaacaaacaaccaagttaaacgcagtctctccaaaaacaaaggcaaataacacataatcaaattctttcttatagaaagtgacttttccatgaactgagaccaaagaaagcactcactgaatgaaatttatagtaaccagaataacaaagcattgtctcaaactttcatcctctggaatatggaaaaattcttattattttactttgaaagaatattcagtaatggaacttattgtaaatgtgaaagatctctctgtgattagttagttcagctagctagatcaaaacacaaataagtctgaatcaggtatataggacacactctcatctttcttttctagcacataaaatatgtcattagtgataggtaggaccaaaccagagataaagggaaaactattttttaatccatcatcattattgctaaaacaaacaaacaaaataaaaagttcatgatctattaataatgggtgaatactacttcattcaaatattattttgactgtctcattttctattaattcttcaagctactataaaagggctctcatttattcttaaaagcaccatttccctgccaacttctgagtccaatggacattttaaattgcttcctaacttgacctgtctgctacacagaatactatgaaccatatcctcaatttttctattttttccacagcaacatcctctccttttacctctccaatacctcatttctctatatgcttttctggttctacttcttttaccatccccttcaatgtgaatcctctccagggttctatctaaaactctcttcttattctagacttaacctctaaacaacaacaaatatgaaaacggctctgacaagtacccatataaaaagaactcccaaattggccctcccaaaagaaaccacccttttgctgattttacgatcaaaattccaatagtttattagaaaacttggcccacatatcttaagggtacttcaaaaacagcatctaaatctaaacttgttattgtcttctattttcccagagattgaagagcatgagttttgaagccagataaatatccagctctgtcaccacctagttacacagctttaattaatgcatttacattccttgagaattgcttcctagctactttgaagggccattattatgagaattaaatttgattatataatggcccttcacaaacatgttcccgagtttagttttctcttttttgtagaccctctccgaggaccttacagtcattccagaaatttctacttctctctgcatccataaccaatagtaacacaatctaaaccattaaccatcttcatatctccagcatttaccccttctgtataactactgctctcattttaggtggatgcctcctcattctctaatgcaactgcccatgtatatccctgcttctaactgaatctttaaaccactcctctgaaataaaaaatactgtgacttcttgatgttcaagggctaatgttttatgttcttaacatagggccagcgtgccctttccacttggcctccacctgccttttcaagttttatcaagtaccagtttccctggtaccatatgctacagtcaccaactactgatgttgtatggcctgtgccctatcaaaggtgcagaacctgtctttgcgcctttttcctagaatcggatacagtgcctggtagaaagtatgcacagaacaaatgcttgttgaattaaaagtttctacggcttaatactgatttttaaagtatttatggctgctgaaagagtgctttctgagacctaatgtgaacgtaatattaaaaggtcaaaaaaggatttttttctccttactcaagactaattatcccaacagtgaaagaaaactctattataagtaattaaaatagccgtaccagaacagcttagtaatacaattcaattaaattaagcaatatatgttagggacagacaaaatattatacaaagagagagagaaggccaaggcgggtggatcatgaggtcaggagatcgagaccatcctggctaacgtggtgaaaccccatctctactaaaaaatataaaaaattagctgggcgtggtggcgggcacctgtagtcccagctactccggaggctgaggcagaagaatgatgtgaacccgggaggcggagcttgcagtgagccaagatagtgccactgcactccagcctgggcgacagagtgagactccgtttcaaaaaaaaaaaagaagagagagacagccctaccttaaacataagctacaaactgctgtgattccatcagcctacagacatttcagcagtagttacagaggggactgacaagaagcagtttgtctgaaagatggaggagacacgtagaaacacctcattctaagaaaagaggggatcaagttttgtccattaataaagctttagcaataacaaaaatgaataattcttagtagaacatgggatgtgtaattaggattcattgccagtccagagataaaggagagatatcagtgacttaagaatgagagagacaaggctggtgctatggctctcacctgaaaccccagactttgagaggccaatgcaggaagactgcttgaggccaggagttcaggaccagcctaggtaacatagtgagaccctgcttctataaaaaataaaaaggctagccaggcataggggtgcatgcttgtggtcccaactgtttgggaggctgaggcaagaggactgcttgagcccagaaagtcaaggttgcagtaagcctgggcaacaggtgagactccatctctaaaacaaacaaacaaagaaaaagagagagagagagatttaaaataaacttgtaagaaatgtttcattaaaagaattaaaaagttattagaaaacttgaccccctttttttttttttgagacagagtcttgctctgtcacccaggctggaatgcggcggcgcgacctcagctcactacaacctcagcctcccagttcaggcaattctcctgcctcagcctcccgagtagctgggactacaggcacgtgccaccacgcctggctaattttttgtatttttagtagaagcagggtttcaccgtgttagccaggatggtctggatctcctgacctcgtgatctgcctgcctcagcctcccaaagtgctgggattacaggcgtgagccaccgcgcccggctgacccacatatattaagggtacctcaaaaacagcatctaaatctaaacttgttatccactattattttcccaaagatcgaagagcatgagttcaaatcaatcctcaatctttttaaatcatcaggaaaatcaagtggcaaaaaacagtgccttaaaacctaatttaactagataaacccaaagaatgccatgtggttccttaagtttctaatgcatcagcagtggcaccagtgaggagtacacagccctgtgggagatggtggccatgcccatcaataatggaggccagcggcaccacagcagtcagcagggacagctgggaggcctctgcaaatgtggggtgcaacacaactaagcaatgaggcttaagaattgtggtggctggccgggtgtggtggttcacgcctgtaatcccaacactttgggaggtcaagatgggtggatcatgaggtcaggagatcaagaccagtctggccaacagggtcatctctgctaaaaatacaaaaattagtcgggtgcagcggcgagcacctgtaatcccagctactcgggaggctcaggccggagaatcacttgaacctgggaagcgaaggttacagtgagctgagatcacgccactgcactctaacctgggcatcagagcaagactccatctcaaaaaaatcgtggtggtacatggaatacacacagcaatatacagccaaaaaggcattggtatccaacagaggcagcaaagcctggtggcagaaataaacatactccaagcaaggatcagatagttcagctcacactaagtaaaaacagtgactagtgaactcccaaatttcatgtctatctggaatctcaaaatgggactttatttggagatagcgtgagtcaaggatttgaagatgaaatcagcctagatgtagggtgagtcctaatacaggactggtgtcctcacatgagaaaagagagagatttagacgcaaagacacagacatacagagaagaaggccatgtgaagacaaaggaagagaatagagtgctgcagctgcaagccaagtaacgctaaagattgccagccaccaccaaaagctgagacaaagaagcactcttccctacagcctgcagagcaagcatggtcctgccaacaccttgatttctgagttctaggctccagaactgtgagagaataaatttctgttgttctaaaccactccgtttgtggcgctttgttatggtagccctgggaaactgacatacgatgtttctttgctaattaggcacctgtcatatgcacattggagataaacgtttaggactcccctaaaatacttgcagtggcaggagaaaatactgctgaataagtagggcctgcaaaagcaaggaaggacacaagccagtaagacatgggtgttacactatcaggagaaatatattccactgagatttgtctgcatttttcttctaatacttgtttctgttatttcaaaaagaagatagtgttgattttctcagaaattccactgatacagaataatgagaaatcaaaactcaaatatcaaaaaagtgattagtaataaccatcattaatattaggcttttctgttaatattcaattcaatgcaacaacaaaatgcatattaatataacatttttcttttaaggtaataatttaactactctatatttctataaaattaagttcattggaaagtaaaagaatttgagtcatgacaactggccttaatgtttaatgtggattagttagataataaagatacaaaaaaggcacaatagcatacactgctcatgttattttaatgaaaaagaacatattcaacaatatgttctgaaattactaatttgcattttctaggaaaataatccactctcatggaacaaatgaatcatatctcattcaataaaaatgagagaaaaatagcacagttttgaggaaagactacaaacgttgataaatgagacatacttaattctatgtgacctgggccagattatcaaaacattctgcatcccagatttttcatcaacaagttgaaaggtcaagtaggttccttttgactctaacaagtcataaccacgtaagctaactaaatataatatataatactattttacccactatacagtaaaactgaagaaatagaaatatactaagggtacattgccaaatggttttactttttaaaacagttttcatttcaaaacataatcacatgttttccatccaatacatgttactgtttatatttgatggaaatgtattaaggtattatacctggtgtagaagaatggctcctttcttcaaaaggttaatgttctaataggagaaatcagactcaaagttagcagcatacattaagtctaagtgaatggtaaaaatgaagataattattatatggagtagggaagtattactacttaatgtgttatgacaatattatataagatgcagcatctgaataggatacgtaaaatggaaaggaattaaaataagcaaaaatcatggcaccaaaagctggtgaggatgtggagcaaaaggaactctcattgactgctggtaaaaatacaaggtgatataggcattttgaaagatagtttgtcagtttcttacaaaattaaacatatttttaccatacaatccagcaatcacactccttgatatttacccaaatgaactgaacatttatgtctacacaaaaatctgcacatgaatgtttacagcagctttattcataattgcccaaacttggaagcaaccaaggtgtctttcagtaggtgagtggataaatacactgtggtaaatccagacaatggaatatgattcagcactaaaagaatgagctataaagccatgaaaagacatagagaaaacttaagtgcatattactacgtgaaagaaactcatgtgaaaaaggtacattgtatgatatttagaaaaggcaaaagtatggagacggtaaaaagatcagtggttgccaggagttagtggggaaggagggataaataggtagagctcacaggatttttagggcagtgaaactattctgtagaatattacaatggtaaatgcttcattacatatctgtcaaaacctacagaacgtaaaacgccaagaatgaaccctaatgtaaactatgaactttggatgatgtgtcaatataggtttatcgattgtaactaatgtaccactttggtgggggatactgataatgggagaggctgtgcttgtgtgaagggaactctctgtacctttcacttaattttattatgaatgctctgaaaaatgaagtcatttttttttttttgaaaaagcaaagcttagtggaacaacttgggagaaaatgtatgctagggaaatacaaagctataaacaaaagcatggagttagaaaaggatcataactattaaggattcaagtgaaggtcagattgggcaaaacatgcagttctgaatcaataatataatatatctttaatgaatagtatgataaatgatttgcctaaatctgtatatacaacatgtatatgtacacaaacgttatacatacttacaaaatgagatcatactatacattcaatactacatacaatacataacttttaaaaaatgtgagtatctactcttagcattaactaatccttaatgttatcgttaaaaatggatatacacaaatttccattaaatattttcatgaatgtattcaacaaacttactgagtatctactgtgtccagggatgctttagatgcaccataaattatttagcactcttattctctactatggccaattatgttaattttacttgattattatcataaaactgaaatgaacattcagatatataaatctttcacactttaaaaaatgtgtttttcaaagagcaattttttagaagtagaatgctaggccaaaaggtgcttttatttataagaaatatatatatatatatatgtgtgtgtatatatatgtgtgcatgtatatatatatatatatatatatatatatatatatatatatatatatatacacccttataaatacacatacacacacacacacacacatacacacacacacacacacacactgcattctagaaacactgtatggaatgcttaagaatgcttatgtcgccacctcttacaaacacaatatattatcaccttaaaaaattcctgtgcctaagtttcttgcaatctgctttttttctaccttttcactccattttgctgttttgttcactcagcttgttttctctataagactttctaatctcattctctaatccctctcatctgaggccttgcattctgttcagtacttcaaatagtctaataattttttttctcagaaccttacgtacatacatggttttgaaagctgtgcttttcctctgagttttcaggtaacagcttctttccctgaaccctaatatttttaaaatagactctatattgactttttttccttctttcttgatgtttaaataaggcaatgactatcaagactcaataatctaacttttgagacctactgttgcaatggtctccaacaggggagatttgacaaggtatgaagacatttctgattgtcacgactggggaggggaggtcgtctggtgaatagcgaccaggcatgtggctaaatagcctacaacgtgcagtatagccccacaaaaacaaggaattatacagctcaaaatatcaatggtgctgaggctgaaaaactgtgttaaaggactaggttagttgatattcactgcttcacagcgaattcacaacactttgtctgcattaacacaatgcagttctactgggggagatattatgcctgatcacactgcttggttcttagaccctataaataagcagagtatatggaaaattatatttcccaacttcttattttccaaacttaattccaaggttcttctaggctttactgtagataatatagcttaaaataagcacattgtcataaccagttcacccctttggtcctgatgaattattttctagaaattattgcttataaattgacagagaaataaggctatctcaaaaatcagcagcaactttgtggaatgaaagcttaccagtgtaatgtttttttcagaacttgggtctctgagtcaggagagcagttggagtttaagcaaaagtatctttctacctcttttctggggatctttgattaatgaagtaaaccctgatttgattttcctcaattcagtttcacctgccttatggaatatctatcaagtggcttgacagatattttggtagaatattgagaaaggcttcattagtggctgcaactaatctacaattacaaatcatagcctaaactatggttttcagttatcagtaataatgaatgcatttaactaaactataattaatattataactaatattactagccctcctttggtatacttcatttctttattaaattaacttctactccaacctttccctaaaggagaacataagatgggcagataaaaataaaaatatactaataaaaaatagcattgattttaattaataaaggaagtctgtagaagaatacctacatatttgtaaacttctgaaactgtgaaggatataagagtggtaaaagttcacctgtttattcattttttcattcattaattcattcattcatccaactttaaattaattaaacactagtttaaaaagcaaagtgtaccaaacactaataaatcagcataaaatggacactatactgcttgcctctgtgaccttataatttttgtggggaaaaaaggtaacacctaatttcagcaactagggaacaatgttaaagtaaaatataagcaggtttacagtaaggtatagatagtatcaactgggtttccctcacagattggaacttctaaaaaagaattaaaagaatttgagatcaaaggtgccgaggtaatctaactgatgtaagaaattacaaaatactgaccttaattatattaaccgcaacaaataatgagtagaaaaggttaagatttatataaacttgtagaagaagaggcctggcaagcaggcaagatgctgcagttgtttactgaacatgaacaggagtggggagaagaaaatgtggtgcgctccaaaagcaagcaaaaaggactgtgtttcaaattggaccctccaattttataccttcgtcctcttccccacccctccttaacttgtgggtacacaaagaagtgcatgtgctacatctgtcttctgaggtcgctcacaatctcacttgttaaagaatgccatatctagaaagcatgaaaaaattagttacctaaaaaatgaaacctgaaaaaaattgatattaatgcaatggagaaaattgcttggtgaaaagaatgctgagtgaataaaagagaaaaaagagattaaaaaaaggacaaaaagcaggagtccctggaacagcattaagaaacatgatgccagagcatgacgttcaggtcacttacatggggattacttgcaggacttgttaaacagctgattgattctattgcaccaccttggaataacaaactcagaatctcttaggaatggggtaaaaaaaagtctgcattttaagaagtcccccaaatattttattaacagttggaaaccactggaattgagaatggatctagtcctgatggaaaagcaattttctgaggcctctgttctggtccattgatctatatatctgttttggtaccagtaccatgctgttttggttactgtagccttatagtatagtttgaagtcaggtagcgtggtgcctccagctttgttcttttcgcttaggattgtctcggctatgtgggctcctttatgattccatatgaaatttgaagtagttttttctaattctgtgaagagagtcaatggtagctggatggggatagcactgaatctataaattactttgggcagtatggccattttcatgatattgattcttcctatccatgagcatggaatgtttttccatttgttggtgtcctctcttatttccttgagctgtggtttgtagttctccttgaagaggtccttcacatcccctgtaagttgtattcctgggtattttattctctttgcagcaattgtgaatgggagttcactcatgatctggctctctgtttgtctattattggtgtataggaatgcttgtgctttttgcaaattgattttgtatcctgagactttgctgaagttgcttatcagcttaaggaaagtttgggctgagacgatggggttttcttaatatacaatcatgtcatctgcaaacagagacaaattgacttgctttcttactatttgaataccctttatttctttctcttgccggattaccgtggccagaacttccaaaactatgttgaatacaagtggtgagaagagggcatccttgtcttgtgccaattttcaaaggaaatgcttccagtttttgcccattcagtacgatattggctgcgggtgtgtcataaatagctcttattattttgagacatgttccatcaatacctagtttattgagagtttttagcatgaagctgtgctgaattttatcaaaggccttttctgcatctattgaggaaattatgtggattttgtcattggttctgtttatgtgatggattacatttattgatttgcatatattgaatcagcctttcatcccagggatgaagcctgcttgatcatggtggataagctttttgatgtgctgctggatttagtttgccagtattttatttaggattttctcatagatgttcatcagggatactggcctgaaattttctttttttgttgtgtctctgccaggttttggtatcaggatgatgctggcctcataaaatgagttagggaggagtccttctttttctattgtttggaatagttttacaaggaatagtaccagctcctctttgtacctctggtagaattcggctgtgaatccacctggtcctggactttttttggttggtaggctgttaattactgcctcaatttgagaatttgttattggtctattcagggattcaacttcttccttttagaattaggagggtgtatatgtccaggaacttttccatttcttctagattttctagtttatttgcatagaagtgtttacagtactctctgatggtagtttgtatttctgtgggatcagtggtgatatcccctttatcattttttattgcatctatatggttcttctctcttttcttctttattaatctggctagcagtctatcaattttggtgatcttttcaaaaaaccagctcctggattcactgattttttgaagagttttccatgtctctatctccttcagttccactctgatcttagttatttcttgtcttctgctagcttttgaatttgtttgctcttgtttctctagttcttttaattgtgatgttagggtgttgattttagatctttccagctttctcttgtgggcatttagtgctataaatttccctctaaacactgctttagctgtgtcccagagattctggtacatcatgtctttgttctcattggtttcaaataacttaattatttctgccttaatttagttatttacctagtagtcattcaggagcaggttgttcagtttccatatagttgtgttgttttgagtgagtttcttaatcctgagttctaatttgattgtactgtggtatgagacactgtttgttatgatttccattcttttgcattggctgaggagtgtcttacttccaattatgtggtcagttttagaataggtgcagtgtggtgctgaaaagaatgtatattctactgatttggggtggagagttctgtagatatctattaggtctgcttggtccagagctgagttcaagtcctgaatatccctgttaattttctgtcttgttgatctaatattgacagtggggtgttaaagtctcccactattatggtgtgggagcctgaccatcggatctttgacaaagctgacaaaaacaagcaacagggaaaggattccctgtttaataaatggtggtgggagaattggctagccatacgcagaaaactgaaactggaccccttccttacaccctataaaaaaattaaatcaggctggattaaagacctaaatgtaagacctaaaaccataaaaatcctagaagaaaacctaggcaataccattcaggacacaggcatgggcaaagacttcatgactaaaataccaaaagcaatggcaacaaaagccaaaattgacaaatgggatctaatttaactaaagagcttctgcacagcaaaagaaactatcatcagagtgaacaggcaacctacagaataagagaacaatttttgtaatctatccatctgacaaagggctaatacccagaatctacaagcaacttaaataaatttacaagaaaaaaacaaccccatcaaaaagtgggcaaaggatatgaacagacacttctcaaaagaagacgtttatgcagccaacaaacatgaaaaaaagctaatcatcacaggtcattagagaaatgtaaatcaataccacagtgagataccatctcacaccaggtagaatgtcaatcattaaaaagtcaggaaacaacagatgctggagaggatgtggagaaatagaaatgcttttacaatgttggtgggagtgtaaatttattcaaccattgtggaagacagtgtggtgattcctcaaggatctagaattagaaataccatttgacccagcaatcccattactgggtataaacccaaaggattataaatcattctactataaagacacacgcacacgtatgtttattgcagcactgttcataacagcaaagacttggaaccaaccctaatgcccattaatgatagactggattagcaaaacgtggcacatatacaccatggaatactatgcagccataaaaaagaggagttcatgtcctttgcagaaacatgcatgaagctggaaaccatcattctcagcaaactaacacaagaacagaaaacctaacatcacatgttctcactcataagtgggagttgaacaatgagaacacatggacacaaggggaacatcacacaccagggcctgtcgggaggtgggtggtaagggagggatagcattaggagaaatacctaatgtagatgacgggttgatgggtgcagcaaatcaccatggcacgtttatacctatgtaacaaacctgcacattctacacatgcaccccagaacttaaagtttaataataaaaaaaaaagttggaaggtagcagaggtcagttgatgagatttcagaaaagaagtggtctctataatacaaaaatgcaaggtgaagatcaagtaccaattgagaatctgcagcaagttatccagaagatctagctaagataagtgataagggtggctacactaaacagattttctatacaggcatatagccttatgttgaaagaagatgccatctaggactttcatagctagaaaggagaagtcgatgcttgtcttcagagttttaaaggacaggctatcttgagaggggctaatgcagttggtgactttaagttgaagccagtgcttattttccattacaaaaattatcgggcccttaagaattatgctaaatctcctccgtccatgtctataaattaaaaaacaaacaaaaaaagcaattttccaaatctcatctaaagagtgtttcaaattgtgagatgtgacccattaggatcattatatcaatttagtgtgttcagaaagtttcttcattttgtaatgaaacagaacagtgaatatagtactaaaagattatatcctggcattaaggaaactattgtttcatgaaacttttgggtcagtcataaatatgtgtgcagtgtgtgtgtatccattgctactcacatgtactagataatgacgtataatgtatttcttatagaaggtcatggtcaaaaaaatgtgaaagcccctgctttatagaacatgaatgaacattcatgggcagtaggaggcttgaggaattcagttttgacctcaggaggaagagataggcatttgtgactcgtgaatccctgctgggtgttatatagtcttgccatgacaaaccagaaagtgtcatattatatgtgacttgatagcttataaaatccactggctggtacttattatttctgattcatgtggccacgaagaatacagtcaggaaaaaatggaatatatctatagtgactctgaagaccaagataggaagatgaagggcttgggagatacagtttttattttgtcgtttagctgaaattcaggacatttaaacagagagggggatatgggaagtaaagaactagctacacagatgatataggacaagaacgacttagttttctgaaccaaggatacaaagccaaaatggatttctggcagggaaaagaaattttctcatcaatcttgaaagagtaagtagcgcttgatggtcctacttccttcacttattcaattcctgtagtttggcttgaaatggtgtctccaatatcattagtgacctaactgccaagtgcaatgtcctttcttttttcttaatcttcatctttaatgttcttgaagtattttataaaaacattttctcttttcttgttcaaactcctttttgcctttttctctttctactcccctcctccacttgttggcttcttttttcctgctttcattcattcctactatgtgaattaactcaaatctctaatcttcatctaaatcttcatgggctttaacacgtcctttagaggctacaactgctcttccagacttcagtgtcacagtgtagccactgttctaattgttctgagaatggaactggtataaacaatcatgcacctgacaccaaatcatgtattttctccaagtatcataactctcagtcaccgtttacatgtctctttttttctctcaccctctttagttagatgccaattccttttaattctttgttcacgttggctcacatccaatcccttaggtaatgtaatgtttctacccctctttaagctcttattgtttcatatttcatatctagactctgactgtcaaacccaggcagtggaatggaggatacaagacattatacagtggaattcaggaataaaatattaaaacttccttatttatatctccatccctatctatttatatctatccatccaatctcttcatgttgctgccagagtgaccttactaaaatataaatttgctattgtcacaccctatgtacatccattaattatgtcttttatggtaatgtgcagaatccttagctacatgaattcataatctggttacttttctccactaatagcctagccaatcatcttgtgccattctctataagcacatgtattcctgtataattctcctactctcttcctctctgtcccctttctttgtctgcctagcatcctctttaggggatccagtgggtgagtatatgacccaggccttgccattcagagaacaaccacctctggccagagtgattggttcccaggaagacagctgactgaagctgagttaaggagaagtatccaggtgacttctgttacaaattcaggaaagaggcacctaccctttgggattgtttcgctggtagaaagatagatgggtgctggtggtggttatctttgccactacttgggaggaatctgtctgaggaaacacaaaagaaaatggaaaagagataaagccagatccctgtttaaaaacctctgctggccttttgagttacacgagccaaaggaagtaaaggaagtcctttttttgtttgttttgttttgttttttgttttgcctcatttaggatagtttgagtttatcttctttttattgcaactaaaagtgacctactaataagacctactctaggaaggctttgctgaccttctagtcagctttactaaacatccttccatgttgcatattgttgctcctccactcccagcattctggatctggtcacagagatagatgaaaactgtcctatcaaaagcctatcaaacaacagaggaaaaactgtacatctttggcaaagtccaaagttaattttctataaggatgttctccatcaaatttaatgagttacatagaagaaaaaaaggtcaattgaaagtgaaggatcctcaagtatttctcaataaacctaagtttttatttatatatatatttatatatatatatatatatatatatatatatatatatatatatatatatagcaataaaaaaaaaacaactaattcaagcgacagcccccctgctttcaacattcttcttcctatagcttgagttacaggttgctttaggccaacttcactgaaagcaagggcatgccaccagcatagaatatgagagccgtgagtaaaaacaattaggactgaaaagattgaactccgttttgttttctccacctgaaaagtttatacccctcttaactatggtgttaattggaaattaaatgtagaaagttctaagttgcctctggagaatattaaatttagctctagtctatctaaatctaatgagaagtttgtgaataagcattcttaaaacaaaatcaaaagaagaccaaatataaatttaccattctatgagcaagaaacagaacagaatcaatatttttgattagttactaaatttccctcctctggtcatcacctgaaatccaagatcacagtttttgctggttgtgggtacaactaagtcacctgtacagacctttcttatcctggcctaaccctaatatgatataaacagagcgaaccagatatactaacagaatatttagtcaggtttgactagttggaagtccattcattttcttaaattgcactttaaaaaatggtggcatggtggccgggcacggtgactcatcactataatcccagcactttgggaagccaaggtgggtggatcacgaagtcaggtgttcaagaccagcctggccaagatggtgaaaccccgtcactactaaaaatacaaaaattagccatgcatggtggtgggtgcctgtaatcccagctacttgggaggctgaggcagggaactgcttgaactggggaggcaaaagttgcagtgagccgagattacgccactgcgctccagcctgggcaatagagccagactctatctcaaaaaaaaaaatttaaaaaaaatggtggcttgtcatttttcctaaaaggaagtaatctattttggcctcatatttagtcaccactaataaatggagattaaaacttctcagggggctgagcacggtggctcacgcttgtaatcccagccctttgggaggccaaggtgggcagatcacctaaggtcaggagttccagacaccctggtcaacatggcgaaactctgtctctactaaaaatacaaaaattagccagaagtggtggtgcgcgcctgtaatcccaggtactcgggaggatgagtcaggaaaatcgcttgaacccaggagtaagaggtcatggcgagcagaaatcacaccactgcactccagcctgggcaacagagtgagactctgtctcaaaaacaaaaacagaaaccacctctcagggggataacataaagaagtagctgtatttagtgtgtgatttctacatgtaattcccattaatactagagaacaaatgtgtaaaaagctttatagaaggaagagaggagaaaatttttgaaagtttttactaaggcaacccaagatcaattttgaacaagaaaaagaaatcctttgtaaccaaaaagactaacaaggtaacatgtactgatgttagcaggatactaaaatgtacctttaaaaaccttttttgaaggcaagaactcttacgtaaaccaagtttaaattcaaggctccattgaatatctattctacctcggtgacagcgttaaaaaaaagtataaatagtaacaggagacctgtgttactgtttatagtttttttctaatgctatcaccacagtaaagtactttagattgataatttagatcttccagaaacatgaaaaaaattaagagttaattggtttttaattcacctagtacaagttttaaaaaggtaatttgtcatttctgatctgacatcgcttatgggcatggcaactatggaaggattatggtaggggatatagaaaatgatagggagaggaaattggttttgagtctccttagattgtacatcaacattcttttgttgctgttgttttcaggctttactgccctattcacatttatgcttgtcagcaaatttcccttggctacattcaaaaggcagctgttcatccacactcctcaatgaataaatatatcaaagccaattcttggcctggggacatgatctgatttctagaagagttgccagcttccttcttttaagagactcagtatatcacttggaccccagcagcttacatacttatttatttttgagttaactattactatattccaaaaacaatactacaaaagtagggtaatcaatgttgagatgccaaggctcaaataaacaagtaatgcaattagttaacatcttaaaataagaatgatgcagattccttcctaaaagtttataacaggtacaataaatgtggtacctttatgagaagaagtccggttgatcaagaatttgaaacaggcacaagcaactagcagaacctgtctcatgaggtccatcagtgctattttgagaagggaacaccatggacaaaatcacattagctacgaagcttttctaccaccctagatgaacagttagctctcacagcaatgcttaaagttacataatgagactgctgacaggggacagggagcaaccagactgcacaatgcaacttttgtttcaatgttaactgacccacatgagcagaaagtataataaacatggcctgtgactactagaggaaacaaatttagagacatgtttagaaagacagtagaaagagtattgtgacaagtggtaaaatgttttcaaaggacaaagttattgaaaaatctaacttcccatcaaggaagtggcaaaccttttaccagaaaataaaatttgctaattaagataaaattgtaaggtacaaataggtcatagttcagttggagaagaacattctagagagaaaagtggcaagatttggtaataattttttcctacagcaggaaaggggtcaaaaaaaaatacagtttctaaaatggccctctctgtctcaaaataatttatcttaacatgcattaaaattcatccttattacctgcttaaaggtctgggtttccaattgaagtgtatgcttcctgagtacatggagcttggcacataacaagggcaccatatatatttgttaaatgaataaagacacgcatgcattggtatgcaagtagaaaaatcacagcattaatgccatcatttatggctttccttcacttaacatgccttactgatatctataactccgtggtctactcagttgagagttcgcccactttaaaagtttgaagttattacaccaactaaaatgaaaagcacttactaatccaaacaattatggtattactataaaaccttaacaatgcatttatattttaaccaatagcagaggccagtaccaatcggttacagtgaaaactagtgactcaggtgtgtactattagcagcatttgctttttaagaatttctgtaaaacaattctaaataatgatgacactcaatttccaagtcagatgtgcaattatatgacataccacccatacttacaatttctcaattatcatgacggattttgtctacccatgcccccttatcagggggtttgggaggtcttttactgaagtacaaccctagactttcctggaatccaagttcatttaactgaaatgttctcagaactgaacagtatgtggtaaagcctgtgttgaccagggattgcagatctgatggcatgtggtaaatgcttacaaatggatagggaggtcttctgtgtacgcaaaggtattaacattgaattagctaggttataccatcataagtttattttatcccctcttcctttctttacccatatactctaaatctctcaaagacagaacagaacctgactttgagatatgaaaagatttaaataacaggacagagctcactgcacttcaaacacgtcactgtattttgtctctgtaaaatttaaagccttcagcttctacatattacatgaattaacatgtcagtgtatatgttaaaatattttttgcttattgtattatgagttctgagatataaatgccataggtgatatcaatcttgagaaagccgtgccattttctacatgagacacttgccaatgataaaaaatataaagttagatctcttatcagatcttacaactgcagtgataaatctggaagagtttataactaatataaatacagcctacatcatatttgggtatagacagacgcatgctaaacagcaactcaaaagaactaccagatcattaccttgttgagtgaaaagcttcaatgacaacattgattacatatgattttcaggtactatgctaagcacagccaattctcacaatagtcttataaggtattgaaagttattttccatgttttatgcatgagaggaaactgagggttagaaatgttactaatatgtaacattctcaaagtcacatagcaagtgctacactgatttggctatcttagccatttggctatcctgtctcttcagcacattcttcctacacatacaccctgagacattcagcaatattttatctacactaccaattttactccaaaaaaattctactcaatagcattagccgagtcactgctttgtcataaaaacaaaattcatattcttatctactgccttacacaggtctttccacagacccttcaacacatgtagcagaggaatcccataaaagccaatacagtgctacatagtaacccagcgtcactgaagacgtcattgctgaataaaagttcatttgcttgaagctgggcgtggctactcaatgaaatagaaatatgggattaagcaatggaactagtaagctttccgaaaggaatagtttaaaataaaacgtgctcccccccacagaaaaatcaacagcatccatctttcctcctcttctgctccattttcaacaatgccatggcattatttgaatgtttaaaactaaaaaaatctactggtttgttgtactattaatttcattgctggatcacccctagatcttaaagccatcatcaatatacttcaagagtactttaaagatacaggaggtcctggcaaccacagtggaagcaggaagttgctcttaggtaatgaatctttttaactggagatacagttctgattgcgatagagcctaaactgaagtctccctcttaagaataaaaacaacaaaaatagtggaaattgttttcaacgagaatatttgtatagctaagatgtcaaattatttgtaagaacttcagatgcacattttacctgtatacaatataaataaactgtgaatacaggttagcactgccctttatacaaatattctgaaattataattcttatcttttcattaaagcaggtttttgctaggcagttggacttcaaataaatatatgtattaagcaatataagtactttttcctagagtgctttatactttataattcaaaattttcattaatgttgcctctcaacttcaattaatgagatttaaaaaatgatcagaataaccgacaaaatatgaatgcaaagtgtcttgtggagggtgaataaaattgcttaatggactgaaaaacatcaattgcttaattatacagaatacattgagctgaaacaatatcactcagtttctattaaatcttccatcagcagagatagaagcttcctggctgcttggagaaacattttttccagatctaggaagactacatgattttcagatacgagcaacatgatctcagctgaatgcgtgggaaacatagcactgagaaaatttcaaatgaccctgtatcagagtacatttgttgaaacactgatgaaaaatgggtatgtacatcatttgtgagcacaaaaatatttaggaaagttagtctaattagtttatgccatgaaaagtggctgatttacatgttttatagtggcaaatctgcttgtttctgtttagaatagaaaatattaagcacacttttaaacctttaactttaaagtctaaaattgagtttatgcctaagaaataacattgcagtctctagagacagtaatttactatccttcttaattattggctaactacaattttttaaaatcaactatgtttgaagaattattactcactgtgaccctagtttttgcaagagtgaagacagactatcaaagccaatctctaccttgttcactcaacaatataagccatgtatccagcctttaatttgacagtgtgcagttaaatagaggatttgcaacactgcaaatcaagaaaaatggaaaataaagagttgtctatgtaactatattctgtagcttataatataatgattatttttccatacataataattagatggcagacaatgggataacatatcttttttaaaactgaaggaggaaaaataacacattagacatgctccttgtggtaaaagtaatctcatgtaggtcttaaggaccacattaatattagtaccagcactttacaatagaactttctgcaatgatagaaatgtcctatatctgagctgtcaaatacaagaatcattaaacaaatgtagctaccaagtacctgaaatgtggccagtgcaactgaggcactgaaattttcattttatttaacaaatagtcactcgtggccagttgcttgtatactggaaaagcagttctaaacttctttttgtaccatccttgacaatgacagtgttgaataattctatcactgtattatgttttgttacagtaataaacaaccccaatgtgtaattagaaattatttttcaccatgctccttgcagtcttcactacaggccccgggctgagagagcaggctctctaggatattgtcagcctcatgtcagaggcaaagaaaagagaaactgcaggctgcaactggctttaaacatttctgtttaaaggtaattcatgtcatgtccacaaatattttattggttaaaactagcatgacctctcttgatttcaataggatggaggctaatgtcacatagcaaaactgatgtcaacgggaccaggcaatatgatccacctccagggagaagtagcaaaagttttcaaaacagtacaatctaccataagaataaaattttgatttcagtcaatgaacatatgttttgcttcaaactgtttgccagataggatataaaatgaccctagatctgataatttgctattttccagccaccttccgataataataataaccacaatgatatcaatcacaataaaaacagcagtaacagaaattagaagaggaacaatagcactagcactgactgagcctcttctctgtgcgaggcactaccaaagatgttatacatagactattgcactgaattctcacaactccatgaggttggcatcgtttccctaacccccctacaagggaggaagctgaggctcaggcctgcagccagagagctaggaaactgcagagcccaattataatcacagatggttcacataggattggcctcaagtcttgttcttgtcccacaatacagcactggtaccccaatgcctggcatcagggttgctctttattaattgttataccagtatttagaggcagctccagtgccaaatttatctgctaactcttaccctaaactgcccaccgcctacatctctacaattccaaaattctcagcagcccccaatataaatatcacccatatctgcccctggcagaaagatactaaatcaattttctcaccacctttcttggaaaatgtgcacttctagggctcatttgccacctcacattgcggttcagcctagaatatgggttgacattaattatggacaataatctaggtaatacctaaaaatcagaaataggagacgccctctgatctagatgtcctaaaaaagatggtgagggcctcaagaaaagaaaagaaggcctcaaggccttctggcagcgggtgtcagaagcaatagacagagttcaggtcaaactcaaccctttgcagggcttgaaaacaaccaaactcacagattctaaggaaaccagtgcatcagagagtttagcaaattagctattttaacagtgagcaagctgagaaagagctatcagagggacatagccagcaagctgatattctggctaaaaaagaggtcacaaagcagagacagaatatgagggcaaaaaaaaaaaatactgtattaattattgaccacataggaccctgtgctgaacaactacttacaatagctctaagaggttgacattatttatctccattttgcaaatgaggaaactgtggccatggaaggataaattgattgtcctggtcacaaagtggtagagaaaggattcaatcaaagctaggtctatctgacttcaggaatgaatgcttgactatactccatcacttgactacagtgtgactgcaggatatctcagtatatcttaacattatcagtgactcacccaaaccttaaaggaggtttactttaacaaccggaaaccaatgagcaaacacttctgccagaagcaaagttctaaaacctgagaacagagtgaaaatctacaatcctacaatggatttgctctaatagcgtaaactttacaaaaagtcaactcaaagtagattttaggtcactttagatcatatcctgccacaacaggatatcctactgatctttacaaatgcttgagttgactcctttcaactttaattattaaacattctatgtggaaataaagaaaatttgaatttctgatccagaatgctgattctaagaattatttaggtgtcaagtgcttgaagaaatttgtccccattttaacgtgtcatatagaatacacctacattgtgcaagtagattgggagcagtgctgctttacatgactaggggccagtggggtatgtgaaacctggccataatttagaacagatacacaagaatttcccgatagcaccaatagtcaaaactaccaatatgagaccccctaggctaaagcaaaacaaaatctaattaattggtgatggctaagagacatggaagttaattaacttgggagaaaaggcataaggcagagactgaaagggaaaagaggaatgctggatttaattgactatcccagcttcagctctaacctctttattgtcaggcactttggcttgtgatagaggtacaatcaaactcatgctaccacacatacatttttagccttatgtggcaagcagcaaaagtaaaagtttcaaactccatataaagaaaaaggggataattcacaggttaaacatgatgaaaacatggtagtaaagccgtcttccaaatgacctgaatcactgtctaaacaactgctctttattccctaatctctcggggagaaatttatagagacaggcagatatagaaagatccttttctgaaaaaaaaattgttttaattaagtgggagaattgaatcaagatggctaagaaaatgcacatttctctgcttcaggtctaaactcaaaaaatgacagttgtgaaatgaaataagttaaaaaaaaatacagctacaccagcactagaaaccagaaaggatgccataaaatgaccaaagtgtgaaagattattacaactttcaaagcagatggaattatggagaaagaagggaggagtaaacactatccaaaagagagaagagaaaattacctttgaggtatgagtaattccagggcttttccaattgcaaagtcaaagagttatttaaaaatcaggagaggacaaccaccagggtagttaattttacaactctattaagctggttcaatcaagtttagttaaaatgagctgcagagggatgttatgtggccccaggataaacctctaaggaatccttttaaataaaacaatagtatgaaaagaataaagaaggacaagcatagattagatatccaaattctgctgacactggaagaagaaacaaagatagggaagtgcctgactctagcctatgggccaggacaaagcctgaagctgccttgtgcgaattggagttctaacaccagagaaacacactttctatgaaacaaaataaggcaggccttcctaatgtctgccctttaagaagtaggaaaggacttgattcccaggaaatcaacaacactcacaggcctctggtcatgggccccttccccagtcagaaccagtatttcttgaagaattatcacatcatattctgaaatacacatcaaacagaaatccaaaaatgatgagtcaacttgggacaaaaacaccatcactcattcattgattctacagatgtctgttgagagcctactgcataaataatggaaactttctttgtaagatgttagggatattgcaatgaacaaagtactgtcctcacaaagcatatattcaagtaggaaaagagagagacaaaaaaaaaaaaaaagaccaaacgcataaaaacaataaaccatgagtccaaggagaaaactaaagcagggtaagagggatagaaagtaacaaatgacgaagaacaaaattaacttcacaaaagacggaagaggagaaataaaatagaaaaaagtaagcactaataaacttccaatcagaatggcatagtaagttcaggctttgactgtccgtctttgtttcaaaaacacaccaagaataagtactatataaaaacaagaagccagaaagccacttccaggaccccaaacaaagcaaacatctgcatgaacacaaaccctcacagacctccaaagatgagcatggcaggacctgcttggttccagattctgacgcagtggacagggctttcagctcccacaagatatggagacccaaaatgctcattccagtagagaaagggacacaggacctttggttaaagccaggagcttcaggtaagggtacagacattagaaggcaggctgatgaaaaatgctgcctgagaccatgaggctgactgaagctgaaaggcagctacacaccttaaaaatgcgagcaacagtgtggccgaggggcttaataattggatgtgaatccagcaaataaattctccaaagaaagccagagtcaactataaaaaatgatttagaaatgtgggatagaagtaactataaaactgttagggagtggggaatccagagtaagaaggtgaaaacccaatagcaataactaaacaataaaaatgagtttttgaacccaaattctaaaataaaattttaaaaatgctaaaaagtcagccaacaaatcaatactcagaaatgaatttcctcgaggccgggtgcggtggctcacgcctgtaatcccagcactttgggaggccaaggcaggcggatcacgaggtcaggagatcaagaccatcctggctaacacggtgaaaccccgtctctactaaaaatacaaaaaattagctgggtgtggtggtgggtgcctgtagtcccagctactcgggaggctgaggcaggagaatggcatgaacccgggaggcagagcttacagtgagcctagattgcgccactgcactccagcctgggcaacagagcgagactccatctcaaaaaaaaaaaaaaaaaggaaatgaatttccttcaaattaaaatgaattttatatggtgctatgacaaagacttttaaaaatagtatcccgcccaaagtactgataatgataatgacactgatgatgaaaacaacagtgatgctgatgatggtgtcattcctgatgataatagtaaacagtatttaaaaacttactatgtgcccaacattattctaagcattttacgtgaagtaacacacttattccttgcacaatccccacaacagtctgtgaggtaaatgtttaaatgagtctgattctatcactgaggaaacaaaggcacagtcaagttaaataatagtctaaagaaacacagctgctatgtgaagagctggaattcaaacctaggcaggattccaccagagcctgtaaatttatctctctgaaagaagaaagaaaatttgctaaacattttgaaagaataagaaattgtaaaacacagaggcatatataaaacaaaaaattttttggataaaagagaaatattagaaaatgaaatagaaaactattgaaataaaaataaaatatgtgtcacaaattcttggctgaagagtaaattacagaattagaaaatgacaaggttgggggattcattttgaatatagaacagaaaagagagattgttaaaaataacatgaaacatcaattatgtcacatgaagaatagattgagaggtcccaataattgtacattaggagtccctgaggaagagaataaaggaaatgcttgacacaatacaggatgaaataatggatgagaattttaaaaattacagaaaattttgagttctcagatcccaagctggcctgaaatagaagatgggtgatatggtttggctgtgtccccacccaaaactcatcttgaattttagctcccataattcccacatgtcatgggagggacccgtgggaggtaattgaatcataggggtgagcctttcctgtgctgttctcatgataatgaataagtctcacaagatgatggttttataaaaggaagttcccctgcacaagctctcttgcctgccaccatgtaagacatgccttcatccttcctgttctaccatgattgtgaggcctccccagccatgcagagctgtgagtcaattaaacctcttttctttataaattacccagtctaaggtatgactttattagcagcatgagaacagaccaatatcctgggaaaattggatatccatatgcaaaagagtgaaacggtatggagatttctcaaataactcatctgtctcaccacatacaaaaattaactcaagatggatcaaagacttaaatgtaagacctgaaaataaaaatactagaagaaaatctagggaaaactcttctggacatgggtctaggcaaagaattcatgactaaaacctcaaaagtataaacaacaaaaacaaaaatagacaaatgggacttaatttataagcttctgtacagcataagaaaaatcaaaatagtaagtagacaacctgcagaatgggagaaaatacctgtaaactatgcatctgacaagggactgattgccagatttacatgaaagtcaaacagctcaacagaagaaaaaaaaacagaaataacctcattaaaagggggcaatggacatgaatacagtttttaaaagaagacatacaaatggccaacaagcatatgagaaaatgttcaacagcactaataatcagagaatgcaaattaaaaccacaataacataccatcttacagtagtcagtacggctattattaaaaagtcaaaaaatagcaatgttggcaaggatgtggagaaaaaggagcttttggtaggaatgtaatgtagtacaatctctatgaaaaacggtatggagatttctaaaagaactaaaaataagtataccatttgatccagcaattccatgagtaggtatctatctgtatgccattcttgcatggctacaaagaaacacctgagactggatatttcataagaaaagaggtttaactggctcacagttctgcaggctgtacaggaagtatagttctgcaggctatacaggcatctgcttctggggaggcctcaggaagcttctaatcatgacataaggtgaagggggagctggcacattcatgccaaaagcaggagcaagagagaggaggggagatgccacatattttgaaaccatcagatctggtaagaactcactgactatcatgaggatggcatcaacaggatggcactaaaccattcatgagaaatccacccccatgatacaatcacctcctaccaggactcgcctcaaacactggggattacatttcaacatgagatttaagcagggcaaatatcgaaactatattactatccaaaagaatcattatataaaaaagatacctttactcatgtgtttaattgctgcactattcacaatagcaaagatgtggattcaacctgtatccatcaatggatgattgaataaagacacagtgatctgtctgtctgtctgtctacctacttgcctatctacctacctacctatttatatacatacacacaggaatactactctgccataaagaaaaatgaaatcatgtcttttgcagaaacatggatggaatgggaggccattatcttaagtgaaataactcagaaacaaaaagtcaaatactacatgttctcacttgtaagtgggagctaaataatgtgtacacatggacatagagtgtggaataatagatactggagattagaaatagtgtgaggggggtgagagatgagaaattacttaatggatacaattgtgtattatttgggtgatggtaacactaaagacccagagtccactacagattatacagccatgtaagaaaactgtacttataaatttacgtacattttaaatttacataaatttacataaattttaaaaagaaataaaaataaatgttgaatctattttagtacacaaaaaaggaaaaatgaaataagtcatggaatgtaagaaatggaggattttttatcagtgagagagattttacacatactttgtattctttatataaatttgattcaatagtactaattgttaccttgatctgtaagaaaagtatcacattcacttgtttttctttctttcttttaacttctgctaaaccagagaatccttacttaaatcaaatggtcatcaggggaatgagtacagtcatttggtgagtctctaggatgttgtagataagtagatcaaacagagatccagaaagaatgcagggacatgctatagataaggaccttcagcattttgtcagatggtaagttatcagacataacacattaaaagctagaaagctaaacatttccactaaataaataaaagcaaatagatttattaaaggcagcctattaaattgattaagtctttttgaaataaatacagggaataaggctgacaggttacctctttatagttaaaaggccttggattgtaggtaagatactagtggtgtcagacaatttatgttctctgacagacttcctcatcagttatacatgtgtcatcattaataaaaatatcacaagacagacatctagggaagagtatcaggctaagatcaattcagtcattctcaaaccttgtctcatatcaaaccatcacataacataaactcatagactcttctattctttataaacaattaaaagttaaaatctcttttctctgtcaaggacaagccatggggaatgaacagaaataaacaggcaatctactaataacagacacaaaaaatgtagatatgtgtacaattcaaactgaaattcaccactctttttgcaagctgggtaaattggatgctttcctttaatgagccatggagaaagactgattgattacagaggatgttgctttatggtttactgttcacaattcactgatctccttattgtattgtctatatatagtaaactgttttctccttcttgggttttttgtgtatgggggggtggggggtagtggggaacgtagaggggacaggtggggtagaattttatgtcttcaaaattatcctcacatatcaaaactgacaggcctctgaagtttaaaagcacctttcacaattccaattcggtaaaagcaaaaacagagatttacaccaaagagatgacacatataaattctgaccttgaagactggggcctgccaattataaattacaggtttctaggcctatttttcttgcaatatcaataggacataaaagctagctactggatgtaaagtaaacaaatctatacaattcattacaaataaaaaaactcaagcaagctgggcaaaaatatttttagaaagtcttcacaagaagcatagaagtcttctcttgtttctctctgaaatttacattatcattaaacaaattttgagatacctaataagccaaaaaaaaaaaaggtgaactgaaagtgaacagaaaaatgtcttttttaaaaaaaaaatcacagaattgctgatgctatattcagtatattaaaatactagttgaaataatctaatttctataaaatgcagccaaaaagttaaccaatcaacaaacaaaagcaacatagctaagtctgttcaggtagaatattcagttacaatgtgcatgtgtgcatgtgtgtgtaggaacggaagccataataattttgacccaaatatatcttaaagttttgatgtttttaacacttttctaggtcccttgattttcactgtcaactacagacacatattcatgcctattaaataaagacacatatacatatggtttattgtcccatttctttgaaaatttctttgacttctaaatgagttggttaggtttgtttcatcagaacagcctgtgctttctaaataacaaatatttattttctaatttaaaactactatagcatctggggataataatatatttacataaaaaataagcaaaagtcaaaagataatagttttaagcataatcatcccattaaaatttgtgaaattgaattaagtaaaaattgtcaatgacaatttaattccaatctttttataaaaataatttattctcaaacttaaggtttcaaacttttgtctctaagatttccaacgttaaggaaagtacgtgatggttagaaatcaccttagaaaagacaagtaaacatttatgtatagtaagacctatataacagtactttctcatatttagagagctttcttccctgaaatgtattttaggaccattagtaacaataacaggaaaatttatagtcttagcaaaaatgagaagatttacataattgtaaagcattttaaaacaattccattctgaaatcataaaatacgtctttgcggtatttgtttgcactattacagcaagccacagtatttattaaaagaaatatattatcatttcttgcctcagtaaaactattgtttcattagagttgatgagcatttttaaaatgcactaaagcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaatgtactaaagcaaagggatctcacattcggaaacgtaaaaccgcttacaacctataatcctggtctacctttggttttcttgaaggagatatgaacgccttttcttttctctttctctctctctcttttttttttagcatcagaatgctacaaagataagctttcataaagtcccaacaattaattaattcaagaatacgctatcttcactgcagaaataataaataatggattttgaatcattggtcctttataggaaattgtacctctgattggcaaattttgaagcagctcagcagagaaaataaacaaaaagaaataggcttctgagaaaaaggccaatcacctttcgtttcttagacaaaagaatttttcagagtttcttgcataataattcatagtttttttttttcatttgggaaaatgcacatatttttggtacagaaaactggtaatcagcaaagttttaatctgaataaccgggttccaatgttggctttgacaaacatcaattatgtgatctctgaacccaaggagataacaacaaaataaaggacaatttaaaggattactaacagcaatggacaccatgcttagagtacaataagcagtccatgaataatgttaatataataaatattcctgcaagtattcactaccatcatcattcttattatagagattttagagatcacattattataatgcttttccatttctgcttactaacaagtgatccttcagtgttcaaactctgtgacatatcctgtgatttctgcaaaacatattatgaggttctgaacatattcaaggtcaaatgcaaaacatattttaaaacaggtaagagaaaatgtgtaagggattaattttcttctccttataagaacatttctttattaagttttagaaaacctctctaaagtcttaaatgaagaaaaatgtgcctcaaaaatatgtttatatacacatatatatgcatatgtatatatgtatgtataacagtacatgtgttaatgaaatagaaaaaagacaacatttcagcccatctaacttgtttttactttatttacaccatatataccgccatggaactaacttctattacagagaagacattaaggtaaaacagttacaaatggcttaaccactagagatcttaattcatatttttctctataaaataacccatacatcttgctccaatgcataaatgcagcatacagctacattccattaaaaccacctggataaacttatagggatcctactctctatagcacattacttgcatcttgtttaaagtaaggacctgtttcaagggtctaatggaaattctattcttatgtaaataaactattaagaatagccattttgctttaattgcacaatcacctcgtcctttttaacctctcctattcccacacatgaaccttttaatttcaatcattcattcttgatttctcttttacagaaaatgtcaaacatatacaaaagtagacaatataatataaggccttgctattcaaagtgtgttgatgtacatttgagttcttttctgatttttgttattatcaatgttgattctaagaatattcttgtacataccactgttagacacatgcaacagattttcttgggtaaaaacgtaaaagtagtattactggaacatacagtatgtgagtattcaactttataagatgttttttaagagaagtcacaaaaatttacgctacgccaattcatgaaaccctggtgatccataacgcttcaaacacttgatgctataagatttaaatctatactaacttggtgtaaaaatgggattttattgaattactaacttgagattatgtcacatttcttcctaagattattgggtctatgggtcttctatgaaatgtctttagctcatttttgattgaattttcatcttattgatttgtaggaattcatttgttcttgataataatcataagtaggttatattttagaattaatatctgtaattggtctctttgcttttttgtttttgaaacacattttgatgaacagaaatatttaattttaagatagtcaaatctttccatgagtgaggcatacttttaaatattttcccatatggataaaatttttccctacccacttactgaatagcccctctattcccccctcaatgttcaatggaaattgttatatttcaggcttttacatctattcctgtgttgccaggattgttactgaattgttcatccatgaaccaatgccacactagtcttgataactaaaacttcacaaacagccatgacatttattagcatgaaatgctatctttgttcacttcagaatttctctaggctacttgttaatctacacattcctaaatattttagaaccagtgtcaagttctataataagtgttgctggtatttttattagaaatttgtatcactgcatctataggctcattttcaaagagctgaacatctctatgatacacagtccttctattcataaacacaaggtagatcaccctttatttactttatatttaaagtattttaaatatttcagtaaagttttgtgtaggtacacattacacatcttttggtaaataccttccatggtactttatcatgttttcctttctgaagatggaatctttaaacttacgtttcctaattgtctactgctggtgaacatgttttattgattttatatattgagttttacattcagaaacttgctgactttcattatttctattaatttgtgattttttttaaaaaaaaaataatcagatcatctccaaagcaggcagttttatttcctccatcccaatgtttataccataaatatcttcatcttagtttattgcactagctggcagctaagactagtgtatggttgaataaaagtggtgataatgagtacagttcctcagttccttttacttaattttttaaatgctagtatccttctatttaaaaggatgtttcaaagatttttttcccacagatatatcacatttaaaaattcccttaatttattaagattttttgtaacacgaatttgtgttggaattaatcagatgttttatgcaattattaccataatcatgtgctgtttctcacttaattaattaatgtggtaaataacatcagttttctgatattaaaatatatttgcagatctgggacaaagccaacctgaccattttatatgatttttatacaatattagatatttacatttatgattgtgaatgaaatgagcctaaaatgctcacttcttgtactccttttctgattttggtatcagaattatattggcctcacatttagactatggggagcaaaactgaaaaagcattacatctaatggaaggcttttaaataaatgcagtagatctatcatcccatgatgtataaaaagtttacttcaatatttcttcaaacttggagtgtatgtgtaaggaggggagtacatgcacgtttccatctgcttcttgtcttcataacctgtgtcttatctacagatatattacaggtaaaaaggccaggcgtggtggctgacacctgtaatcccagcactttgagaggctgaggtgggcagatcacctgaggtcgttaggagttcaagaccagcctggccaacatggtgaaatgccgtatctgctaaaaaacaaaattagccaggtgtggtggtgactgcctgtggtgccaacctactcaggaggctgaggcaggagaatcacttgaacaaagtaggtggaggtggcagtgagcccagatggcgccactgcactccagcctgggcgacacagcaagactccgtctcaaaaaaaaaaaaaaaaaaattagaaaactcttctcccacccaggtggttttaatagaatatagtaaagtttagtggaaaatatccaataaagagtgaaagacaagtaatgctacttagttaaaaaaaaaatcacttaaggaagttgtgagttaaaaagtcatcacctagagttggtgaaatgtataacttatggaagtgtgtttcagcctagtgaaaagggactgatctagaaataaattaaaagaaaaacatagcaatattatttatcttataataaagccaaaaaaccttaattgtaattggagtattagattggcattaaaacaagacatttaggactgtgtgcataaaaaaagtatgaatgttgaaaaacatgtttaagagacatctttcacatgtttttgaattatagtcctgagtatagaaaaccacaataaaccaatttatgcttttcagactttcttggcttaagaaaaggttatttatcaattcctatccaacctctactttcaacatggacagttgctctataaaaaaaaaatatatatatatatgtatatatatatatgctcaaggaaacatgacacagtagctgaagttaggaagaactgcccatctgttatgcgtgaattcctgaaggtaagctgagagccctcatttcaattaaaatgaaatggaaccacatgtatacagtagatccaaactttctattacttttttcttacatgtagccattggggatagtccaaatctcactgaaaaagaaattcaaaagctaccttaatataaaagatcatctatcaaaaatatcaaacacagcttgacattgcttaatctaaaatgttctcactccattccaaaaaaaaaaaaaggaccctaaatctgtatcagaataaacaattacttgtttggttttctccccccacaaaatggcagattagaggcttttagcatgccttggccacttggaaacagcaacgtagtgcataaagatcaactatgtgcgctttaattccagaaggaaaatgggaatccgctggaatcctaaaggataccccagatccaggggagaagaatgcagacaaacagcccctgtgactcaaacagctggtaacagtgaatgaagtgccaatacatgaagagcttccctctgtgactcatctttccactggggtcaatggagagcactttgtttctcccaagccctggagttaacatggtgagaggcttaaagacactgagagggaaagacacctggaaaagctgcaggcattttccaagactcaggaccaagagcacaatgcaatttttaatttgggtccatgttgtgggaagtcagggaccccgaacagagggactggctggaaccgtggcagaggaacataaattgtgaagatttcattttaatatggacatatatcagttcccaaaattaatacttttataatttcttacacctgtctttactgccatctctgaacataaattgtgaagatttcattttaatatggacatttatcactttccaaataatactcttataatttcttacacctgccttattttaatctcttaatcctgttatcttcataagctgaggatatatgtcacctcaggaccactgtgataattgtatctaactgtacaaattgattgtagaacatgtgtgtttgaacaatatgaaatcagtgcaccttgaaaatgaacagaataacagcgattttagggaacaagggaagacaaccataaggtctgactgcctgcggggtcaggcagaatagagccacatttttcttcttgcagagcgcctataaacagacatgcaagtagggaagatatcgctaaattcttttcccagcaaggaatattaatatttaataccctggggaaggaatgcattcctgggggaaggtctataaacagctgctctgggagtgactgtcttacgtggctgagataaggactgaaatacgccctggtctcccacagtaccctcaggcttactagggtggggaaaaatcccaccctggagaatttgaggtcagactggctctctgctctcaaaccctgtttcctgttaagatgcttatcaaggcaatacatgcacagctaaacatagacccttatcaggagtttttgattttgccttttaccttatgatctttgccttgccctttgccttgtgactttattggcctcagaagcatgtgatctttgttctcctttttgccctttgaagcaggtgatctttgtgaactactccctgtttacaccccctccccttttgaagtccttaataaaaacctgctggttttgcagctcaggtgggcaacacagtcctaccaatatgtgatgtcacccccggaggcccagctgtaaaattcatctctttgtactctttctctttatttctcagctagccgacacttagggaaaatagaaagaacctacgttgaaatattgggggtgggttcccccgataggtccatacaaagtcagccagtctgtgtggcagcgtagttgcgcatgcattttagtcttgagccagagattggagtgcctgctctggagctaggtgggagccttcacagggagaacagaagtgtggaaagtgcctcagtagcaagcgctggaattcggctctcccctgcagcaggcttaggggtgggatgagagctgctacagctgtggtttctcctaggtgaccagacttgcaggcagagccagcttggggacctggaactaatctgcatgtgccattgctaggtgcccaagtatgctcccctcagatcatggtaaagtgatccaccctgaagcagaaagccaggtatttggagcacccacttgcctagaccagcatcccacccttcgtggatatagatcctggtgagcacggccctctgcgctccatgcccaggaagatctccaggtattcagagtactcgctcacctggttcagcagccagtgcagccccatccttcctggacatatattgtagtatatgaagaccctctctgctccacacgcagacaaatatccaggcatttcgagcacccattcaccaggattagcagcttgaactgtcctacccacactgtgcagaaattgtggtatagtaggaccctctgcagtccatacccacatgtatctccaagaatctgaaggatgtactctcctagattagaagtgtaggccacccatcaacaccccatcaccatgcagagaaattggggctgaggtttcccagctttaacactaggcacacctctagttgcttggtgaccagacactggattctctcctagcactggtgcttgtgtttaccattgggggacctgtatgcaggcctacccagtgtggctctgtcaatcatgcccaacaacccccaccagtgctgagcagagagctcagaccactgtgcaccccacggatcagcccattgcctgagacaatagagaccctctcccaataaacaagaatcaagtatatactatacgtatataccatgctggctatataccatgctggctatagtcggctcttgctcataaatgccaaatactaccttgtaggtcaaactgcacagcccaatataaaatctgccaaaagaagtacacggtactataaaagcaaagccaagagaccctacccatgatcctctgcatccacactccctagcgaggaagggaaaaggtaaaaagaaaggaaaaaaatattatagggcaagggaaaaacagaaaaaaatcctacctgcacaaaaataattacaaaaagtagaaatgtcagcatctccagatgagaaagaaccagtgaaggaatactggcaccacgaaaaatctgaatgtagcgacaccaccaatagatcacattagctctccagcaatggtacctaaccaaaatggaaactcagaaataacagataagaaaattcaaaggccagacatggtgagtgatatggtttggctgtgtcccacccaaatctcaaactgaattgtagttcccataatccccacatgttgtgggagggagcaggtgggaggtaattgaatcacgggggtggtttcccccatgttgttctcatgatagtgagtgagttctcatgaggtgatggttttataagcattgtcatttcctcttctggcattcattctcttctccctgccgccttatgaagaaggtttcccctttgccttccgccgtgattgtaagtttcctgaggcctatccagccatgctgaactgtgagtcaattaaatctcttttctttataaagtacacagtctcaggcagttctttatagcaacaagagaacagtctaatacagtgagtcatctctataatcccagcacactgggaggccaaggtggaaggattgcttgagggcaggattttgagaccagtctgggcaacatagcaaggccctgtctctatgaaaaaaataaacaaaaataagccaggcagggtggtgcacacctgcagtcctagctactcaggaggcttagacagaaggatcacttgaacctaggagatcaaacacacagttagctatgatcatgccactgcactgcagcctggttgacagagtaagaccctttccccccacaaaaaaataaaaaaggaaaaaagaaaaataattcaaagcatggattgcaaggaagctcaaggagatacaagaaaagtttgaaaaccaaacccagaaacttctaaagcaatccagtaagtgaagaaaaagataagcatcttaaaaaacaatcagaacttctggaattgaaaaactcaaagaatttcaaaatgaaagctttatcaataaaccagctgaagcagaagaaaaaaattcacagcttgaaaattggtgttttaaactaacccagtcagacaaacataaggaaaaatgaattttaaaacatgaattaattctttgagaaatatggaattatgtaaagtgaccaaacctaggaattattggcattcctgagagtgaaggagaaaaagtaaataacctgagaaacgtattcgagggaataattcaagaaactgtccctgttcttgctagagaaatattcacatacagaaaacctagagaacacttgaaagatactatacaaaatgaatatcatcaaggaatatagtcagcaggatgtccaagattaatgctaaagaaaaagtcttaaaggcagctagagcaaaagggcagatcatgtacaaagggaactcaatcaggctaacagaggacatctcagcagaagatttacaagccaggagagattggggcctatgttcggcactcgcagagaaaataaattccaaaaaacaatttcattttctgccaaactaagtttcataagcaaaggagaaataatatcttttccagacaatcaagtgctaagggaatttgttaccactagaccagcctttcaagagaacctggagggagttctaaacatggaaacaaaagaatgatagctagttgcccaccacccccaccaaacacacacgtacacacacaaacacactcacttaagtacatagctcacagaccctataaagcaaccatacaatagaaactacaaagcatccagctaacaacttcacaacaggatcaaaacctcaaatatcaatattaaccttgaatataagtgatctaaatgtccaactttaaaggcacagggtggcaagctggacaggaccatccatctgctcttttcaacagacccatctcacaagtaacaacacccctgagcacaaaataaaggactggagaaataatattattttgcaaatggaaaacaaaagagagcagggatcacaattcttatattagatgaaagagactttaaaccaacaatgttaaaatgacaaagaaggatggtacataaagacaaagggctccatccaacaagaagacttacctatcctatatatatatacacaccacccaacattgaagcatcaagattaataaaacaaatatttctagacctaagaaaagactaagatagccacacaataatagtggtggacttccacaacatgctgacagcattagacagatcatcaaagcaaaaaactaacaaattctagacttaaattcaacactaccaattagacttaacagacatctacagaataatacacctataaacacacaatatacattcctctcttctgcacatgaaacacactccaacactgaccataagctcagccctaaagaaagtctcaatacattcaaaaagattaaaattatatcaaccatactctctgaccatagtggaataaaaatagaaatcaatacaaagaaaatctctcaaaaccacacaattatacgaaaatgaaaaaacttgctcctgaatgacttttgggtaaaaaacaaaattctttgaaataaataaaaacagagacacaacataccaaaacctctgagatgtagcaaaagtagcattaagaggaaagtttatagtactaaacacctacctcaaaaagttagaaagatctcaaattaacaatctcacttcacacctagaggagctggaaaaacaagaactaaacccaaagccagcagagaaaaagaaataactgaaatcagaacggaactgaatgaaattgagacccaaatatccatacaaagaaccaacggaatgaaaagttggttttttgaaaggatacacaagatcggtagaccactaactagattaacaaaggggaaaaaaatagaagatgcaaataagcacaattggaaaggacaaaggtgacattacagccattctcacagaaatacagaagatcttcagagagtattacaaacacctctatgcatacaaatcagaaaatctagaagcaaatgaataaattcttgaaaatacaaaatctcccaagatttaatcaggaataaattgaaaccctgaacagaaccatatcgagttccaaaactgaatcagtaatgaaaaatctaccaaccaaaatagccctggaccagatggattcacaggcaaattctaccagatgtacaaggaagagctggtaccagttctactaaaactattctgaaaaatcaaggaggagtaactccttcctaatgcattctacaaagccagcatagcatcattctaataccaaaacctagcaaagacacaacaaaaaacataactgcaagtcaatatctctgagaaacacacaggcaaaaatcctcaaaaaaaaaaaaaagcaaactgaatccaggagcacaccaaaaagttaactcaccaagaaaaagaaagcttcattcctaggatacaaggttcgttcaacatatgtaaatcagtaaatgttattcaccacataaacaaaattttaaaaaaatacgatcatctcaataaatgtggaaaatacttttgatgtaatccagtatcgcttcatgataaaaaaccctcaacaaactaggcatcgaaggaacatacctcaaaatagtaagaaccatttatgccaaactcacagtcaacatcgtgcagaatgggcaaaaattggcagcattccctttgagaactggaacaatacaaggatgcccactctcaccactcctattcaacatagtaatagaagttctagccaaagcagtcaggcaagagaaggaaagaaaaaccaaccaattaccaaaagagaaagtcaaactatgtctcttcactgaggatttgattctatccctagaaaactctaaagacttggcaaaaggctactgggactgataaaccacttgagtaaagttttgggacacaaaaccaatgtgcaaaaataagtggcatttctataatgcaacaatattcaagctgagagccaaatcaagaacctaatcccatttacaacagccatgaaaaaaaaataccttgaaataaatctaaccgaagaagtaaaatatttccacaaggagaaccacaaaacactgctgaaataaattacagatgacacaaaggaatggaaaaacattccatgctcatgaattgaaagaatcaatatcattaaaatggccatactgcccaaatcaatctacagattcaacgttattcctctatcaagctaccagtgtcacttgttcacataactaaaaaaattaaatataaaaaaaattctaaaacgcatatggaaccaaagcgaagcccaaacagcaaaaataatcctaagcaaaaagaacaaagctggagatagcacatcaccctatgtcaaactatactataaggctgcagtaaccaaaatagcatgacactggtacaaaaccagacacatggaacaatagaacagaatagaaaacccagaaataaaactgcactcctagcactatctaatcttcaacaaagtcaacaaaaattattaatagggaagaacccctattcaataaatgatgctggaacagctagctaggccataggcagaataattaacttggactcctacgtaacattatatacaaaaattacctcaagatgtattgaatattaaagcataaaaccttaaactatgagaatcctagaagaaaacctaggaaacaccattatgaacatcaaccttgggaaggaatttattagaagccctcaaaagaaattgcaacaaaaacaaaattgattggggactaaatgaattaacttttgtgcagcaaaaagctatcaacagattaaacagacaatctatagaatgggagaagatatttgcaaactatgcatccgacaaaagtataatattcaaacagcagacccctcagcagaaaccccacaagcaaaaagagactgggggccaatattcaacattcttaaagaaagtaatttccaatccaaaatttcatatccagccaaactaagcttcataaggagaaataaaatcatttttagacaagcaaatgctgggggaatttgtcaccactggcctgccttgcaagagctcctgaaggaagcactaaatatggaaaggaaaaaccattaccagtcactacaaaaacatactgaagtacacagaccaatgacactatgaagcaactacaccaacaagtctgtaaaataaccagttagcatcatgatgatagaatcaaattcacatataacaatattaaccttaaacgtaaatgggctaaatgctccaattaaaagacacagaattgcaagctggataaagagttaagacccattggtgtgctctattcaagagacccatctcatatgcaaagacacacctatgcccaaaatttaaaaacaaaggaaaatctaccaagcaaatggaaaacagaaaaaagcaaatgttgcaatcctagtttctgacaaaacaaccaacaaagattcttgtttaaaccaacaaagatttaaaaagacaaagaaggatattatataatggtaaagggttcaattcaacaaaaagatctaactaacctaaatatatctgcacccaatgcaggagcacccagattcataaaacaagtacttagagacctccaacgaaacttagactccaacacaataatagtgggagattttaacaccccactgtcaatattagacagatcatcaagatagaattaacaaagatattcaggagttgaacacagctatggatcaaagggacctgattctccacccaaaaacaagagaataaaagttcttctcagtaccacatggtacttactctaaaatcaatcacataattggaagtaaagcactcctcagcaaatgcaaaagaactgaaatcataacaaacactctctcagaccacagcacaatcaacaaatggttctaccaagaagatttatatgctcatatgttcatcacaggacaattcacaatagcaatgacattgaatcaacctaggagcctatcaatagtggactggataaagaaaacgaggtacatacatcccatggaatactatgcagccataaagaacgaataatgaaatcatgccctttgaagcaacatggaagcagctaaaggccattatcctaagcatattagtgcagtaacagaaaaccaaatacctcatattcccacttgtaagtgggagctaaacaattgttattcatggacataaagatggtagcaatagacactggagactactcaaggagaaaggaaggggagaagggttgaaaaccttacttttgggtagtatgctcactactttggttacaagatctatcatatcccaaacgtcagcatcatgcaatatagccatgcaataaaagggcatatgtaaccctgaatctaaaataaaatttaaaagaaaaaataaccagtcagaagtcgaaaaggtaatactgaactctccctcaaaatgagatcgcactcatgcacgaaaataaacaactgactactgaatgcctaatcttacctgataaaacatcttactctttaaaaacataaaaacgtattagattttttccaggtgccaaaaataaaatatatagtctgggaattaataacaatttttatccctccattaaaagcattaagtcatttatttacttcttctcctttattctgatagttgcttcatgttaatctggcttgacttttaacagaacaagtttccatctgattatctaagtctaaatctcccttagctcttttagaagatacatccttgctatggtcccaatttaatatcattatgcaatatctatcctctaccaaactgcctgagtctctaaactctatgtaggatagaaaaaaattaaatattttattaattttatttaaaatagcaacaaaaaatgttcccagatgatagtaactccttagtcaggtctcaaaaatttcttccaacaattatgctgactggtttttgtagtctggtccagaatccataccaaccttaacgctctgctccctgctgcattgtcttcattttggaaacagccttgccaacaagtataaagaatgtataaattcagttattcactagcctattccgtgtccatgtaacaaacaaaaatacatgaaatgaacattctttattctgacttattaaatagcatcaagtttagcaagaagctcattgcaatagttcccaaacctagataactaatgttatactaaaacaaattttcatgtttgttgcataattttccccaattgttttaacagattaaggcatcacctaaaaatctcctggaaacccacattcactttgctgtgagttgatgccagctgtttcaaaacatgggtcaaagttaatttagaaataataacaatgttaccattctgtctctatttacagaaaaataagtgagaggaatctttgcttgcctcatagcgcatttgaataaataaatcagagaacattagtaaatttattagaactatctgaaaagtgttactttgttataatttcacctatacattcccttaccatcaagtctgaattacaccaaatccttttgggggcagacattaaattgggtacaagaaaagaaaccaagacataaagatgagggaatcaaatagttaagtttttctaagcaaacctaattatcccaaatctgcatcaggaaactcttacattacctcacgatacaatatgcactggagatacaatgatggataagaaatgtatctttacggctaggcgcagtggcacccagcactttgagaggccgaggtgggtggatcacttgagatcaggaattcaagaccagcctggccaacatggtgaatgaaaccctgtatctactaaaaatacaaaaaaaaattagcagggaggcagaggttgcagggagctgagagtgacccactgaactgcagcctgcatgacacagcgagactccgtctcaaaaaaaaaaaaaaaaaaaaaaaagagaaatgcatctttatcctcaaggagcttatagtctaaataggaggagatcaagctacatcaagctaaaattggaaggaactgttagaaggaattgagaacgtgaacctaaagagaccataaataggaaacaaaagaagctggagacaaagagagcaagaacagtggcaggaattctaggttaccagaactactagcattaatattttcaaattaaattccactcagctatacagaagatacaactgtatttaaataataaaattgcttgaaaatatgctgaatatgttagactcaaaatatacacattaaaaagacattaggttttgaagagtttaaacaatactgttgtactctgtgtgtgtgtgtatgtgtatacatatatacatagacgcacatgtatatttacaaaatttgtatataacaggcttattacattagaggccagggaagttcttttttaatggatattacattaaaatatttcaaaataaaatgtattaatttatacatccatgaattaaaacatatataattatacagttaatagattatcgattaattttaatgattcacaaactagtatctcttatggaaacaatataataacttgagaaaaggacaatagagggaaaactaccacagtaaataagtagatctgtgagtccctgcaatactggatataaggcatggcaatcttgaaaatatcaaccatccatcctgttctaaccccttccacttgctattgtgttaggaatgtggtcttgttactaagttgttccaagcttagttactcaagaagacagtttgggcagggcgtggtggctcacgcctgtaatctcagccctttgggaggctgaggtgggcggatcacctgaggtcagcagttcgagaccagcctgaccaacacggagaaaccctgtctctattaaaaaaaaaaaaaaaaaaaaaattagccgggcatggtggcacatgcctgtaatctcagctactcaggaggcagaggcagaagaatcacttgaatcaggaagacggaggttgcagtgagttgtgatcgcatcattgtactccagcctaggcaaaaacagcgaaactccatctcaaaaaaaaaaaaaagacagtttgatactaactagctaggaatttgatgttaagtgtaatagcttagagttctcacaatgataggtgctggcgtggataaattgtcacaaacacacttatccaggatatttaaagagaaatataacaacaacaacaaaatctacatcatgccatacagctgtgtgacaagaaaatatatttcttttcatatgtatgaaatttcaaaatagtgtataaagactcacttcaaatttgctaacaatgaatccaactaactatttcatatttaatactcattaaacaactactacttagtggcttccccactccccttactgaatgacatctcttcagcaagaatcaactttggaactcaaaatcatttcattatatatgaaaaatcctaaatatgatgatttaatagcttagaaaggttttttcttcattaaaaataaatacccaatgttaaaaatataaatttagtttaaatatttgccacataagttaaaaacacatcaaaaaacacaaacatactcttaataatatctctgataaaatgacaatattgtaatgtttttcctattcctccatcacaacacaaatctaccctaaaaggtattaaataaccttacaaatttttgtatagtcaattagcacatgcattgtaacctataaatacttgaagtagaatcacattttgaaaccagtatgttaattttatgctaaaatccacagaccaataaatatagttataaatcattcttatgttcctggcctttccaatacattacaaataactttattttctttttctaaatgtagcaaaatttactttaaaattactacaaactgacaaaaacaaatgatattaatcagaagtcaattatccttttagcgagaataatgatgtggtgatggggggatggtatctggaaagaagagaatgggtaatcccaaatttcagttacaccacaatcttctccccactattggggttagactttcaggggaggattaatctctgaagtgagagagagacctaggactatcaccttaccagcaggtctcagcaactagtcaacagttgattggggctgactgttaggcagggagagaaagaaagaaagaaaagaaaactggcttcttctctcacaagcaatctagactttcctagatttataaaatttcagctttaaaaatatccaagcaaagaagaatgaaaagtaacttatttactaaattttcatgaataaagggccaatggactaactgcacacctctagagttgaaccaaatgaaattgcagattttggagatcaaacaattcaacctaagttacaagaagcttaaaaattagaagatgataattaaaactaaataagtttttaagtatcttatatttattactgagatatattaaaattgtaaagtgttccacacctacaaatatttaataaaattttgtaaccatcttgaatcagggaatatcatccaaaattacaaagatattttgataggatgaaaagcaaagaaaatatgcaacacaaatcaagtaagtaggacactcccctcttgcacacggacaggctggatgcaaggggcactcccaaaaattgttatacctgattacccagttagatggattttggggcagaaggtagaaattgagtttgaggatttgacagtttgctgaaacagaaaaattgtgactagttgtcaggaaaggtcagcatccaaatccagccagaaagatggatcagcatattgttaaactgaaaagaataataaaatatttataagagttggtggagtgagcaaagcagtaaatgcagaagtttagttgggtaaaacattttgcaagagttatataaagatcatggctctaaatcatatccagaaatcaacttccattggtcatctctatattagcttacctaaaaattaaattaacatgctgagttcaattattgaatggaatggctatcatgttagatgacatcaaaggaaggatgtatactgtgaatgttaaaaatacaagcagatacaattagcatgaaaactggaagtaacagcagatttagaagaagagccaagtggtgtggtaaacattgaatgtggggaacaggtaaaattaaaaacatgcatggaatgtcctccattatatctccttagtcagtggcattaattattcttgactattttaagcagattgcaatctcagccaacaacaaattttattcaataaatatttaattttactgttgggggccttaggtttctaattataaaaagatagagttggaatagatcatctctaagaatcctgctacatttacaacatgattcttcacagcaagactccacagttttctccagaccagctcactctgcactggttttcctttagatagagaaagtttgttcatgtggtgctgtagaattcccctgaatctgttttacacaaaggttttgcatctttctccagttagggaacattatatcccccggtctaagtcagtgcttctcatactttaatgtgcatttaattccacttagaaatcttgttaaaatgtagattctaattcaggaaatctgagatgagacctgagagtctacatttctaaaaagctctcaagtgacgcaaatgctactggcccatggaccacactttcgagtagcaaaggtcaaagatatgctggaagtatcagtggctttgaaaaaagcagcatcagtctacacaagctttcctaaagcctacagaccaataccttgactcacattatagacaatatctagaggatatttatcagtttcaacctgttttcaagtcccctgtaaaaaggtatgatttcctttctactgctagtatttcaatttatggccataatttcatgtatctcctggaaagaaaacgacatctacatgttatttgtgcagtagttctgagagaacaaaggttgtaaacaggtatgttctatttcagaagtgattgtattgtatttgggattcacaaaaaattgactttattctttaatgagacatagagtgatctttcaaatctcaatcaaaatctaatttttcctatattaaacttaatttgaaaattaaaaataaactgccataactatttgcttgaaaaaataagtcatcaaatatcttaaagatattttgtgaagcaagaattagaggccatacttctttattttaaaaaagagaacaaagaagtttccaatactaagttatctaaaaataaaaaagtatcataaagaggcagttccctatatatggatgtgtttaagtgtatctataagtcagttgtttgaaattcagaatacaatttcccagttaataatgacgttgtctcttagctagatcaccatgaataatcaaacttataatttggttgaaacttaggtttgccttgtcaaaacagatacacatctgaaaaactcaccagtaatttaaaagaaaaatactgcaattgaataagaaaccattttcaatttatcttggatgttaatccttcaaaaaggatgtttacaatgaggatgagtggggatagagaagaaagttccatgttttccgtcaaaagtgttttaggttcttcctgatacatgacatcagtttaaaacttcatccaaatttacaagaaaaaaacaaacccatcaaaaaatgggtgaaggatatgaacagacacttctcaaaacaagacatttatgtggccaacaaacatatgaaaaaaagctcatcaacactggccattagagaaatgcaaatcaaaaccacagtgagataccatttcacatcagttagaatggcaattactaaaaagtcaggaaacaacagatgctggagaggatgtggagaaatttttacgccgttggtgggagtgtaaattagttcaacctttgtggaggacagtgtggcaactcctcaaggatctagaaccaggaatacaatttgacccacaaatcccattattgggtatatacccaaaggattataaatcattctactataaagacacatgaacatatatgtttactgcagcactatttacaatagcaaagacctggaaccaacccaaatgcccatcaacgatagactggataaataaaatgtggcacatatacaccatggaatatatgcagccataaaaaagaatgagttcatgtccttttcagggacatggatggagctggaagccatcattctcagcaaactaacacaggaacagaaaactaaacactgcatgttctcactcataagtgggagttgaacaatgagaacacatggactcagggaggggaacatcacacactggggcctgtcagggggtagggggcaaggggaaggggagcattatcataaatacctaatgcatgtggggcttcaaacctaaatgatgggttgataggtacagcaaaccatcatggcacacgtatacctatgtaacaaacctgcaggttctgcacatgtatcccagaactcaaagtaaaattaaaaaaaaaaaaaaaacttgttttccttaaaacaagagatttaggttccatgatttctgcacattaaccataaataagaatagtttgttgcttaaattattaaggtgatcttattagtaatagcttatgaatgagaaggaaagaaaagaaactacagtggagatgtttccaagggaaaaacctggaatagaaaagaaaaaataaattttttgcagggattgcatttgtgcctatgaaaaagaagttgcccatcatgggaaaatgtggaacgaaagaaatagaaaagaaaagaaaaaaaaaaaactttgttccataaaggagaagatatgttttgggaaacatctgctcagaaatttctccatttgtctagagagagtggttggaaaccaagcaatgtttcagaaagtaggtatacattgagttttgagaaataattagtttaccatcagttgaagatgaaatgtgaagcagaggaaaagcacttccaaagagccaagatatgaacttgcagggtgtggccaggcatggtggctcatgcctgtaatcccagcactttgggaggccaaggcaggcggatcacttgaggtcaggagtttgaccctagcctggccaacatggtgaaaccccatctctactaaagatataaaaaattagccgggcgtggtggtgcacacctgtaatcccagctactcgggaggctgaggcaggagaatcgcttgaacccgggaggcagaggtcacattgagccaagatcacaccattgcactccagcctgggcaacaagagactccatctcaaaaaaaaaaaaaaagaaattgcagggtgtgttcaggtaatatcaagtagtttggtattgctggtggtcaaagtgcctaggaaagtagcagtattaatagactttcaatggtccataaaagacttaaaggtatatataacattacctcttatgcttcaaaaaaattttttttgaaataattttatggaaatattttaagcaggggtaaacatcttccaatttctttatgaattaaactcaaacaaacactctggcttcatagagaacagactgggtgacagtaagactggaaacaagaaatgtgcccttcacagaatgcagaaagtctgaacctccgtccagtaataactggaaaagaaactaaaacgcggtagaggaggtgcattttcaagattttcaagctataaggaaggtaaattaggaccaattagtgactgtttggttactgggatgagagggctgttagaaggagaccggaaagacctgcaagtgtctagattggttgagtgagtaaacaaggaataacataagacaagtagtatataaaataaataatagactaaaacacaatacatttgagtgacttataggatatccaagcaaacatatttgagagacagtaaaatctccaaatctgaattctgaggaagaggtttcagaggtcatgagcatttggatgatacttaaaacatcagggtagagattaagtctcccagggagaacatgagatatgaaaagataaaggggtctgaaatctctatttaggaaacaacaaaatttaaggaatagcgtaaaaagagctgataaaggaggttggaaaatgtttagaaatgcacttagtaagtagaaaagagtgttgtcaagagagttcaatgagaagaaagcagccatggctatcaagtgttacagagaaacaaaacagcaagtggactgaaaagtgacctttgtatttgacaactaggatatcatcactgatctcagtgagagtagtttcataaaagcagtaaaatgacacgtcagatttcagtaggttgaagaaagaatgggagagtttaaacaaacaaacaaaaaatggtgatcaagatggttcttcagagacctttaaacaggaataaaataaagtagaacctagatggaatataaaattcacagagcgtcgtttctttgtatttgcttggctgtgttgtgacagaacagacttgagcgtattaatatgctgaagaaaacagaagtattaagaatatgagtgtaaaggaacaagtttccagaggaggttaagaggtaatgcttaacagcaaagattaaagatcggtcttcaagtgaaatcctgttagtagacggtgtacatcatctggattcaacctacagccttactccttgatattagcagtttctttgaacttaagtcatatcaaactattaaatgttagcaactgaaatttaagaaattaaaaaaaaagttttctaaacattaaaactaaagactttataaatcaatttggcctctcagagatataaaatttccttctctgattttagctttaatagaaaacatcttatccatgaattaaaactataatggttgttctccttacacaataaaaagaatttacaggttctaaagggcaggtaatggattttctattttcatgccatgattatgtatcccaaaatatatctaacagtcattcaattgagcacctcaaacatatctttagaaatatctgaaattgggaattcttaataaaatactgttgcctgcttttcattatttaaaatcattattattgaaatcacatttgagaaacctcacaattgattttattcttaaaataagaaggcatagcaatttctttattgtctatatgtacattttgtttttaataactcaggctaatttaaaaaatgctgaatagaaaacaggctaacaattttaaatagaaaaatagaagatgttacactgtaacatctgttccatctgcttacctcaaaatgtgaagatatgttaaatcagattttgtatgtcctttgttttatcttattaaaccagaagtttaggaaagattacaagaaaattcactgaacaatgggttgataagccaaatgctgaaaaccagatacacttcaacattttgggagctatcattatggcactgagcataaatatatatatgtgtgtatatgcacacatatatatagatacatatataaaccagcttataagaaatctgggccctaaaaattctttcagaaatttttctttgactcttttatcctagcttggcaatataaatataaaatatagaccttaaagttaatgatactccatctttgaactgtgactttgtattatattaaatttatcatcaaatttctattaaattcttaaaaatgttttaggaatcattattttttgctattttaaaaatactttatttcagttattttattttacattgttggactggacatagtacctacctctgagagttagtgagagtagtttcttctttcatcttttaaacattgaacacagtgtactactcctagtaggaattagacagatccacatttaagaaactatttacctaactatctaaatatcaccaagtagaatccctaaacaaataatatcaaaaaatacattgtacgttcccaaatagggaagatgcctaccatttcccaagccctatgaagaacatgtgaaattctttaaattagtactgatcataataaccctcagaggtaggtactatgtccattttagaaatgtttaagaaacaaacttaaagaagttaacttaccctatagtatgcagcagaaccaattatcaacctcaactactgaactcaaaagactacgaaaaatgcaaatgcatagatattaatcactgacttcttcattcagcacttttcaaaaattaaaggagtcatttgaatgcagcctagttttcctaatgcatgtctgttttctgtggcgcatatgggaaatttataataaaggtgatttctaagattaatagagataaatttagacctatctatattacccaaaccccattcttaaaaaaaagtaaatattaaagtatcaatgacatttaagttaagcattatacaatttttcattttctcttttgtaaaaataaaattttattcaaacaataagctgaaatcctaatgtcatttcattcccattctagattactagagtagcagtagacctgaatagcctcaaaacaatgcctaaattactctcaaagaaaggtgataattgccataaaaggcttttaatattggatatggaatcttgggaagagaatgagagggagagaaataatgtcagagctctacttgtgaacataaaatccgatagacctgatactcaaacggaaattactttctgtcagagtacacattcctgtcagagtacacattcagtacaatgccttagggatacgtcagcctctgccacaatttaatctgtaagtatctaagaatctcgccattccttgtcagccatgctgccaagacgtgcagagcatgaagtagtgggttccctaggcccatctccaactcctcctatctctattcaaataaaaaacagtgtctcccattaccgcccatgcactacaggccatggccatgaaagcattttccaagatggtgtgtaaagccttacctttaaaccattgcttaatgtccttactttaaaccagggagtttctttttgactctcccaaggacacaagtactgcaaggggagatatattcatttctactaaagtatttcaactcttttctctaaattatgaacaaaattattgacattgtaacttcatttagtatatgccaccatttaacataggtttgtattaatcagattattagaaccacacctagcaccttaggcgagcatgctacatcactgataatacacagagagattaaacctattaaacctgaacaaacgtttatttctacctccttagttaagatgtctagaaatctacaacttcccagattgctatcttaggtgaagagaaattctgtgatttatctggaaggtaaaccttcttctacaagactggactttcaaattttctcccaggaaatgctaaaatctaactctacttgaaggcctaaaagaatgggggtagttccaagcagggtgctaacttatgcctgcagcgtgtctcccttaggcaaggaagtagtatatcttcaagcaaagagctaacaacctctactacagggaccagtagtactacagggacaggtaggtgcttctaagaacacggagggctttaagtggggaaggatggaagtgatactgaaacctaagtcctcccacagattcttccaattcttgggtatacgtggctttatcattcaatactataacgctagtgaaagggaaagtgtcaagttgtgaacttgaataatgacatgcttcagcaggcacaggatcagactttctgagtttagtctttgggaccactgccaaaataatgctgaaggagaagtatatttcatgagccaccccaacccctactctgtaatgagtcccatatctccatatttactcactcagatgcaaggtttttggactaagctgatgattagctgggctggtcacttatcttgcaggaaagactcacggttcctgcaactgtcatagtacagagtggcagggaagatgcgcgtcattaataggtaattatccaaaaaacaagactaaactgcaaataggaaaggggggatggtagaaaataaaccaaagaataatacacatctatcacgttattcattgaccccccccaaaaaagccatatttcagagaccatatatgttatgcttaaatatttttaaatcagtaacttttccttttgtctttctgagtaaacgggcttagtcctagtcattccaactacctatctgaatgggaattatgtgattagtaactaagagttttgttctgggttagcaatataggattctgtgacataaggaattcaaagagaaagagcaatgtaatattcagcttctggtatgcaaaataggatttatcaagcacaataggcttgtaaaccagattaccaacttcagaaaataatattgtttctttatatcccattttagcaactcaagagacaagcttgtttaactgaccatacagatttaatataagggatacccaaacaggaataggatatcacatataggagagtctgctcctttcagtctcaaaggagggcagggaagagggagcagaacaagattgtttggcatgtgaattgattttcccttctctgtgctctgcgtggagaggaagaagctcatcagattagccagggtaaaactgaaggcagagcaggggtccagcttcttggcccttgttctagactcagaaaagagattgtctctcaggctgctcctgatgacaaagccctatcaccttggcaggaaggaagaagactcaagacttaatctgtggatgagtctttggttcctgtgtagcctgcaagggaagtagaggcagctgagagtgtagctggggcacctaccggagaggctgccgtaactgctgtgagggtatggaacagactctcctgaggaatcacactggacacatacccaggtctcagaagagtgaagatcaagctggccagtgctacagggaagcgctgcccaagatgaaaggcagcagatgtcactttatagtggctgcagactacaaccagacaaatgccaacagaacaaccaacaaccaaatggatggacctcactcagtggcagaggagccagaggacccaaatcttctctcctgcctcaaagatgcataagctgtcctcttcctgggcatcaaggaggttatttaagaaactaagctttcttggcccaagacagactaaaagggaccgcttgaaattttaaactaattccaacgtttagttcactttttcctactaattttctttcctactctatcagtcttcccatcttaaacatgggacttctatgtttcaattgttcaggcagaagctttgccatcatctttgacccttttctttctctcaaaccccaaaactacactcctcttggctcaccctgttccagccacactggcttccttgtggttcagcaaacaggccggatacattgcagccacgatgcctttgcatgggtgcttctctctggatgggatgctcttctccaagatgtgcacatgaatacattctggtgctcacattctttcattcttggctcccctggcacttcctgaatggaacccactctgatcttatttaaaattacactttgctttcactggcagctcagcccccaaaagctccttccctgttttctcaacatggcaattattaccttctaacatactctataatttatgtatttgtttttgtttgttgtctgtctcctgccaatagaatgtaagaaacacagctacagggatttttgtgtattttattcacggtcatatttctagtttcgaaaatagagcctgacattgtagtaggcactaaacaaatatttcttgaaggaaagattaatcaaaggttcaaggtttaggaggaaaatcagatttgttatagaccaaattaaagaaattacattttccctatacatccatttgcccttgacattatagctgctcaaagaggatttattgttccttgtgtgtgcattcctcaccatattcttattgtcacccttcccagtttcccagttcaggccctggactgagtgatgtctaatgagagtaaaaccaaaatgaagacatttgcataaaaatagcaattaacatttactgaatacttcctagatactattcaatcactttacatatatcagttcatttgatacaaccacttaccaggtaatattatcaacctgcaagaataaatgaggcaactaaggcacagagaggttgagaaagttacccaagttggtattatggtagaactaggactcaaatctaggcaatgtgactttaaagtgcatgtttttaacttcaccctgaggtttgtgtgtttccaatggttgcttggataccttgcagcaactgcctgcttattttgtgaactctgctatattaagagctacttcattatcaggaaaaaaaattcaagacataagaaacacaaatatataaagcaaaacactaaacaaaatacctaagcatagtagggtttttaaaatcacataaatggcaccaactaaaaatgtatgctataaaaagattatgtatgtatgtatgtacgtatgtatttaaactatttttatggtaaatttggagagaatggaactaatgaaaaataacaacttctaaagatagaaagtaaaagtacacagattggcagatgaggtaggaaaaagaaggccagagataaaaggcaggcaaaatcaatcactcttgtgttaaaaaacagtagaacttggaaaaatcacttaacctttctgggtccaattcttcatttgtaatgaggttgttaagaacaaataagttataaaaggacccttctcagctctaaaaactatgtctctaagtccaaattaagtattgtccataaattctatagcatcttccatcagactgcattatctttaatattccatccagttaacaagccttcagttatttaagacttttagcaaaatttatgttttcatggcacatttaaaggactctctgtaaaacaatatgtttttaagaactcattcaagttctactctaatttaaaattttaaaaatccaaaagcttttagcttttggagaaattagaaaaaaaaaagtgtttactattttaactatgtttcctatctgattttcttataatagtaatttccaattcaaaaatattaaaaccaatgtcactttttaagcttattattgtgagataataagaaataatagagatcacttctatcttttgctcactttctcccaatggtgccattttgtttaactgccattggatatcacgactagaaaattgacattaatacaatccactggcattatctgaatttcactagtttttacccacacttgtgtgtgtgtatatgtgtatgtgtgtgtgtatttagtttcatgcaattctatcattttatcacatgtactgtgaactccaacagagtcaaaacaacagtttcatcacaaagatccctcatccaactaatttatagccacagttacctcccttcctccctatttttctttaaaataaaagagaagcaaagaaaattatctgggcaatagcatcttaatttagattcaacccacaaaatggttattgataaaactttaaaccactagaattaagaaactatttagattaacaagaaagatacttatgtaatgagaaaaacacactagaaataacatcattatctgttccttaccacacaattaaatttagaatgaaagcatctctgggaaataatttcaattatgtagtcctagatcattagaagattttactaagattaaattgggacttaagcagccagtattcatttggagagcaacaaaaaccacagagtaaacactctagccaaagagttaattctagccaaaagaatattcaaactaaattttctaaaagaagaaaagatgcaacatattgtatataaaatgaaggatttagttatttttttaaaaaagtttatgagtgtaaaatgaatgaaatgtcaaagaggaagacgtatacacattttcatattttctatatataaacatatgtgtgtagaatatgtacacattagaattttaaggctctaatgcaagtttttatgtttcttccaccacatctgtatgttaacaaatggaaaagaatgtattttaatggagattatcaggactatttgtcataattgaaaaaaatacagaactactttaggcctacatttttacgcttgaaacatgaagaggtgtgttgactataatttttttataaaattaggatggtaatgatactgatgtcaaaatttagcctaaactgattctgtctctccttccttcagccctttcctccttcccttcttccttattgccttcttctttctttctacctttctccctcttgcctcgttttttccttttttaaactcttttattgtagaaattttcaagcctattcaaaaacagagtagatcagtttaatgagctgatatatacattactccaatcatcatcaatgcatgaccaatctttttcacctgtatccaaagccacttaaccaccccattccaataagtctgaagcaaatatcaaaccatatcatcccatctgtaaatatttcagtatatatttctaaaataaaattattcttatattgtaaacataactataatgcctttatcccaccaaaaaaaaaaatccttaacagcatatcatgaaagaagtaatcagtattcctatttcccaaaattttttaaagtttgtctgtttggactggaatcatgcaatgcaatttcatgcactgaattgcttgataggcctcttaaatcccttttaatctagattctccctctagctccttttattccacttgtgtgtgtgtgtgtgtgttttgtttttttgtttttagtggaaaacagacctttgtcatgcaaacttttccagtctaaatagtgactaaaatgattcctatgtattcatgaaacccagagctttggtcatatacaggttcagttttgtgtgtataggtgagagagaattagtcagactaattcacaaagaatgtggtggctttacaaacatgtgaaaatcttcaacacttcctccatcaagaggttgaagaaaagtggggctgggaatgggggattctgaggagaccagtcctttccccttgaatgtgggtaggcttttgactattttgtaaccaatagaatgcaaggaagggatgttgtgtgacttcccaggctaggttagaaaaggcaatgagattttgcactgttacctgggacacttgtgcttggagccttggggcagccatcctgtgaggaagtggtaacttatagagagccatatgtggattctcttgtaggcaatgctagtcttctagtcatccctagataaattccagatgggtgagtcaataaattctcagacgaatcaatttttcaggtgtagagtcagccccagccttcaaatcttccaaatttatagtaataaaatggttaagtccttaagttctgtgataatttttggtaacaataatgacaggtacaaggatgttgtgttgtaccacaagcaggtatatatcatctacatgcttctatttttgcattagcagccactgatgaccattagtaaattaacaaataaggagttgcaaaataatgatattccgtttctatcataaattgttcacttacttattagttggaacttctagaagaaactttccctcatcaaccctttggttactataagacaaaaaaaaacatatagaaaaagcaagacaaatgatttttaatcttaatctacctgttttcaaaataataagctggttccataccatctttcaagaatgaagaatgaaatcttacaaagagatccctgtacactttgcccagttttccacaatggcaatattttgcagatatatttacaatatcacaatcaggatatcaacatcgatatgattcactaatcttattaagtattcctcagttttacttgtactcgtgtgtgtgtgtgtgtatgtgtgtgtgtgtgtaagttctatacagtgtatcacctgtgaagcctaggcctccatgatttcagatgagaaatctcctgtcattcaaattgctgttgccctattagtaagctgtcatttatctctgctgtcaatattttttctgtatctccagtattcaaaagtttaattatgatgtgggtcttttagggttcattcagcttggggttcactcagcttctatgatctctagttttgtgtcttttaccaaagttggagctttcaatcattatgtcctcaaatattctttcagcacaaccttctcctctccttctgtgaatctgatgatataaacattgagtcttttgttattgtccctgtggctctgttcttttttcttctttttcaatttattttctccctattgttcaaatgaggtgaattctttcttccagtttgttgattctatcttctgttatctcattctactactcaacccatccgtgatatttttctttctgttgttgtatttctcatttccataacatccatttggtacttttgcataacttttatttctttgttgagattatccatttgtgacagagattgttcaggaatttttatgattccttctttaaatctatttccagtacccgatttatttcaatgttggtggcagatgtttgttttatttattctcatgattcttggtatggcaagtgatttttaaaatcatattctagacattgtctgttatgttatgagactgtgggttctatttaaatgttttatttaagcaggcaatcactctggttaggtttatcatgtgggtcttcacctacttttgtaggctatggttctaatgacagttaaattttcagagaccttgtagtgttgttttgttcagcttggtttatctgctggatatcccactggcccgtgctagagctgcctgaggagggtgagcctagtttttgatagcttccttggcttctgaaatactaagactttccaagtttaccacgtaaatatttatacctgatcagaaccaaccaattctccaaggagttttggggacttttttcatggcaaatggtatttaaatatcataatcttggtgctatagatacactcattgataactgcactggtctctgtttgtgaagctgtacatacacatcaaacccaaaatttgtttaagataaaatccaacatgaggtcatactgatacaattcaaatttactactacatgatttttacttaaccttagtaatctatccataaatctcagttttcaataatacctatataattaatcatttgatttattcctcaagacaaacataattgtctaaaataccaccaataccacaagaaaatatgttttttaaaaaatctaatttttttgcaatcctttttgtcattaaggtataacccactaaggatatatagctatcttgaaatttcttctgttcaacattaactttgtttgaaaattacataaaatatttacattgttctaaagtcaaaaataggtatagtaccctcatttcttaaatagtagcatataagtcatttatctcatattatggtatatcctgtagattaatgtgccatttgatgtagaaatatttgcattccttttcattgctgcatactactacatattctggatgtaccattttttttcttcacgtcccctatggacatttggttatttccagtatttgctattaaagatagtgccgcataagaagcgttatttactggaattttgtattgttttcactgtatcttttgatatacattcctaaaaggggaattgaagagtcaaaaaatgcttatgaaaattaactagattctgagtcactttcagaggattgtaccatttttgcattcctacaagcaatgtttgaaagggtctatttcctcacagtccccagcctcacagacattgtcatgcatttggattttttaataagttgtttatatattagggatatgggaatatcacctcttgtctgtgataagacttgcaaatactgtttccattttttttcgattattttccattttttattttattattattatactttaagttttagggtacatgtgcacaatgtgcaggttagttacatatgtatccatgtgccatgctggtgtgctgcacccattatttgttttttattttgcttatggtgaaaatgttttgccattttaaaaaactgctatgcaatcaaattagtcaatctttactccctgattgcctctgaattttagctagtagtcatgtaaatttaatctgtagccacattataaaagcatttgcttcctatagtatttgaataattaaagtttttacattaaacttctggcccatttaaaattatactgatgaatggtgtcagaatagatctaatttttatatttttccatataaatatccagttgttacagcacatttattaaaaggtatatccatctccactgatttcaaattctagcttcattgtaaactaaatttccttcagtatttgggcctatttggggagattttctattctgttctagtagtccttctagtcaatttttttaaaattgtaagttttaggctgggtgtggtagctcacgcctgtaataaaaaaataaaaatataaataaataaaataataaaataaaactctaagttttatattattactattatttttagggtttttgttttttttttgagacggagtttcgctcttgtcatccaggctgacgtgcaatggcatgacctcagccactgcaaactctgcttcccgggttcaagtgattctcctgtctcagcctcccgagtagctgggattacaggtgcctgccaccatgcccagctaattttgtatttttagtacagatggggtttcactatgttggccaggctggtctcgaactcctgacctcaggtgatccatctgcctcaggctcccaaagtggtgggattacaggcatgagccactgcacccagccagttttaaattatgttttaatatctggtagcattaaccttttcacttctcttctttttcagcattttgctggatattcttgccttttcattcttccaaatgaattttataatcaacttttcaagatacatttaatacaaaaaaatctgactgtatgtgcattaagactgctttacatataaaaaataacttagaaataaatgatattttatgatgtttgagtcttcctattcaaggaactaatatgcctttcatttcttccagtatacttctatatctttcacatgtgtatttcagttttcctcatatgggttttgacatttcttgttaaggctaattacacctaggtagtttattttctttatcaataaatgaatggggtcttcttttgcatattatcagtaggtttttttctgattggttcagttttcattattaacaattttgatagtttgcttatgaaatggcaaatgagtaaattattgtatcactataacaaatctaaaaactaggagaaaaattaagaataagagagtagccaaaaaaggaattgtcttaaaaaaaaaaagccagcacaacaatttgttttgtaccctgtttttgtaccctggaccttttgaggatatgaggatatgaggatacaaacagatattctatacctacaactatttgcaaaatactgctatttgttaagaacatgtattaacaatctaataatgaaatcatgccataaattggtgcaaacataattcccattaccaaagggtttagaacagaggccagttatctgttgttcacatctccctcactagatatatgttactagataagagatcttattgactgttttctcatgagaaatatcacaattacagtatgatatattgagtataggagagaagaaaagttaagaaattcagatttaactcttgaaaaagaaacaaaatatatttatttgcatctactttggtgtcaactgaattcatacacgtctcaccacctatgaaaataattaaaatatattgtgaaaacataagagtaacttatcaaattcataaaacataatttcttaaattcttccacaagttactctggatatttataagtattaaagaaatagatttactttatttaaatactttcattaagtactatacaactgaatataaagcaagtgacttataatttaaagttctcctaaaacatgacaatcaaattaacccctttttgtttgatcctacatcaacctgtccaaatggtctactaactggtcaggaattttatagtatgtgcattctattgactttaattggatattttcttgaacagaataaaaaaatcaaacgtgattttgaataacaagaactgacaatgcacaaactccagcaaaacattaacccaaaacaatttcaagaccataatatgattttggaaataaaccatctgatattcaaattgtccaatagtttcctctaaagtgatacaaaaaattatcgtctgaaatcattaacttgcacactctggaacattaaagtaaatcttgataacttatcaaatacaatgaacatccatcctcttaagagaaacagtatagcagctaaaaacaaagcagctttttggcttatatgagaagctatctaattttgtttgtttttctgttctcaagaaatggttttcattgtttctatagatcgagttaaatgttggactgaggcaatataacacaatgaattcacttaggagacctttccagtaactactctaaaataatcctgtattacttgccctttttcttcccaatgaagaaaaaaaccactccctttagaatatggtctaaagactgacatataagactatgttgtgtgtgtgtgtgtgtgtgtgtgtgtgtgtgtgtgtgtctatatgtctgtgtgtgtgtgtaaccacactaatatgatacttacatagcatgaattaacatcataataacaatcacttccctttcaaacatacataagaaagaggctagcttataagagataatatatgtaaaattacagttgtaacatcttattacttgcagtagtaaatagcagtgagaactcatgtagatagagagcacaaggctggttaccagaggctggaaagagcagtgtgggggttgcagggaaagtgggaatagctaataggtacaaaaatatatatttagaaagaataagacctagtatttaatagcacaacagggtgactataatcaataatttaagtatacatttaaaaataactaaaagattataattgaattatctataacacaaaggataaatgcttgaagaaatggataccccatttaccataatgcgattattgtttattatatgcttgtatcaaagtatctcatgtaccccataaatatatacacctactatgtacctaaaaatttttttaaattaaaaagaatgtaaaaaataaaaaattcgagtgaaaataatttcaatggtgtttattgaactatttgcatgccaattcactcttcattatctttttctgctacaaacataagtatacgaacttaatttgttccttgtaatctaatttcaatgactacatgtggctatcctagggaattagtacttaatatcataatttaataattatctttagaaataaatttttaatttgaaattttaagaaattaatatgagggtaggaagatttgacaatatgaacactaatgttcggatctgcctgtaacacaataaggagtttgagatggtaaactgtaagaaaaaggaatacattcattctctaaagagttctgtactggagcttcttaatcatttcaatttgtgcactctcaaacaacagtattacatccaggcaggctgtccttactattgtcagggtacaactgacaacctgtggccttctcatctcaccccaggctccatccagcaccctatgtggctcaagcattgagtccagaaacactgtacacatccaacccctattactccctcagaaaactacacttcagctaccacttgggcccagagaggtgttcacactgtccctggaaggacttgacctatggaagggccacagatatttcctgcacatgggctctggcagctaggttggggtattctggggtcctgagtacccagagcatggtttagaaaagagagactgtggctatcagttggtagccatgtatccgtagacccagctatttattccatttgtagaagggttctctgaagtgggagatccaaggcaagcactctggcagcctcatcaaaggcagctggagatgacagtagtcatctcaaagttctgccaataagcctatctctttcagaaacacatcagctattttactgttaatatggtgaaacgagaaataaccaagtcggtagctgtggatgcacttttcctgaggcttgcatttccccattatatccagcttaggctggaccagaagcctcttccaaatgccataagccaactaactctaatctgtaaaatactaggttgaatcaacccatccttagataataccctgactgatctggaaaagaaaaaccaaaagttgaatctaatcatatcatagacaatcaagatagacacaagcagactaccaagttgaatagctccttgttaccaataacaataaaatagttatcaagaagggcactttacgtgggagggattgcaggtaaaaagcagcctccccattgctcctagcattatcctacaaataaaatgaaacaccacacttactcactggaaaacatctggtagttaatataaaagactctttataatctaataccagaccacattttccgcggtgatcttttctcattcttcctctcctgcttctaatttgttgaaatatactacgacttctgtctttggaaacaatgttttattcttgcctccctgaatttcttcctatctcctggtcaagcatggccttttcaaagctctatgactttgtgtgtaggctgtttgtttgtctacttcttcacctggcaaactcctatttaaccctcagagtccaacttaaatactatctcttagttccctgacccatccaagcagagatggtgcctccattatctgtatatatagcaattcattaatatatacagcaacacatacaaagctgtattaaagtaagtatctacactagtggactgtagcatattctaagagagggacaaggtcttattgttctttaatctcccctgttttgcacatagtagattgattgttgtgtatccacttaaagcataactttttaaaaaatagaataacttccattcagcattacttacgtgtactgagtaaaagagaaggttggaaacaaagatagtgattttgtttttaattttatataaattgtatttatcattctgcaactagcctatttgcacaaagaatcaagagtcagcagcatgaaaaatcttggttattagaaactatgtaaaagcaactggagcctagccatccaatgctgcagtttcctattttatttttcagtatctagtgtttctctctctcactctgctgagtagtgaaaagttaggataatccaattctttaaatattattgatgcacaggggatccaattttaatatttggagaagataaatctacttggaagaatatactgaatattgtattcttttccactatagcagaagtgagcagttatcaaaatgtaaatttcagacatctaattgtatgatattccactcactaaacaaggccatgttttcattaaagcttggattaaaattccagttgtgcatacacttggaattttaaaatttcctcatgagtccatataggttgcatcacccattcaaggcaaaacacacacacatacacacacacacatacacacacacttaaggctacttttctcatttagggtataaacaccaccattctgagctgggaaaggcagaagaaaagtaacagaagggaggctgtggctaaaaggccattatgtacatagagcagaaaggtgtgtttttgtgtatatgtgaatatacacatgagtgcatgtatgtgtttgtccaactaatgaaaagaaggcatgactgacactgcaaaatttctcactgccaaccaaaaatcacctaatatcagacaagaacggatctagaaaattacccgagctctctaacaggcaaacctcaaacttcccacattgtctccacactaacggcagctatatcatttcaaagcccccatgaaaccaacaaccaagaactactctccccatccatcatactctctgcccacatcccatacccgacaataataaaaccacatcctaaaagcagcagatcaagacttaaaaaaaaaagaaaaaatttaagaataacagtattgtccaatcactcaaatatcatcttatcaaaaaagcaatttccaccctaaaccaactgaaaggcaccacaacacttagaaagacatcaatcacatggaattattttatttttataaaagtaattataggccaggcatgtctgtaatcccagcactttgggaggccgtggtgggcggatcacttgagcccagcagtctgggaccagcctgggcaacatggtgaaactccacatctgcaaaaaatacaaaaattagctgggagtggtggtgtgcacccatggtccaagctactcggaaggctgagatgggaggatcacctgagcctgtcaggtcaaggctgcagtgagctgtgaccataccacttcccttgagcctgggtgacagaacaagatcctgcctcagaaaaaaaaaaggaattataataaaatctgaaaaacatgaaattgtgtttacaatgaatctttagtcaagacatgcaaatagtcttcctactctgaaaatagacctcaaccataatttgaaaaatatataaaatcctattctcccacaagtcagtcaggtagtaaacaagtgttttctcgagctcctgctatttgctaggcattgttctattaggccgtgggtgaacgcatatgcaattaaaatttttaagataatttcaaacactactaaatgtaatgaagaagtatgaaaatgtgagagcaagttcaagttattgaagaaggcctccttgtggaggtgacacggaagccaagaaagatgagaaggaaaaaaagcatttcaaacagaaggagcaagtgcaaaagacccaaggcaaaaaatgagccttattgaacggaaattagtaaaaaggagggaaaaggagtaaaagtcattagagatcttcaagcaaaagtgtgccttgatctgctttatgtaacagccacttacatgttaagtgatcttggatgaattactaatctcactgtacctgagtttcttcatctataaaatggggatagtaatagcacctacctcaaagagttgtggtaaggactgagtaagttagcatgttatagcgcttagaacaatgcttggcaaaagaaattgtgaaatgagtgttaaccactttttcattagcattaatatcttctgtatcatcatcagtaaaaaataatcacttgctggcagatgaaataaataactggatgaatgtaagagtggagacagagagaccagcagctaccaggccactgcattaatgtctgggcaaatgatgattttaaaccaagattacagaatgggacagattcaaaatatattttattaagttgataggattattcaatgaattaaatatgcaaagtgaaccaaataaattaaatgagactcctagtttttaacaacttaattgagataaaattcacacaccatataatttatccatttaaagtgtacaacctgatggcttttggtatattcacagaggtgtacaaccatcaccacaatcaattttaaaacatgttgttaccccaaaaagaaatcccatatcacccatcacgttgactctcgtagtcatgcagttatttatttcatctaccagccagaatcactatttcttaatgatgatatagatagtacaaccaccagtatctaaagatttaactgttcaggacatttcatataaacagaaccacataatatgtgttcccttatgattgacttttcatatgcatgaagttttcaaggtgcatccatgtagtaaaatttattaatactgcatttcttagtgctaaataatagtccactgtatgactataccatattttatttatccattcgtcagctgatggacattcgggttgtttatccttaaggctgttgtaaacatttggctgctatgtacatgcgtgtacgggtttttgcttgacaaatgttttcatttctcttgggcatatttctaggttatatgtaactctatgttaaactttttaagtaactgacagactgttttccaaagtggctgcaccatttcatattctcaccagaagtgtatacaggttccaatttctctatatcttcgccagcagttgttactatcttttttattatagctgtcctggtgagtataaagtagtatctctttgaggctttgctttccatttcgctgatggctaatgtgttcattttcatgtgctcattagccattttacatctactatggagaactgtctattcagacctttatccattttttaattgggttgtttgtcatttcattattgagttacaggggcaaagcaaagcaccttaggcaaaggcaaggttaatttagaaagaaataattgtccaatctaataggtatggtagtgcacacaagttgttagctcttaaaggcagagactctgctataatttactttaaataatatagttgtccctttcacggcacctagcagaattgaaatcaaatattttaaagaacatatgaaaatactggaatactcccaaaaaaagaagttcttcagttctaatagaaggctataacatttaaaactaatttcctgtagagattaacaaatgaatttcacttcatgggtcaattcaaatcagctggcagagactacctagaacagtgttttcagagtgataatgaagctgtagctgacttagaacaaattaaatataataacatcttccatgagcatcagaaggggtaaatgggggcatttgtgatagagcaccatcccaaagaaggtttatatattttgaaaatataaaagcaattaaagaagattgttaaggtgcaaaggttaaaaaaaaacttgagatatttagagtacacacttaatatcagaaaatgatcaaataaaatgcaaagactgtgcttctaccaaaatatttacttggtgccactttcagaatcagaatattagatcaaatagatcattgatctaactcagtatgtcatttcacacatacccagagcctctatctactaatcctatttttcttttttttgcttttgttttgagacaaggtctcactttattgcccaggctggagtgcagtggcacaatcatggctcactgcagcctcgacctctcaggctcaatggattctcccacttcagcttccctagtagctctgactataggcatgcaccatcacactcagctaacttgtgtgtgtgtatgtgtatgtgtatgtgtatgtgtgtgtatatatgttttgtttgtttgttttcggttttttgaagagatgaagtttttccatgttgccaaggctggtgatcctcattttcatataactcaacaaagacaaaatggtgagacttactttttcatgtagttgaaggtgtgaatgacatgaggtgtgaataatatcaccaacaagtcttacacgattcagtagtaatgaaagtctgtataaattatcaatgtcaattcattaactctaatatagagatgatttcacattataggtatatacatcacatttcatcttttcagcaaaagtaaagttgcataacatttgcttctaaatactactttcaaagtggtgactcagagaaaaatttaaacaactagttttaatgacagacctcaaatatatatggcataaaaagacaacagttttagtaattaaatcatacagtctacaagtttacaaccattttgtattatacacatatcacatatagatattttacctctctaggttttcagaaaccgaaaggacagtgagaatttggaacacagaatacacagtagctgcaggagtggagccaccatttccaaactacacaaacttagtttcacgtgatcttgtagtgatactgagtattttttaatttatcacaggaaaacaaaaggattctgacagtctcttctgtgagaacattaatctgtcaggactctgtgaggagagacagcaaagtccaacagtttaaaccaaaacaagagggcatgaaaagctgtatctgatcaagaagggcactggcataaagcaggctaaataggtacatgggcttaacaccagcgaacctctcatttgcttcacgtctttgtttttttctgagtgttggcttagttctctgctatcactgacagttttctcttcttcacatgaaatatggtttctgacagaaaagttttataaccttttgatgaaggagatgggcaggacttgttttctggacttgttactctgtcaggatttggtaaagtgaggccatcagcaggaaccggcagatggcaatgaaagtgattcctaggtgccctcattgctcattggcataagacactcccaccagtgcaatgacagtttacaaatgccatagcaatgacccagaagctaccaccccattccatggcaacaatgcagaagttactgcccctttccttggaagttctaaataacctgccccttaatttgcatgtaattgaaagtgcctttaaatgagtataaatacagttgtcaagagcccattctttggactcatggtgcaatgcctataacttagccctgtaccccaagcagtaccatttaataaaagactgctaacacctccagctcagctagtcctagaattatttcccagggtatgctaagaactctttgggctaagccccaattttagggctcacctttcctgtatcagtttcagtgccatgaccaaagctttaaaaagattatctttcctattttgagtttgaaattttttatcaaggagggacaaggaaaggcccagactagatcacatctcttaaacaatccctgtggtaaaatgagtactgggccagatgaagcctgattatagctatccatgtgggtaaggaaacagaattcattagaagaaagaggggacataggactaaaaagtcaccccaatgagtttttattacaatttgccaatattagaatatgaaacagagaagtgagaaaatgaagccaggaagaacaatttggaatgaaatcatggcaatccaggaactaaaagacaagtatttgttttcaacacatagtaactgtgcaccaccgcagcaaggataacagatatggtccctggccttagagaatttagagtctaatgggaaagatggaaaatacataaataaatccatgagcatatatatgcaaataaaattatagtgctgtgaagtaaattaataggttgcaaagatagaaacacagaaaaggacctacttagattgggtaatggagcaagatccctccgaggaggtgacatttcaactgagacctaaaggaggaggccaaagctatgtgcatagggaggtgggggctacagggtaaacgagatgggggcaaaaaaactactgtgacacctgtgaggcagaaatcgcctcagcatataagagaaacaaaaataaggccagcataaaatgtgtcagaacataatgctcaagttgaagggggagaatgggtgaagctggagaatgggcagaagggatattgctaatcatggtaaaaaactgggatgtttccctaagtgcacggtccattgaaaggttgaaggacagtagttgagtgtcacaaaatgaatactgcaagctgctgagaggtgaatgacaggaaagggccatgattaaatgtggataaggagatattgtgtcattccctgcattcccagccaagccacattctacaaagaaatctcttcattgtctatggatccaaggcttgttactttaactctgtaagtatcagcttcccccttaataaagcaggaataaaaatatccacatcaaatggaagattgtccgagaaattatgtaacgtaagtcttggtatatggtaggtactcagaaaatattaggtctcttctcatttacttcctgtgtagctaataaaagttcttccaaattcatcagcaggtgctaagttttgaaaaataaaaaactagacctagacaacttggtctaggtagcggaaacgaagtatctaagcaatgcagacaaactagtctgaatggaaaataaccttgacttgatcagaatatttactagcctctatattctaaaccaaaaatctgaactacgaatttaagaataaactctaaattcaacaaccatccaaattctctaccacaatctatacaacacagagaaaacctaagtatgaaggtaaataaatatccttgagttgttcatctttctgatttgctcgttatctttatctgttacccaggtgcataatcgtgttattccctacctttttaaaaagttacgtagaaaatttaagaattcaaagaatctatgaaaataatttctatacatctttaatttcccttcttacatattggtattatggctataaattgtctatattgtaagatcccttaaataatttttacatataaaagattttttcataaataggattaatattagagaatatgagcttcaggttacattcatcatcttggacttcccaaagagaactcgacaaccctggcaatcatactacagatgattctcttataaaaagaataagaccaaaaaatggccagtataaatgatcctctagggctattctgttcaatatgttagccatgagccacatatgactattaaacatttgaaatgtggctggttggaattcaggtgtgctctaagggtaaaatacatgccggattttggcatctcagttgaaaaacaaaatgtaaaatatgtcaataatttttcttattgattatatgttgaagtgatcatatttaggatataatgggttacataaatacatgtttaaaattaatttcactttctttttacctttttaatattttattatcagaaaatttaaaactatacatgtagctcatgtttgtcttgttatgtttcttttatacagcacagctccataatgatgtacattttaaattaaatcaactctgcataaatctgttatcgaacaagtcaggatataaataaataaacaggtgaattcgtgaataagtggataaagttcatgatatgatatctctggttaaatgatttcaaaacgttgcttaataattgtttgagcaaagtgataagcataaataattaggcaagtgtttaagttagtattacattttgtctgatgaataaacatgaattaaattaaatgattatgggtcacatactgtgctagtcatggaacacatatatttaagacaaggctactgctgtcatgtggtttatagttttacggaaggatataaacaataaaacaaataaatgcattaaaatgtttttggtgctgtgagaaaggcatttagtagttctctaaaagaaatgtaagagggcatttttcttgtttcagagcatggacactaatatccattttatcctttggagccgaagatagccaaatgtccttcagtgtgtgggggtggcctgaaccatcaaggatgttcagttcaaattattcatagtgtcactactgagaaacacccagcgtcatgccatgctatgaacaggatcaccactgtagaacacaacacaaatatcataagtattttctgatgctggttcctgaacactgtggtgactccagagactggctaaatattgtgagaccccattctaaaaatgcaatcaacataagattacacaaaatcatctctgttctttggtgtgtaaaatccatacacatatacactaacatatgtatatgtgatatatgtatacatatttatatattacagacgcacacatataagtatatataatatatatataaatgtaacatgtatcattaatatattttgccgttttcaagctgagaaaagaaaaaatgtttattgaagcatttaacagctataaaacagaatgttcatatataagcttctctttaaactttttcctttacaaataattttgtcactaaaacaggaataccaattttgccattctcatctgatacccaactgacaattaagcaaacagagatgaagaagacaaggaggaggaggaggacagcattctgtcatctggtagcagaggttactctttatcttttttttttttttttttttttgagacgggagtcttgctctgtcgcccaggctggagtgcaatggcgcgatctcggctcactgcaagctccgcctcctgggttcacgccattctcctgcctcagcctcccaagtagctgggactacaggcacccgccaccacacctggctaattttttgtatttttagtagagacggggattcaccgtgttagccaggatggtcttaatctcctgaccttgtgatccgcccgcctcggcctcccaaagtgctggtattacagccatgagccaccgcacccggccctctttatcttttaaacattactaagagaattgccaatctagaatggtagagtgagcaaaagacagtccccatgtaatataaaaatgccagaatccttaaaggtgaaatgagtcaaactactaccaatagacattaaggtaatcactatttgataacaacaacttttaaatatgtatgaaacctataaacgtgtcatacttcactgtcaaacctgctcatcgcttccacccaaatcaaagaaagatcctttaaagaactcacattctagaatcgtattcaggctggagacaacagaaatgttttaatcaatgcataaatctagggtagtgaagttatttgcctcaaaaataacagtgtagtacccttttcaaaatgtcttactacataaacttaattggctctataagaagtgaaaactttgaaccataaattatagagggaaatctagcataatggtagaacagtgtccaaaaagtgataccctttttgcattaaaatattcagggctaattatgattttagcacttgtttttatccttgctttgttcattggccaaacttaaacacttctcatctccttcaatgaaaagtggtgctattatgttcctggaagcatgagcagggttcctcaaagcctaattttaaggtcttaattggctgaggcaatgggagaccatacaaagcccacttcacagagaagggcaagattgccaggtcacttgagaacagatgaagagctaactggaagctattgctgaaaccttacacagtgtcctgggaagttttagcaaatagtaacttacgcagaacagaacacaatcatccatcatcataaaacagaacccagaggggttgaagttagcttgtagaaacagaacagttaaaagattaaaactgttatcctcatttaataattgagtaccataacaaaccagacaagccttatggagattgggtactgttattggttctgtggtatgctattgctttcaaatatttggcttcctcctgacccttaagtctcaggaaccatgtgctcacaattaaagagggttgctatttactaacacttttgttcatttggtattactggatccaaagtctactttaaaatttggaatgctgaagaataattcattcatccatctgtttatccacccaacatttgtggtgtgttatggaataaaagacacttaagacgttgaataaaatcatctcagccctcaattagttcaatacttaataatataataataattaataatttatccaaatagatacattataagaacagccaatctggaattgttttaagtaagttacttcctttttcattactcctaattactggtgacaggttcccaaaacaaacgaaacagagaagaccaaattttatttgtgaaattcaagactctatagaaaaagaaaaggtaaaaatctggaattaacctctgaaaagcttttagattattctatgtttaccttaacgataaagacacatactagaaaaagatatccaataataatttacacatttggggttgacagtaggacttgctactgatttctatacactgtctagcgttcaactgaaactcagacactcttcttgaaatttcaataagatgtttataaatgtgttttaccttgctgttacaaaaatatatcagaggcttaatgtttttttctttttcaggatagttcctatgctacttctgactgtatactctagcctccttgccttgttgtttgctcctttgttcattcactcttacttaactaaacaactatttattgggcacctactatatatatatatcatacatttatatataatatatatcatacatatatatcatatatacatatatcatatatatatatacatatatgatatatatatatatatatgtcagtgtttgaaaagaacaaggaaaacctccatctgcccctattatacaccatgggtgtcttatttctcagttttttccctctattggcaactggaattcaattctcgagtttaggtttactctttgtcattcttgttttcccaattttttttttttttttgatacagagtttcactattgtcacccaggctgtagtgcagtggcacaatctcggctcactgcaaccttcacctcccaggttgaagtgattctcgtgcctcagcctcccaagtagctgggattacaagtgcccaccatgacgcccggctaatttttgtagttttagtagagacggggttttaccatgttggccaggccggtctcgaactcctgacctcaagtgatctgcccgcctcagcctcccacagtgctgggattacagaggtgaggcactgcgcccagcccccagtgctttttcctgcagataatttactccacctttacctctattaactattccagaacacaagttccctctatttcacattatccccaacaagaatgacccataactgatgaaaatttaatatccaagcaggaaaagttttctgactccaagaattataatatgctagaattctggtacaagaggaagttcatgctaattagagaagattgtaattcacaaagttaaaatcctgaaagaaaaatctccctccggaagaagtatgcagtagaaaagatctcaaactcttaaataacattaactctaattaattaatttatatggaataatcaggctttggtatttttcagctatattggtagatctttcagaaatcacaaattgaacaaatgtgatctgaaaatgcttttgtttcccaaaaccacaacttccccagtaaatgctctaaccattcaattacattcctttaccttgaataaggaacaagtagtataaggtactatctataaaaacaaataagtaacttctataagatcctttttgtaggcaaccagaatatgtctcaccctttccttcccaatacccaaatcccccaaaacagaggtacttgttaccttctcttgtggtttagaaaccaacagacatctcctatgtctgatgaccatgacagccatgatgtgtctgatttagccaaggcttcaggagcttataaccttgtattaatagggaaaattcctaacaacaaaaagcacaaagaaaatcttttcttgatgactgatcccgtaacctgtaatttatattccctcagagtatttataggatttcatagtcatgaaagacagaaggcaagatcccttaagtggttgcttctttgaaagcaccaaacctacataagaaaagaactgtagaaccaactagagctactccatcaacaacccctcccttttgaaaaacatgcacccacatatatacactccttttcatagctttatatgtaaatttttgtgtaaattgtcttttatctgaattaacattttaaattccctaaaagcagagagtgtcctctttcatatatggaattcaatggcatcacacactccaaagacactaacaggtagtctttgaaaataaattgcttttggcttgcctatgggttgcctgtgcaagacaagtgcttgaatcagcaccaactgaacttaaggagaaaaatgtaagccatcgagccaaatgtgcattatatagtcatgaatctcatttaatacttctgcctagctaataatataaataagtggatatttcaaggaaaaagaattttaaaaggaagagaatatagtttaatgagtacataattattaatattttacaaaataaactttggaagtgagttgctggaaggtgaacaaaatatttgagaactggaaattttaaaaggtggtggcaatttctaagtgctcctgatagaaaactgatctgagaaaagattgcatacaaaattgttaatgaaaaataaactacatatttgggtggaattagagctgtggaaaagaaataagatgattagtcacctgaacatggttatggaggcatggaaactgaaagacaagtacaataccgctgtgaaagagttctgattgctttacacagagaaatgttcctgaggccaaacaacagttaccccttgtctaacatcgaccttataccacgacttaaacaaaaataaggtaacaattctacctagcagagaggggaatcatgaggaagcagtagagcatctcactttaacgtgaaataaagatcaatttacaataaagtaaaaaaatttaataaattttaaaattttgcatttagaagcctcaggggaagcttagatatccatgtcacctcactccagaagtcagagggagttacagaagtggagaggccaaatcttaatgcaatattttgccagaaaatatgaaaccaaaaaagagaccgaaaaaccaaggcgaagattacatgaggaagtctccaaaagcaattgcaatgaaaacaaacattgacaagttggacctaattaaactaaagagcttgtgcacaacaaaagaaactatcaacaaacagacaacctacagaataaaagaaaatatttgtaaattatgcatccaacaaaggtccaatatcaacaatctgtaaggaacttaaatcaacaagcaaaaataaacaaccccattaaaaatgggcaaaggacatgaacagatacttctcaaaggaagacatgcagccaacaagcatatgaaaaaagttcaacatcaccaatcattaaagaaatgcaaatcaaaaccacaattagataccatctcacaccagtcagaatgtctattaaaaaatcaaaaaataacagatgttggcatggttgcagagaaaagggaatgcttatacactgctggtgggaatatcaattagttcagccactgtggtaagcaggcaatttctaaaaaaacttaaaactaccattcaacacagcaatcccattactgggtacatacccaaaggaatataaattattctaccaaaagacacatgcatacgtatgttcactgcagcactatttacaatagtagacatggaatcaacctagatacacatcagtggtggactggatcaaaaaaaaatgtgatacgtatacaccatggaatactatgcagccataagaaggaatgaaatcatgtcctttgcagcaacatgtatgcagctagaggctgtaatcctaaattatcctaagataattaattcgggaacacaaaaccaaatatcacatgttcccacttattagtgagacctgaacatgagtacacatggacacaaagatgggcaacagtagacactgaggcctacatgagggtggaggatgggagaggggtgaggatggaaaaactacatattggatactatgttcactatcatagtaatgaaatcatttgtatactaaaccccagtggcacgctatttagtcatataacaaatctgcacatgtacccctgaacctaaaagttgaaaaagaaaaaaaaaagtacattttaaatgtttgctccacaaattccaaaaggaggaggaaaagggtatgcattgctatgggatctctgtaaaaagcatttttatttaatttgaacctgagaagttggaagatattccaaattcttatttattgattcttattgttaacgtatttcagccaaaacttttttattctctcttaatagattatgtctctgtctggattaagagaaggaccaaaaaagtgatcatttgtagcagtaataactatgtatgcagatatcaacattgtagaacattataaatatactagaccaaagttgcattttctaactagatgtaaccacatattaaatagctatatttttcctcttttaacagttttgtcacttccatgctgccaacgcggagtcacagaatctgcaggttcacgctgagcccttttggttaaacgcatcactgaggcaatcagaatctccttttgctgccctttaactgggaacagcaagttctgccctagtcccaggctgggctggtgggggtgtgtgtgtgtgtgtgtgtgtgtgtgtgtgtgtgtgtgtgtgtgtgtgtgtgtgtgtgtgtgtgtgtgtttacccagtgtttagtcttttatccctcacccccctcccatgcttccccccaagtccccaaagtccactgtatcattcttatgcctttgtgtcctcatagtttggctcccacttataagtgagaacatacaatgtttgcttttccattcctgagttacttcacttagaataatggtctccaacaccatccagggttgctgtgaatgccattatttcattgctttttatggttgagtagtattctatggtatacatatatatatataccacattttccttatccactcgttgattggtgggtatttgggctggttctacatttttgcaattgcaaattgtgctgctataaacatgcatgtgcaagagtcttttttcatataatttcataatcttcataaattccctctgggtagatgccccgtagtgagactgctagatcaaatggtaaatctacttctagttctttagggaatatccgtattgttttttattgtggttgtactagtttacattcccaccagcagtataaaagtgttctcttttcatcacatccgtgccaacatctattttctttttgattttttaattatggccattcttgcaggagaaggtatcaccaaattttgcatgaagaatatttgcttgaagataggtatttaattgaaattacatttacttctcctttcctcccttaacaaacaccattatgataaacacatttggtgaaatatttatgaggattggtgtgtttagggaatatctcagaagacacagtacatactgcagccattttcttttccttgaactgtcaagctaaactcagcatgaacaaagacagaaatattaacgagtacccaacagaggcctcactgatgtggaataagagatggtattacttagatatatacctctttggagtgtacacattgaatagccatagtcacagcaggcttggaaaataaaagcagtctcttatttcaatatgagcttacaattgcaccttaagaaaaaataagaaaattaatttctgtatttgttcataatcattggcatttcattgcaacgaaatcatactatatagaggtctccccttctaaatatcttttaagaaaggaatccttccaactgtcataaacatttgactgtctattaacctcatagtttcaaagtatgcattcttacaccttagctacatcttcccaactgtaatttatatctctcttctcaagactgaaagtgcttcttagttaacttatattgggtcattctatactcagaatggaagagggtaaagagaaatgtttaacgtaagggcaactcctgtaccattgacagacccaggtgaacttctagctggagacatgactgttttaacagggaaaaggaggaagaaactgtggatcataaattatatgtatacctcttctggccccagtgaactttgaaagctttgtagagagacaaatatttcatgaccacaaaagtgtaagttagtcagatggaatagttcttggaaatagttgtttcgtggaatttatgtagatgactacaaagactaatttgtgcttttgaaaactacagtgtccattaatcactgtgaatttcaaaaacaatagaaaggtatggtcttgagtgactggttagaaagtagttatcactttcatagtggaggcacaagaaatgaaaggtttgatcttagtttcctctttatgggagagaaaggttgcatccaataatattataattaaattcattaattgggccttgaggcttgatgttcctgtgagctattcaaaaaattataggttatcaaatgatgtgaaagaaaattttagaaatattacagctatcacaacaaaggagttaatgtctaacagtaaaactattgtttctggataagcatttctaatggtatagtcattaagacagcctaaagactttgaaattttgacaattctattttctttcaaacattcttaacaaaaaaacttgatctctttaaaagttcagggaagaggtcccaacaaagtgaggaaagccaggttggtttcaatttagaaggctcattgaggttgacagagtattgctggtttattttgatatgctatatagcagtgcaaacacaaaatcgagtttcacaaagtctgctcccatctgtaactgcctgtcaatcctggagaaataacctgcccccacttccctcccagcctaagctgcctcaactgttaaatgggattaataacctcagaagtttattttaagagttacataagataatacatttaaaacctgcacattaccaaaccctcaagaaatattaggttccttcatttccctaatggtcatctcaaggaatgaagtaagtagttgaacattaagatctaatgtcacttgtataggactgtgggtagcgaccttgtcaaaatgtgatgtaactaaaaaattacttttaaatacaggaacaacaaggtcaatagtctcaataggggaaaaaaagcaaatctataatttctcatggttgatgtgatggaactgtttatctgatctacgaaggagagcatgcacatcaaaatctcggtaaatactatgagggagaacttcaagggctttacactggacagataaaaagggaaaagattcttttgttgccaaatatactagtttcaaaaaatccactgaagacagctaagctaataaacattatcagactagtttggtgataatttggagttattcttcatatttggtcttgtgttttgaagaagcagaaataagaataaatcaataaggctatgttttctttttgattgaaagaacagacctaagtgtgtagttagaaattataggggagtgtagcttctgttgaagataccataataaatggaaaaaaaagaggtaggagggaaatctgtgccatccatttatccatccacccatctatccacctgcccccatacacaaacatccattacatgtttactttctgttaaatataaaacatggtaccagatgcaatgaggaaacaagagattaaaacctagtattaaataatatatatgcagataaccagaggaaacagcaataagtggcaaatgtcacggaatcctacctgaaagttttaactgcaatggagtggtaaaacaaaaaaattgcactagcaaacatgataaaaagggctagagtttacatagaaagagaagaggaaaaaaatggtaggacttttgtaacaaaattgaactttatttgtttagcagtgggaaaaccactgaggtttctaagctggagagtcatgggatcaaagctgtgttaaatgaagattcatctggcagaactgattaagcaggtgtgtgtgtgtgtgtgtgtgtgtgtgtgtgtgtgtgtgtgtgtgtgtggtttctccaataaaacctgttaggtagaggtcaattgtggatgtgttgtaagtaatttatcacaaaaaacacaaaaccgaaatcggtgatttacttttttgtattaatttgagagtattcgaggttatttctgtaagatgtcactcttaccaaatgctttactaaacagcagattaaagaatgcagaaacaaatagctggagcccagggcacagtgtgaccatgaaacacccacaagagtgttcctgcctggaaaaataatctgtgttggactttagcaggcatataggtgaggacaagtccagcagaagacacagactacaggttaggaagatcatgcaagtaagatgcttctgtaacccttgtaagtatgaagcaataaagagctaaataagacaaaggtggtataaaggttaattttatatgtcaacttgactgagccacagggtgcccagatatttggttaaaatttggagtacgtctgtgagggtgtttctaaatgagattaacatttgaatcagtagaccgaaaaaaagcatattgcctccacaatatgagtgggcctcatctaatccactgaaggtcccaacagagcaaaaacactgagcaaaaatcactctccctctgcatgaacgtcttcaaactaggacatcaattctctcttgccttaagcttgaactcagactggaacttataccatcacctgtcttggttcttatagcactggactaagactggaactataccataggtgctcttgggtctctggcttgctgaccatagatcttgggacttctcagtcttcataaccacatgggtcgtgtgtgtgtgtgtgtgtgtgtgtgtgtgtgtgtgtgtgtgtgtatttgtgtgtctgtgaacatacatagaaacacaccctattgctactgtttctggagaacccagactaatacaggtggtctaaacagaaagagaggaatgaatatatgacaaacagctaagaaaaactttgtaaagtcaccagttgtagtggacaaggaaatgggagaatgtaatctttttttcaaatcataaatataagagagattttaaatgcttacaggaaaactttcaaattaataaatgttttaaaaattccctaaagattcaaatggaaatttcatggctataaggcatatataagttttacatagaatatgttgatgtcctgtatttttaaatatttccattttatatttcatgacatgcatatgtttattttcagcaactacatctattatgtaaaccattctggactccagtgtaatcaataacaaagaataatcaaacttcaaatccttaaaattcaatcataaattgaagtttagaacccactaaaggtacactaggcatctgaaaattcagtctgttagaggacatagataattttattaaatttactaagtgcagtaacaatatttttgtttgccctttagttcccttatttcatgtttcagccaagttctttcccacttcaacgcttcataaatgctgttccctctgctggaatggctatgctcatcaccccttacatggctaaaggtcaggcatcactttctaaggaaaccctgacttcaacatctccctcacccataatctgtgaagttagatcctccatatactcttagagcataatctatactgctacaaaggacaactactctagtagacacagtgtcgatggccaacatgaaaatgttctaaacaggaaaaaagaatataataatgaatacagaataataaaactagcctgcattgtgtcttcatactaacataatcaaaagtttaattttttaagggaggaaggggcccacaaaagcgaaagtctttagggtccacaaaagccatatgtccctagttactctgcattattgctaagaaatgacaccctgacttttttttttaggctggatgatagtacctacctaggaattaaataaaattataaattacttaaagcacttaaacagtgtctggcacatagcaataaatgttagatgttattactgtttaaaacaataactgagggctgggcacggtggctcacacctgtaatcccagcactttgggaggccgaggcgggcagatcatgaggtcaagagatcgagaccatcctggccaacatggtaaaaccccatctctactaaaaatacaaaacttaactgggtatggtggtacacacctgtaatcccagctacttgggaggctgaggcaagagaatcacttaaacccaggaggcagaggttgcaatgagctgagatcgcaccactgcactccagcctggtgacatatcaagaccccatctcaaaaaaaaaaaaaaaaaaaaaaaggaaaaacagtaactgaaaacactattcattacattacattcaagagaatacattcctcttgaatttagttttcaaaataagtttgcttctcccaagcagtttctgtgttccatttaagataatacaaaccatatgacctaacaggtatccctcccagatgtcagaaaactgagagctaaataaagtgataaaccaaaacaacttcttcttggtgcctaggacactatttctctgtttcttattttttttcctgtgatttttagatttccatcgatgtccattttaacactatagtacagattttaacactatagtacaagtcaaaataaaaggataaaatttgaaaatatgactacgtaatatcaagggccttacaacagcctaagccaataaggactgtctccatttcgggttcactcataatccatgtaacttctttgaattttcatagtatatttgaagaaagaatatcaaatacgtatacctaggcataaggaaatcatactcattttgaaaataccacgtttcgcacatttccagaactatctcaatatatttcaaggttaatacagtaaaagtaatttatgaatattcctaatttactgataagtgtccaaaagtgggtgcacatttccaaagagggtcaagcaggctggaaaatttcttgatatacagggaatcaagtagcagagaacctattacagatctctaatttcattattttattggtatattagtttttcatagatgctgtaacaaattcccacaaacttagtgccttaaaatgatgcaaatttattatgttacagttctgtccgttagaagttcaatacgtcttactgggctaaatcaagtgttagcaagggtaccttcctttctggaggctctggggaagaatccatttccttgtcttttccaggatctagaggctgctcatatcccttggttcatggtccccctcttccatcttcaataagcaatcttcagctgagtctttctcatattgaatcctactctgcttccctctttcacttttaaggaccacgtgattatattgtgtcccagataatacaggataatctcatctctagaaccttaattttttccagctataaaatcccttttgccatgtaaggtaacatattcacagattcaacccagtatccaaccctgttaggttgtggacatcttttggcagaggagggagggaataggcaggcattatcattttgtatgcaacattatagaaaagacagatagtactcattacaacacaccatcaaagcagaaacgacctcccagaaatccatatttgcaacaacaaatagtcaaaatgtacacagtttccatctgcatttgttttaaggtagctctaatataaggttttaaaaaaaaaaaaacacagcaaatatatgctttgaatttaatgaaagctacttagtaacctaaaagctcaaatcgaatctattttagcacaaggagctttgccttactcatctccctaagtgtgctcatgattcaagtttaaggaagaacagctttgctacacaaataatctataaagtgaagaaacaagaaaatctaagaattcacataatatatttaacatttctgaattttccagaatatatttcagaatacacacacatacacacacacacacacactgtctctcccctcaatattttggaagaggaaaaatacaaactttaaatatttaaactccccactcaatcaatactggtctgttgccaactgaatacattactggaaatattgaaaatctttatctctaaaattaagttcatccaatagaagtgttataaattttaggcccgttacacagaggtgaaaaagggagggctcagagatatttacagttaactaaagaataatgaatcataagtttccactgcccatttactgactaaagacatgaatgttgatttcgcattcaatcacagttgacatctgcacagatctgtgtatagcatccctaggcatatcgttaatttaattctggttctaggaatatttagccaatgtagtttaacttcaatccctgttgacctaggctggatttcaattcataacagaaaacatatgagaaacaaaattactgtaatgaaacatctataagcaaaagaaactaagaataaaacatatttcttaaaaaattatgatttgactctaagagcgggcataattttttaaaaactattctttctcaattggttgttaaaaacaattataggctgggtgcagtggctcatgcctgtaatcccagcactttgggaggccgaggcgggtggatcacaaggtcaggcattcaagaccagcccggccagtatggtgaaactccttctcttctaataatacaaaaattagccaggcgtggtggcacacacctgtagtcccagctactcgggaggctgaggcaggagaattgcttgaacctagaaggcggaggttacagtgagccaagattgtgccaccacactccagcctgggcgacagagcaagactctgtctgaaaaaagaaaaaagaaaaaaaattataaagaaagcaacaagaaaataaaagaaggggtaacttcatgttaaataactgatgagttttaataatgttctcaatttatcaattaaaatcacttattttaattatctctaatgatctacaccattgaacttctgaacaagctggtcacaatgtaaaaataagatgctaaggccaggtgcacagtttcatgcctgtaatcccagtaactcaggaaaacaaggtctaggattatttaagtccaggagtttgagaccagcctgggtaacctagcaagacctcatctctatacaaaaattaaaaaataaaaacattagccaggcatggtggcatgcacctgtaatcccagctactcaggagtctgagatgggaggactgcttgagcctgaggggtcaaggccgcagtgagccaagatggcgccactgcactccagcctgggtgacagagcaagaccccatctcaatcaatcaatccgatgataaattcaattttaaaaaattaaccagagtccaaataaataaatgatattacatttagaaatcatcccataagttacttcagaatgtttaaatattacactccaatatggaatagaaaaaacttgcttcttcctgttttgggactaaaggacacttctatgaatatcatgattctaaattatttcttcagtaagacaaatctgaaaaactgtgaaatgatttgcagaataagtgatagacgaatgagtgactggatgactagaaaagtaaaccaatatataaataatgtataagcacaacataaagtctaaactacatgttagaaaagatacctacagttcgagagtccctccgttatttctgtcccacaaataaattataagacattatcctctgttaacagcaattgaccaccaactgtacaagtagcatagaaattcgaaggatgagcagggaaaagcagaaaaaccagctgaaaagtttctcagaacactgggaatgatgaaaccaaaggaataaaccattaaaaagttgagaacactattgacagatccaaaatctatcacattagattaaaatcagatttttagatagaaaaaatctaagtcatacagtagtctcccccctatttttagatagaaaaaatctaagtcatacagtttcaatttggtttcaatcactgcctgtcaactgcagtccgaaaataggtaagtacagtataataagacacctagtgacagagatcacattcgagtaacttttattatactatattgttataattgttctattttattaattattattaatgttttattgtttataatttataaattaagctttatcataggtttgtatgtataggaaaaaacagttcatatagggattggtactacctgcagtttcaggcatccactagggtgcctaagtctccacacataaggggagtctactgcatctctttatgctcacagccatgtatatggccagaataatcagtgaatagtgtgccagattcgccactaaggtggctctaatgctttggatatacatcatatgacaagctttatgctttggaagcaggttgccaaaaatactgatttggcaatctggcttaaaccactcctaagacttctaccaacgcaggtcatgccaaagttttacattgcaaatccagtggctacttctcatcccttctctccttttctccaaatactcatcctttctttgagcatatacaagggatagggagctaatgtatctttcctctactgcctacttctagactatgtatatgttcatccttttttttgagcttatataacacaaagattagacccaattacagatgctaagaagctacccatcaaaataagaaaaccactacaaaaattattgtgataagtgaatctgccaaatatactagcatattcaaaacactaaaaagatcttaaaagaagaaatccctaactcttttgcccttgttctttccaacattcacttctctacctttacttttgacctcatccacccgtatcttccaggatcctgctataccagctaaacttccacctgttcgacctctcccatcaacagccccttctactcaacatacataatcaggctcaagcttttctatgactagtagtacatacagaatcatactctaaaagttatagtcattctactcttaaagactgagactattttagacacaaagttttaatattctttttttttgatattttggtattttgaatttttttcacgttacactagagagttaaatcatagtatacaatagggctagaattaatactaacaatgttattgtgtccctaaatgaatcaggaagctcttagaggataccgtcacgaaatgaataaaatataaactatttaaatattgctaccataaaatgtaatacataactgaaatattagaaaagacaaatactgttacctaattccagagtgtcataaacaatatgtaaaccactctaattaaattacttaatcaacttctgccaaatatttgctgatttttattttggttattcagagtttaataagtatccaataaatttcaaaacagggaaaaataaataaatttgggccaatggcaagatatcatctctgtctttctaaatctaaactttggggaaaaactatgctttcttttggaagagtgattttttttttcactaaatattagtattatggctcccctattaactgtgctcctttagtgttctttcattacttccctcattcattcagttgttcaacaaatatttcacacgtctactgtgcaccacgctctttctaggcattggagacacagcattcagcaaaacattaaaaaatcactgccttcatagaaactctatgctaggtgatacataaaacaaaacacatttctcaattgtgtgcctgtcaaaaattcattaaggcaagaaataaagtatctttgggccaggacaggccacacccacagccattactagggtgaaacttaaaactagtaaaatgtatatacacatacacacacacacacacacacacacacacagattcatatttatatctagatagatagatagatagatagatagatagatagatagatagatagatagacagacagatagatagaaatgatgcatatttctttcactgtctactttttggctaagacacaggtgttaaccaaaaataatctgagcatttgttctctgctgcaaaggcattattttctgaagagctggaagaccattttcttttttctacatcctcttacctgtagtactttcccttttataactattcagaaaagataactccctaacaaagaaactttgacaatggcttatttcacccttagatgtgtcttctaacaaatgacacatgacagcaagggacagattcaggaagccttggtacagtacacgctgctgggaatgactattttctatgcattgtactcacagcatgggggcagtgaggaattggtgaaggtcccacctaataaaacaaatccagaagagtatagcacctaccccaaactggaaatactaagtaaatcaaatttcatctttaaggtaaaggaatttcaggccatgtcaatttctaattattccaagaaggaaagccatgtacacataatagccaaaactacaaccacccagtgcctggaaagcaagatcagtcacctgtttaaaaaagagtcactatttcagtttcaggaaaaaataagaaaattgccttctatatttgttcatattcactagcattttgtacagcaagaatacaactacactgtagaaatgtctctccttctgaaaacttttgaaaaattctttgcaatttccacataaattttaggttttagtaaacctgatagtttcaacatattcttatacctaaatcctcccagctgaagtttgcagctctttactcttgtctttgttaccccttataactgaagaatttctcagtgaataattactaaacttctaagaggttcctgacattaaccccttaataaatttcctctcctacaggaatttccaaattccaaatttccagacttacaggcccagaataccccaaaagtgtatgacaacatggatctatgaatatagcagcactcagtgatggaaactccttctcccagggcctcagttaacctggcaaatgtcacttactatgacattaaatcacaccaaaaaatattaactctgagatggcattaattctagcaaacagaaagtttatctgtcatatttcacttatagataggttaactttgttctacttaataggtaagtttctaagatggtaaagagaatcacatataaattagtattaacaattaactttgatgtgtcagaaatatctaaacttaatcagtagtttcgctgcctttcaccttctctatgtgtaccattataaaaaaaaaaaagtttaaatcactacgcagataaattctgcagaaaatctttcttcctcgtattttccttatggaaatcttgctttgtttttaagatctaaataaagtgacatgccctaaaaatgtccccacagggacctcagcagaagtaatcaaaactctttttaccaagagcatgttgcttatatttctagtaattatttataagtcctcaactttaacagcatttgcttggtagcagattaaagtgttcattacgtccaaatccaccaggcagtactgttacaatatttttcacacaccagacaaaagattaaaatatctcttgtgacaaaagtttgggccttcacaatacttcttttttcttacatttttgattttaagaattaggtaaaaatgcataccctctttttctcccactaaatcaactagttcctgactttcctctttctcacaatggcaaaaccactgagaccttcgaatctcctgtgagtcctctctcttcctcaccttgggctggtcctccacaacgtcttttgcatttgttgcctgttttccaattccactaccaaggtgcttcttcagtccctcttttccttttatagagaacatatcaataggcctctaactggacacattgccataatcaatgctaagaatttaataacagagctccaaaatatgtgaagccaaattccccttactctactgtttccaccactatgattacaacgttctaatatattatataatgtatctatttgtaatatgtatatctccacccaataaaacataagctaaataagggtagggtttttttctccccctgctttattcactgatatatcctctgtacctagaatagtgtgtacttgaaaatgggcacaaaatatgtattgaatgaactaagacgtattttactgaagtaaatgtaaacatcagcattttactaagacagaagcagtatgtcttatcaattaattcctgcacacagccagtaaatgcagttatcatatacacaggaggaatgctgtggctgaagaattttctcttctcgtcccagaaatgaagaaagataagaagacaaagacaagaaaaggagatgggcttggaaatagtccaaaggggatgcaacagaagtaggtttttttccaatcctaggattaggattccataaatataaacaaagaaaaatgaaagaacaactaacacacacctctcttctcacgatgtatttcatccagaagctgctcctgcctttctatctgttgaaagagacactgcaactcagattccttgttttcagtcaaattcctgagttgttgtctgcagagcatcagctggtgtcgcagatttttctctctgttttctctctctttcagttcctcacagagccactgaagtttagtctaaaaaataacatttatatctaatggttaaagaaactcagaaaagagcagcatttcaaaacatgaagaaaaaaataagtaacataatttgaacaaatatagataattaccaaatttttgcaaaattttaaaatatccatgtttaatttgcataatggtctacagcaagtaaaagctggttcagaaattaagccatggtattcgtagatttttaaaaaatattttgtgtcatctttagaaagacaaagtttggcctattaaactttcaataatattatgggtaatcctctgatttgatatacagggcagtctagtataggaatttaaaaaacaaatacatcccagaatagaactacagactttttataaaagaagtattccttcagagaattttttaaaagataaaattcctagcatgacttctaaaaatgcatatccccactgatctagctaattaggcatgaggagagattctttattgactagaagatatagagttaatgtttatgcttctaagacacaaggaaagtgaattctggcaactctacttcacagattctaacctcacctacctttttttctttctttctttctctctctctctcactcttttttttttttcgagacataatctcactctgtcgcccgggatagagtacagtggcacgctcttggctcactgtagccttgacttcctgggctcaagcaatcctcctgctcagcctcctcagtagctgggactacaggtacacaccaccatgtctggctaactgttttttgtattttttgtagagttgggatttcgccatgttgcccaggctggtctcaaactcctgagctcaagaaatccacctgtctcagcctcccgaagtactagaactactgacatgagtgaccacacccagccctcacctatctttaatatttagatatttaaaacaagaataggaaaagaaatatttctttcaccttcaatacagcaggatttcagtcaagtcttaggaccttcctaagtcaggctaccctccaattcctagttatatatgaaatgtactgtctgtaggaaaatcatgcttttgaagataaaacctgtatcaaaattattaatataaagtctcatcaaaaacaaaagggggccatcataacagttcttctggaatgatgatatatagagttctgtagaaatggtccccagtgaaataaccgtaagtgctaaaaatattgtttttaaaaattaacatttctaaatattgtcctgtagccatacagcaaatgaagaaacatttattcaagaaactctatttaacctcattaaagtggcacttgaggcataactgactccctccttctaccctcagtgtgataaaagctccactcctcatttcagaaaaacactgccaagaaaacagggttttctctttctcaagttcacagtcaaggtacgtgatagcatactggatgggcagatcaccaggatttttcagccttgcagctctgatttgcataggctaaaatcctggccaagtgcagcaggatgttgagaatcccttgctcccccaatgtgccactgataggatggttaccctaccccaagcacagcaggctgagaatactggggtcccaactgccatttccccaggtcacttataataaagccgtatttatgaatatgcctgatgaatacagattttcttgaaatcctcgagaaaatactagcaaacggaatccagcaacctataaaatgaacatcatgattaatatggtttggctctgtgtctccacccaaatctcatgtcgaattataatttccaacgttgtgggagggacccagtgggaggtgactggatcatgcgggcagtttcccccttgctgtcctcatgatagtcagtgagttctcaggagatctggtcgtttaaaggtgtgtagcacttcatcctttgctctctctctcttgcagccatgtgaagacaagacatgcttgcttccctttcacccttccaccatgattgtaagtttcctgaggcctccccaaccaagcctcctgcacagcctatagaactgtgtgtcaattaaacctcttttctttataaattacccagtctcaggtagttctttgtaacagtgtgagaacaaactaatacaatgatcaagtggaagttgtcccaagaatgcaaggtttaagataggaaaatcattaatgtaatataccatattaatacaattagggacaaacatcatatgattataccaaaagacacagaaaatgcatataataaagtcaaacattccttcataataaagacactcaaaaaactacaaatagaagagaacctccttaatatgatttttaaaatatctatggaaaacccacaactattatcatacttaacagtaaaagtctgaatgctttctcactaagaccagaagcaagaaaaggataacagctctcatcactcctaacattgtattagagggttatgaaaaggcaattatacaaaaaataaaaagaaataaaaaatatccagattgaaaaggaagaagtgaacatatctccatttggaggtaacaggcttatgtgcaggaaaatcctagtaattccattaaaaaaatctattagaacaaaagagtccagcatattataatacataaaatcaatacaaaaattaattatatttctatatattaatatttgcaatgagcaatccaaaaataacattaagataatcatatttacaatagcatcaacaaatgaagtctttagtgataaacataaaactgcaaaacttatatttaaaaactacaaaatgctttttaaaaaactgaagactaagtgggaagatatcctacgtaaatggattgaaagcgaatattattaaaatagcaatacatcccacctaatctacagattcaacaggatccctttcagaatcccatctggcttctttaaaggaatagatgagttgatcctatgtttcatatgggaattcaaggcaaatttccaaaatagccaaaaaaagatattggaaaagaagaatatagttggaggattcatacttatccattccaaagcttactacaaagctacagtagtcaagatggtgtggtattggcataaggacagatatacagaccgatggaacagaagtgagagtctagaaataaacccatatataaatgtcaattgattttcaacaaaagatccaaaacaatttcatagagaaaagaatagtcttaccaacaaatggtgctaggactactaaatatacaaatacaaaagaattcatttatacccctacttcacaccatatacaaaaactaattcaaaaaggatcacagatctaaatgttaaagagctgaaactataagattattgaaagaaaacacaggcataaatcgttgtgaccttggcttggcaatagcttcctaggtgtaacaccaaaagcagaagccatcaaagaaaaaagctgacaaattgaacttctttgaaattaaaatgctgtgctttaaaggccactaccaacaaaaagaagagacaacctgctaagtggcagaaaatatttgcaactcaatgtctaataagggaattacatgtcagattcataaagaagtcagtaataaaaagacaaatgatgccatttttaaaacgtacaaaggatgtaaatagatatttctccaacgaagatatataaatagccaataagcacatgaaaagatgctgaacatcattagccatcaggaaaatgtaaatcaaaaccacagtgagactctacttcacacccagcagggtagctaaaatcaaaaagacagataataacaattgtttgtgtagatgtggagaaactggaagtctgacatactgccagtgcgaatgcacagcagtgcaattgctttagaaaataatctgacagttactttatgggttaaacatagaggtaccatataacccagcagttctactcccaggtaagtatctaagagaaatgaaaaacaaatatacatgcaaaaactcagatagaaattactcatagcagcattataataacagccaaaaaactgaaacaatccaaatttccgtcaaatgatgaacagatttaaaaagtggagtatatccaaacgatgaaacattatttggccataaaaaagtgaggtcatgatacatgctaaaatggatgtatcataatttggatgaaacttgaaaacattctgctaaatgaaagaagtcaatcacaaaagaccacatattatatgattatatttatggccaggggcaatggctcacgcctgtaatcccagcactttgggaggccgaggtgggcggattacaaggtcaggagttcgagaccagcctgaccaacataatgaaaccctgtctctactaaaaacacaaaaattggccaggcatggtggaacacgcctataattccagctactcaggaggctgaggcaggagaattgcttgaacccaggaggcagaggttgcagtgagccaaaatcacaccattgcgctccagcctaggcaacagagcaagactccatctcaaatgtcctgaatagacaaatctacagggacagaaagattagtggcagactagaactggtggttggatttataggtgatggctaaggcgtcctgattttctacttgaggtgatgaaagtgttctcaaattaaatgtggtgatgactgcacaattctgtaaatacactaaaaagcattaaatggtgcattctaaattaacgaattgtatgatatatgaattatatctcaattaagctgttagttaaacggtagagagtaagtcaaggcagaaaaacaaagctaaaattacacctctatgaataaacgagacctggctacgcaatttataggcctctgtcttgtctggatgtcactggctaaatgtaggaaatctgcaaattaaattgggctgtgcacttccaattatgattgcagaaatttaacaaagcctacttcgcttctcaatactccctttgaaacttccatgtgaatacagaacaataaaaagcttccataggacagaaatcaggaaacagggtcaactctttgccagataaaatatgtactttctattataattttctactgaagcactaacgaagaatacaggaaaaatataagatggtataccaccatcctcctatgacagtcaaggcagcaaattgggctgttctctagaaagtgttttctacgtagagtatgaaacacatgctgaaggctggaaatcaagaggttgttacagtactccaagcaagtgaaaatgcaaagggaagaaccaaagtgtacatttttgagatatgatacttcctcacatgttatggttaaagtagagagaggaatcagtaatggtcaagacgtataacccataatagccaagtttctaacttacaaaactgtgagacaggctttaggtgttaccctgtgtactctcagctgaggtgggcacaaagagatacaccttctccttaaccaaaggagagggaagagtaaaagggactttgtctttcaacatgggtaccgactcaagccacagtaaaataaagcaccaagtagactcctaaagttcctgactccaggccctagctcccagggagcatttctacactcaccctaggccagaaaaaaacatgttgcccagaagagaaacacacaagcatggctggcttcacctgactagagagcccttggatctttaataaacatcaggagtagtcagacaatagtcaccataagccctgggagagactcagtactgtgctggcttcaggtctgccccaccacagtcccagtggttgtggacacagaggtgcttgtttcaaacctcctccacctccaggcagttcagcactgagagaaacactgcgtttgttttgagggaaagtagggaagagaaaaaaagactctgcctggtaacccaagcacttcggagaacatatggaggtttctcaaaaaactaaaaatagagctaccatacaatccagcaatcccgttgctaggtatatacccaaaagaaaggaaatcaggatagcgatgtctgcgctcccacatttgttgtggcactaatcacaacggccaagatttggatgcaacctaattgtccatcgacagacaaatggataaagaaaatgtggtgcatatacacagtggagtactattcagccacacaaaaggtgaatcctgtcatctgcaacaacatttatggaacttgagacattatgtgaagtgaaatgagccagaaaaaggaagacgaacttcacatgtctcactcatttctgggaactaaagattaaaacaattgaactcactgagatagaaagtagaatgatggttactagagactgggaagggtagtgggagagggaggcagtgcatatggttaatgggtatatatagaatgagtaatatctagtatttgatagtacaacagggtggttacaatgaacaataatttatcatgcatttttaaataattaaaagaatataattggaatatttgaaacacataagaaacaagtgcttaaggtgatagatatcccttttacaatgatgtgatcattatacattgcatgcctatagcaaaatatcaacttttagcagattacaaattaaacaactttggcaaacaaaagaaatatataagcagaggataaaatttaaaagagataaatctgaaggaatacattttaaaaaatagtaaaatgaacatggactgataaaagatatgacatttacagttgaccacagactccacaggagtgaaaaagaagacagtttttcaacctcctgtcaatagagacaacatagtaggatttaatctggttggtatgcatcactgatggcaaatgtgagtaatcataagcgtaaggtagaaaacatcaataaaagaagtggacagaaaatatggaaatgtatatgttactcttaaatctactctaagaaaattaacggtgcaagcataataataaaatgcaacacttttcccccatgttggaaatgaataaagaatggactggaccgtgtcaaatcatagtgtagttgcccctgctaatgtagtcaggtccatggtttttctcatctccaactgttttccgccatatgagaatgaaactctacttttttttttatcagatcttctgatgcttcccacataaaacttcgatattgtctttatgcaattgtctgagttttcaaatgtttgctaccaattcaatttttaataacccatgtggtccaaacaaaatcggtcccagcatgatcctccagtaatctcttctaacccagtgatttaactgcaaatttaaaaaatcacttcacgttgccttttctccaatgcttttccacctactccatcccagtctttcacctttgtgtaattactacctatggtcactgctactcctaagagatggtaatggagaaacaataaatctgttttgtcctaacaataatactaatggttctggggaaaaaacaaaacaataacaacaacaacaaaaaatccctcacaaagtattaggtttgatatgtgttatggattgaattctgtcccctcagacttcatatgttgaagctctcaccccaagtgtgactgtatttggagatggggcctttagggaggaaattaaggttaaataaggtcataagagtggactctatctgacaggaatcctgtccttataagaagaagagatagcagaactctctttctcttccagcctcacagaaggaaggtcacataagcacacaaagagaaggtggccatctatgagccaggaagagaggtctcaccagaaaccaaacctggcaccttgatcttgaacttacagcctccagaactgtgagaaaataaattactgttcaagtcattcattgtgtggtatttcgttatggcagcctgaacagattaatataatatgacctatggcttcagtctattcttacgaagactttattccattgtcaaacaaaatttaaagctaactatagttagattttttttatgaattgaatttgtatgcagaatatattattaatcctacaaaataaaatatcaacctatggaaatttaatcaatcaataatcaattatgagaatttgtctttgttggataaatacccaacatcttcattaagtgtcttgaggaagcagcttggaacacaatatagaaataactttaacaattcccaataataattagctgacaaggctattaatcacagagcaaaaaccattctattaaccactcacaggagtattttacagattacataataggatcatttatttaactacatcaacaagtattgctaaataaaccaaaacagagaataaatttgtaaatatgtcttttttttttttttttgagatggagtctcactctgccgcccaggctggagtgcaatggaacaatctaggctcactacaacctttgcctcctgggttgaagcgattctcctgcctcagcaaccgaagtagctgggattacaggctcccgctaccacgcctggctaatttttgtattttcagtagagatggtggtttcgtcatgttggtcaggctggtctcgaactcccaacctcagatgaactatccacctcggcctctcaaagtgctgggattacaagtgtgagccaccgcacccaggtaatggcattttttaaacctttgcagttgagtagttgatagcttccaattaggtgggaatattcataagtatctagtaaaactaccaagatgaactttttaatctgtgagaatcctctactgagtcctagggtaatgatatactaaagccactaagaaatgactcaaagctaaaaatcaaggaccacagaaaatttaaataaaaagattatagcttataaaggtagcaataatattaggacccagaattttgctcctttaattactatgcttcttttcccaaacctctagaaacaattttgaaagaaaatgtttgtataagaaacagagataaagaggatggcaattttttagaatgtggtcagccatctaaacaagaattaaattagaaatgcaaaagtcaaatacaagtcaacctaaaaatatgtaattttttcagtaatactttctctaccttttcactaagttataaatataatcaagaaaaaagcaaaataatctccacagcaatacatatacttttgctcaattaactgaatatattccacgtaaataatctaaagtgtatttccaacaagtcagtcaagatactgagtacagtattttccattctatatcagaaggataaaatattagatatttatccacatctatcaataagaattaagtacactgggcctaatacttctcacacaatgttttaaaaaatccacatcaataaaaagacaatattcataaatgtaaggtttatattcaagtgtggattacacaaccaagggagacaaatgatggaacagagttccgagacctgagttctaagcccttcgcagtaactaattagttttatgtccttaggtaaaactaaaaacatcttgggcctcagcttcttcaatctacaaaatgaggcagtcaaactatgtgatctctaaagctacatcagttaaacagtgtggaaaagcaaatgcttgtcaatgcctagaatatactatactataaaaagtgtaactctttggggtggtatcaaacaacacaatataaacaaatcttctccctaaatttggaagtgtatttcttacccatctaatctccaagtttatagctattaccaaataaaaccagtacttgggaattaatatattcactgaaatctcatctgcttgttgcttatttttctataatatttaagttaaggaagtgcctcaactgggaaaatgcagcatgcccaatataattactctttcaaaaaatatttattgaacatttagccaggcattgtgataagtgctaaagatgtaataaggaacaggataagcacagatcttccctagtaacatttacagactaaagacacagaagcaaacggggaatttcaacacaatggggcaaaggccaagaagaaaaagtatagctttataccgtcaaaaaagtatataaattcacctttctgtctcttaagggaataaatactggatataggaattaaatgtgtctcctatgaacaacagtgcactcaggatcctgcctgatgtggaagcacagctaatattagcttttctttattctctgtcacaaaacaataatgtaacatgtgggctcaacagtgattatctctagtatgtgagtccatcctgagagtgctggcctgcgctagatttgacatgttatccctaccgtctcaatgtgaatatctttggtacttctcacttcttgccatgatgtgaacaaaaactgtgatctgtgtctttgtccttgcttctcttggggccttcctgtccaaatagaagtttctgactatcagtctctctggtggaaactctttcaatactgccacgaatttgcctatctgggacactacatgatcatttattcagataccaatccctgactactttggctagaaaatcctggaaatctctttctccattaccctagaatataacatctctcatcatgtgtatgctgtcaacaaaattactccagtctgtcctttcctctgaatgtttgaacaattttcttaattcagactctcactctatctcactgtatgggaaaagcttcttaactggtttctctacctcaaatcttaccaactctaatctacctttcacctcactaccaaaatataaatataagcatgccattctcctgttcaaaactcctttgtgattctccatgcaatgtagatctgaatccaggatcctcaaaatggcaaacaatgctctactggatgaacttaatccctctggagccccatcccctgccattctctgtgtcataccttcatattttactattgctaaatcatttgagtgttctttgcattcatcaaattgcttctgttctgtgcctttcctagaactttgttctttgcatgtttgctctttgctctttacctggatggtttcaatattcatctgggacatcagcctccatggcagcttctgcatacttctattacagctcctgcttgtaagactgaaattatctgcatattgtctgtctttcctaaagaccaggacaatgtcctgttcttttttttttttttttttttttgagatggagtcttgctctgtcaccagaatggggtgcagtggcacaatcttggctcactgcaacctctgcctcctgggttcaagcaatttgcctgcctcagcctcccgagtagctgggactgcaggcacgtgccaccatgaccggctaattttttgtatttttagtagagacaggggttcaccgtgttagctaggatggtctcaatctcctgacctcatgattccccctacctcggcctccaaaagtgccggaattacaggcgtgagccactgtgcccggacgtcttgttcattttttatgcccacagcatgtaacagcatctgagacgtagtagtttctcagtaaattccattaagctgaagaaaacatggccttaccataccttgttagaacttgttacaaaaacatacccctcatctacggaaactgcttacctggcattccttaatgaccatgtgatggttaacactgagtgccaaactgattagactgaaggatacaaagtattgagcctgggtgtgtctgtgagggtgtttccaaaggagattaacatttgagtcagtgggctgggaaaggcagactcacccttaatctgggtgggcacaatctaatcagctgccagtgtggctgaaatataaggaggcagaaaaatatgaaaagacagactggtcgagcctcccagcctacatttttctcccatgctggatgcttcctgcccttgaacattggactccaagtttttcagttttgtaacttggactggctctccttgctcctcagcctgcagatggcctattgtggaaccttgtgatcatgtgagtaaatacttataaactcccctttaaaaatagatctattccattagttctgtcccactggagaaccctgactaatacagaccatctcaaccctcttccttcctgtaatttcttattattaccattcattagctattttacctgtaagtatagtccaactctcaattggacttcataattttattatgccaccagtgccaacaaagcaactgtgtgcaatccccacccaatccttgttttctagaattaacactaacagaacaaattcatttggtagatttatgaaaacaattactgaatgccctcagaggtccttctaatactgcaagacgtcagaatggactatctgaagagcaattctactttccatatagttttttgtcctctgatttcagatcttatcttcaatacttatagagctgtccagtcatagttcatgggaattatagtactgtagcccatcaataacctaacccatctttctagcaaatagattcaattcccccttagtcagttggtcagtgtggtatttttcatcacaacccgtttacactgtagaaggaacagttgtctcatgcagtaatagaaggggtctgatcagaagttcaatcccattaaatgataagggaaaactgctcacaagctcccaaattaaagagctatgattaagaatcatctgtggctctcatagtttaactgaactactgcagtgaaagctttctgttcagaaatgataaagattttaacttgaaagaaaattctaagtacattgctcttgttgtcagaattgtaaagctgaggaaaagaaaaatgagaaacgcaatattaatgcacaacagaaatttctggccaaaacattctgagacagcaaaacgtgtattctaaattccctattcaggtggcataaatacaaatttgtatttgtttctatcaaaaatggctagaaatgcacaggttcactgttgttaaagtctaatgctcaatcactatactttcattttcttgttaagaatgctttgttttaggaggcttctctaatgcatagttggccttcaaaggtaaactttatctttccatcacctcccacccatgtcttactcaccaatctcagggcattatctgtggttactcaaatattctcatcttcatgtcattgttctacccaaaactaactaactggagaactacatatttttgcaaggccaagtttaaatattgcttttttccagaagctgtctatgacatgctggtagcatcataccctccctttctcccagcacaaacaatagaattagctcttccttcttctgtgttcctttgtcaatgttcacatatatctataatctggttcttaatatttcaacagttttactttcctttattctctctttctaggcctacatatttaactttaaaatgttaaaataagaaacatggagattccctaagtggactgcagtgatatcttcccctgcaattaagcattatagcttcatatgttcagttacataacaaaataaatagctaaaccaaataggatggcttaaagatcataaatattacaataactttaggatttaaagattaattaccttgctttctgctaaccagcgatgtgggtcataatgtatatcaggaccagatgaaaaaacctacaaaagagaaaacagtcgattagaaatacatttttctctgacataaacatatataaatgaaattcttcaccacagtatccaaaagtttagttccccaatttaaggatttaaaaagaaaaattgttgccccaaatactcaaccagttccaaactagcattcatttatatgcctttttatgtatgtattcatttatttatgtattggcaataaatattttgatggaaaaatcaactatcaagtgctatcattgctaggatatatggaggctgattctgtggagttccatatggcaaacagcttcaattaaagtcagtttatttcatttctgtttgtttcctctcctcagtcgtgttctacataatgtacttcaaagagggttatatgtgattacatggaaacaattctctctcatttatccttctttaatttaatagtaaaagggccattttgtcttatcaatgattgtcaatagacacaaactcatcgacatgacttcacgcaaacattgccttgtatttcaatagttcatctgcgctagctgctttgacttccttcacgccaactcatttataaaatcccttgcatctggttttgtcatattactaaagtaaaactgtattcaaagttggcaatgactttataattgtaaatacaaaagttttttctcaatttgtacttttgttgaactctgtgctacaaataatatttttgaagacctctttctcaaatttgcctgtttaaaaatatcctctctctctacaaggagaagtctattcctattctcaaatacctccatacctcctgagctgtgtgcacattgcttctttgtcaggaatatcattagttaactcatttagacaaatgctgaaagcataatgagtgcccaccacatatcacatatgtgaatattgtattcttatatccaattttctctcatccacctttctatctaaatctcacccaattctcatatcctccctgccttttcaaggaaattttccctaatcacccgagttcacagtatttccttcctcttccagttctctactacattgctgaatatttgcatacatccatttgtcattgattagaatacacttttattattctttttcattcatgaatgtcatacatgtcaattaaatcttctgtggcctaataaagatattaatgtttaatatcaaagtataagataattgggtataagtacaagtaatgttcacattttattatttgctttacagatttacctatagctacatgtttaagaagatagccttaacctgccaggcatggtggctcacgcctgtaatcccagcactttgggaggccgaggctggtggatcacctgaggtcaggagtacaagaccagcctggccaacatggtgaaactctgtctctactaaaaatacaaaaattagccgggcgtggtggcgcatgcctgtaatcccagctactcgggaggctgaggcaagagaattgcttgaacccaggacgcggaggttgcagtgagcagagatcgtgccattgcactccagtctgggggacaagagagagactttgtctcaaaaaaaaaaaaaaaaaaccatttaacgaacggtgtcagcacagtgtctgggacagagaacacaataaaccactgctactgcatatcaagatgtcactattaataaataggcttcaaggcctattatgaaaaaagcactataacaggcatttgtcattaaaaatataaagaaagagaagccatatgtatttgtgaacatgttactaaaagaggcaatacaaaataatgataggtaacattacttgagtatccactaagcgcaagatatttgaccctataatagcaccttctatatcttacctcactttatcttctcaatgagccaacttataactggggacatgaactcttagagaagaaagagcttacataacttatccaaggtcatatattagaaatttgcaatgacttccaatatgaacctatacctgtcttgatccaaagcccatcgtcttcatgctctaaaactgaatgaatactcagaccaagtgttatggaaagagagagactaaaataagtacagtgcagaactaatctatttacttgagctcttggattatcaaaaactggcctgtgagaatgatacatcttaattcagacactttcctaattgttttacaattgtagtgtacgtctgtccttcattgtcaaacacatacattaactaaagtggaataagtaacaaatacagtgacttgaaaaagaaaaatgtaactaaaaataacatcaacattcccaggacttttctcaaactcatttattacatatctattttctaatctattccatagcactgttactctttacatacaatggctgaaaatctcatcagcaatatttcaagaatcaataaatgactaagtggaattattccttttttgaaaacattttacatgattcttccacactctctcagaactataaactacaaaacaaacataaattttatctttaccacacccctgggtggtttcttaagcatgtttcttgagtgctatgttcttgagcattccatttttctttcccaggtttacagcaataaaacaacagaagttactaatgaaaagaggcccacaatgaaaaaaatgtagactcttaaaaaattaatagaatttcctttcttttagatctattttccacccaagacttggattgaattagtctttctctaggggaagaagtgtaaaacccattaccacagtcactccatgtctgaaagcctataaaaaattggatgcttcttggaatatattggaaggataatttgtgactcataaagaaataaaatatttaagcaatctgctatctgcacatcatgtatttgcctgcaattgcccataacaaactgtgtatatatatgcacatatgtgagtgcatatatataggtgtgtgtgtgtgtgtgtgtgtgtgtatacatatatatatcttacaacatgatccaaatgtttccattttaccttcctacatgactgaaaacaaaccatgctgttacaaatatttaaatatagaataaatattgcattgctaatatatacttcttctagataaaaattaggattttcaaggctccacattcattaaataaacgcaaatatgacaagtcttaaatttaaaaagcagcattaggaaaaaaaaaaagttagaattatcataggccctacaatagttctaaaagagttagttttccccctaaagccaattacttctcatattagactcatagtcttttcaaagtaacacttgaacttaaaaaaaaattgtaaatgggaatacatattgtaaaaattccatcaactctaccaaattctattagttaaaatatttccattaaagacaaattctaaaaatgtcttgactgcaagagaattagttatattttcctttaaacacaatttaagatagaaaaaaaggcagagagaaagagcaagaaaaaagaggggaacatagtagtatgagaaaggaaggtcattctagaagaggaaaaagactaataaatgtcaaaatcaatagtagaaactgctgaaaaataaaaagcatttcagcataatatcacaatgtgaatgccatcatatcaccaaatgcagtaaacagaggggtaaatgatgctaaactgtaatgtattatggctacacatatcaaaacaatgtaatgttctctgtatgtaaaatagcagcaaaacctagagctgacagaagtgcttacctgcaaggaattcagagcatccatgatcacttctgtgtttatttatcattttactatgactctaaattgtgtagcagtattccatttgttaaaatagaaaagctaaattaaatacagctggtttaaacagggaaggcggataacatagtggttattaatttaggttccagagttagactccataggtttgaagccctagtttagcatttaaccagatgtacagccaagggcaagttacttaaaccgtctaaacctccctttctcttaagtgggtttaatcagagtaactaaaagatagggttgtttcagaggataatggagagactaaagcaccatgcatactacagtacctatactatagtactcaatagatgttagccggtaatataccaacaacaacaaaaatagcctgcgatagtgaaaactcaaattccaggcctcttgactccaagggctacctctcttataagatttttctttttttttttttttacagagtgagacacagccaattcaatgaaataacatcattcgttctctcaccacaactgtgcaatagatccagcgccttattctaaaaaatgcaaaatgttattttgttttataaaattttccataataataatctgactaccacacatgaaaatcctattacaattatatattaggaaactaactgaaaatataaggtgcaatgagaattcataattacttttaatttctccactgagtccttggagaatgttttacaagctgcatcaatttcctttcctatcacaccaagaatggattcctgttcagtctccaagcaaagaagttgatccttgagctgcaatctggcctcttccatcctccttaagtgctcctcttcaatgcttatatgtttttcctaaggcattgaaagaaattaaacaaggtgattactattaagtggaggcaagaaaatacttgtaatatctgttcaaccaactagaagtggatttgaaaagaaatctgattccatcagtccccttactttaccaaaataaaaacactttaatctactcattaactgaggtaaaattatagagttccatcgtagggcagtttgggaactggtgagaagatatctggcaaacaaaattataataagtccctaaccaaaagaaaaaaagaagtagaaaaaagaaccttttcccattttaataatatattctcagtaatgaatgagagtaaaagatgatgtcagacactgacttcaagctttcactgaacattagtaaaacaccagaaaatataaactgctaaatatgatgctagtttcttcatttgaggaaaaaaataagtgttaccacctttatctcaccaaaacatagctttagaaaaattctaagtttcaaatgcaattgcatttaccacataaatgcttttgagtcgtgaaaatttgataaaagaaagatgaaggtacttttcatcttgtcattatatacttaaagaaaagggagccctttcagagattacaaggacttggggacccactctaggcaaaaataattctaaatcattatgattatacagttacattactagagaaattccaaatgcatagggcttgtaataaaataaaaaaatcactagaattgtatgtctaaatggtggaccaaatccatgatggctagctatgacaccttcagtcatcacactgtaacctaaccatcttcaactggcctgctaaatacaacaaaaccaggaaaattatgtgagccacaaacccaacctgaactgaaaaaaaataacaaggagatccactcattaagaattaatcatgaaagctagaatgatattttactaaaagaaacataaatgatatttcctttcaattcaacttactttaaaaacaaatgaaacatcctctgccaggaaagacagaccctttcataatctatcttctgtacttctctcatgcctcatcttcctcctttccactctgctggaatttgattacttacagcatcttaaatctgcctacatatgtctccccagaccacatctgacttgtacaactctgcttgaagttgtgctacttcaaaatggggctggtagccaagagacatttatctccaggagttcatcttagtccatcatctgggtctggatctcagctttgtaaacctaggaactggaatttctttttggtactcagagaggtactttcagcagcagagtaacattaagctcacaagagattaatgtgtatgaactagaaagccactcaattaactacattcatttacgatgagactcataactaccatatgaatcagaatgtccatgtcagcataaccagtacattttctccctatagacagatctagatgggaaggcaaactataatcagactataggttaacgaataggaaattagagcaaggggagtttgttttatgaaacaatgttcaaatggcatccggctaatgaaagtccagcatgttcaccacacatcaggaatttacaaaccacaataacaggagtttcattcttctaggtagtatttgcatggagggtgctgaggtgtatctccctaactttcttgtttttccacattgagtttctgtccaaactctccctaccaattaatacatcatttctttagattgattaatattttcccaagtcttgctcatatctaggagttttctgaaaaattaacatcccagctctgaacagtatttgataattgtatcatttactcattagaaagcaacattattactaagtctctaggtgatatttgcctccctactgttcctgtgtatctaccacctataccttcttatccttcaaagtttatcctttaagatgctgcattctttcttcctgaactcctgaagcaaatcattcccatagtatattaggtatatcataattttttaatttttttcaaattgtaatataattatttgcttgtgaacctatctccccaaataaactgttaatttcaggagtccacaaaacaagtttattatcatctttaaactcctccactttgctgaataaatgatttaaacattttttgaagacacaaattcaatatgtgaaagatgatttcatcaattaccatgcagagcttataaccttggaggctactgaggtgtcctaggaggtttctccccacacgtacataaggcctcctgatggtgcagtattttcatggtctgatagtaataaagaaaataaataccctatcagagactaccgatgtattagaagactgcccatattttacatctaagcaattcaaaataatgttataattgatctttcttttctcacttccctcaaagccaactctctttcatccactactacttttctgtggtctccattacttgtctcttattaataagaagacaaaactacttcaatcttttgatattcttgagaatgttgatattgtcagaaaaatctctataagttcggtctctttagaaaacatagaaaatttcattatccggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcaggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaagaaaaaaaaaaaagaaaatttcattatccacttcactatcctctgtgggacagttgtatgctatgtccaagctctctttgaagtaaaagctgtaggactatgggctcacatggatcttaaagatcagtaaattcaactacttgctccttcaggattcccttatttggcatttttgacagttgagtcatccaaccactaaatgaacacaagtgtcaaggaacagagtacctgacaaagctgtaaactctctccatcagtgtccaagctatatgcaacaattaaactaaacaaacaaatccttcacccccactaaggcttctaaacttccaggtaaagatttctgttcctttcccctgttttttatttgattaggtttcagacacatagtggtctccattgtctgcatgtactccaagatcctaaatccaagagttaagtaagctcttccacaccatacttcagcagttataatttcattctttcattcattcatccccctcatccaacaaatatttacctaagtcctattctagacaagacattctcatgtccactaaagatggagtaagtgattgcttctcggccttctggctaagatcgagtgtggagatagagtaaacgacacagacaggcaggctcctactctcatagagtcaacaaacatttgcatgaaatgtcattacttttgtcccattcatctggtttgggcatatttatttgaacactaattatggtacccaatgaagtagcgctttctcgcagtttcatgttttagaaatagatgtgctgactaagcaagcacagctaattctgggggagggttggggctggaaattggctgaagttaatccaagtatcctgttagatttagaggcattcaaataagtaacggcagatgataatatttaggcactattaaggctattccctggtctttcagtcaattcagagggggcaatatcccctgattctacaagattaacaaaaagttaccaaatttctagagaaccagaggcaaaatgtggtatattagagaatgattcaaaatatggaagacacaatctaacttcaatgtttcagggtgaaaggacacagatgcctggagctagggaatgtaggtaacttcttttggagggtagggaggaaggcagatgaagctaactacagcagtctatgagatccaagaagaaagatatcctagataatggctgagtttgagaaagaaccctagagaataaaccaacccctaattttacattttaggtaaccaaagcgcagacagactacataacttgactaaagtgaaagaacctattaaatacaaccccataacctgatcccctgactagtcttctctcttaaaatgctagaaaggctgaggccttaacattagaatttagaaaaacaatgtgaaaaattcagaaaagttttcagcaagttatgtgaggactaatgtcctaaagtagaaaggagaaatcaaaaattaaattctgaatgagccttatcataaatgaaaatatatgacatattgacatattcagaatagaccacaaaatcaaaagcacactgaacatgcataatatcccaaacttttaaaggggctatccatctgcgctgaagaagtacctgtgtacacataaaatctgctttagtccaattttcaaaagtgtgctaatcacacactgaacaaggtatagttccatcgtcaagacaggaaaggttttatgaagcttctattttaggacaagaaaggctcatattgttgacacttaagtataaagaaaacgtaaaataaaactgctgacaatctcatgataaacacacacacacattctgttaactggtttgatgaactgtcctataattcaaaagataagaaatgctgttgtaattatagatttatgtttcagcatgctctttacaactcagagcattcactttcccagaggctctaaagattataaggagatagatcttatcagaaatataaaagcttcaataacacaagagcatgtccaaaatagtatctctttggtaaaaggttatgagattccttcaatgtcttaagagttccagaaatgccactttatttagaatatggctattacatgaagtaaaaacagttcatcaaacaccttaaacagaaatattacgttaaataaagtacactgacatgactaaataaatcattaatttacaaaggtaattaatggttttccttcactgaaaactaacttgagtcagcaaatgtgacaatatttcagtcccaaggccatctttacatacgtcaacaaagggtagggggagataggataaaaggtagagaaagagagaaatcaaataatattaaaggctgaaataaaaacgaatgcaatttaagcaaagttactggaaatacagcttgttgaacctactgacatgcacacatcccctaaaaagttttgaggaagaatattttcataactcaagataaaactgttatgcctaagctttaaatccaggacactagcattacaaggcaaattatgaaactatcctgaacaaaaattggatctgtctggaaaccatttatctgactctctaaagaaggcccacatttttataccaacagttgactcagctgcaaagaagttaggatacaacataaaatgtcaaccagggcagaaactacaagggcaactaaatgagaagatatctgcgatggatactataggaaacttggaaataatttaagctggaaaattaccacacagcagtttcaactgtcttacaaaatggccaaaaaagaaaaaataacacatcaagtgctggtcacatcataaccacttttttcaagcttatttctcaaaactagatttttacgtaatggagagctccttaaactcaaaacttgtctatatatgaaatatctagactgatatcaaaaaataaacaagacaaagcaaaaataactctaaaatcaagagttcagatgagtttgaaaaatctccgtggatttaccctacatatatcacttgccctctgggaaaccaactcttctcaagaatatacaggaaaaggaaggtgaattcctaactcattataaaagtccaataacacacccctccttcctcacccacatggttgttagaacagtgaaagattacctgagttcttgcacaggaatattaggtgccccttctctgtgctaccacaagaagttatgattaatagtgcattaagagcatgtgagagccttagtaaaacaatagagctaatagaaaaaaggaatggcaaatgggaacactggccatatgatttgatgcaggttaaaacttaggtatgacaggctttgcaatctataacctctaaaatttaaatttctgctctgccactcactactctgtgtcttctatgtctgtctcctcatcagactgtgagtacctctaatgtgaagatcttatccttctttatttacatatcccagcccctactagactgtctcacatagcagtcatttcataaatcttgctaaaacataaataagcttttatgttctactcattgacaagcatttttgagcacattaaatgtgtcaagcatacaaccaatacaacaatttttaaaaattataaacaagaaaaaaattttaatctctgaactcaaataacttctcgtgctacagtaagttagttctcttttgttgccacagttaattatttaattcattgaggacaatcaccttgtcagtggcgaggctattgtaactatcaagacaagacgatatcacaatagtgagagccctggaagtggtaagaagtattcagatgcagaatcaattttaaagtagagtcaataagatcagctgatgaactaaatatgggtccatgtgtgagagaatgagctgattctttacatgtatttaacaagcaaaggaacactatgatttctactctaagattggtttctaaaacaaaaatgctaccattttgtgggttagatacactgtcttccttctcctctgataagtagaggattgctttatactatttcctccaaaagaggggaagaagttatgattaatagcgttaagagtatgcaagagccttagtaaaacaatggagctaatagaaaaacgggatggcatatcaaaacactggctttaagatttgatgcaggttaaaacttgggtgtgaatgactttccaatctataacctggtcttaggcaggcttacaaaagtttgtttccataaaccagaatcaaaaaaatggaaattctaattcaaacttttaaccacatttaaagaaatcattctgcctcaggcttttcattgtctttttctaggaaagtattgagcaatacaaagacgatgaacagcataatcagaacgtgttaggatatgtattggatacgttcctagaaattaatattcaaagttgaaataacaaataccttctaaatgatactttatgcattcattaagttttattcttattacatatttctctcaagacaaatgcctggaaatagaaataacatccataatttaaaaatcagccaattttgatgcatttctatttctgaaatgaaatatggacaagggaacaaacaactagagtttcaaattatgcatttggaacgaacattgtttaattttcaaaagaaaaaaattatcattcatattgagagaaatgtttataaggttacagtgtctttaataaccatcaagatttcttcctctttttttttttcttaaaggatactgaattttattctgagttgtttttttttttaattatactttaagttctagggtacatgtgcacaacgtgcaggtttgttacatatgtatacatgtgccatgttggtgtgatgtacccattaactcgtcatttacattaggtatatctcctaatgctatccctccccactccccccgccccacgacaggccccggtgtgtgacgttcccattgttcagttcccacctatgagtgagaacatgcggtgtttgattttttgtccttgcaatagtttactgagaatgatggtttccagcttcatccatgtccctacaaaggacatgaactcatccttttttacggctgcatagtattccatggtgtatatgtgccacattttcttaatccagtctatcattaatacttttcttatgaaagaatattttttaaacttaaaaatgaaagtccaaataaaataacctgtatataacaagcacctcttaggtgtttttcctaaaatttattgattattgcttgttcaacattaaacaacaaaatgaattgagtcaataaacaatttaaatgctgatgaaaaaaaaactcaatgaaaacaaacccagacattcactttatgtttccttttagggtcaaccaaagccagctaagattgcttaactgaaacagatatgatacagaactttcatgttgcctattccatcggcttttttcacctcaaccaatggtatacaccattatttagcctgatacccacactacagggatcactcacaactgtggaagtaaatgaaatcaagctaatagtaaaggattttaatggaaagtgcagaacatgtttgccttctcctctagacccttgtagttatcaatccctcagtgagttaaggatttaatagcaggcctctcaatcaagtccaagtcaggagtgggtacaactggtaaactttgactttactcctgtaattcacttaaaatcaacctctttgattgtaaatagttggtaggaaagtcattgccaattgagtaatttcaaaacggcttcatcatagctgtgttctaattcagaaagtagaaaccagaagtacttctatgcacctttatttttttcccttctctttgccacagctgcacatataaatgcatcctctcccttcccattgtatattcacttcatttttgcattctatactgttttcttaacatctgacattacatttcataaatgggaagcactctgttatttcagcctattctctgtaaaagtcaaggagtactctgggcttaatggttacatgtgattcaattaaacatactttaaatgaaaactcctaaaaatgtatcatttgccttcaaccattttattatttttattattgtttttattaagaagatgggaatcttacaggaaattactcataacatcctagttagtgtttacttagagtatctggtttaaatttgcttctaaattaatgtgtggtgactacaactttattctactcacacaacttaaaatatctgtagcaccaaaaaaaagaccacaagctgcctaaaaatggtctaaagtgtaaacattaaagtaaatgctagaagtcaacagctcatttgcttctatttttctgatttctctagaaaaatctgaagtcagaaaattctgcctgctaccatcaaatacctcttagtcaaaaatgtgacaatgtgactttgcaaagtagtgaatacttcatagaacagacatctgaaaatcatatatatttttccccatcatcaaaaaatagcaatcctaaacagatggttaaattagaactgaaacacaaagtttaaaaacactgattcactgtttcctctcacagatacgttttatgtggaaagttcaggttttaattagatttttctaacaaaatcattgacgactcacattccaaaatttgtcagaccaaaaaataagagtatatggtaatttgttgaatgcaataaccctaaatttaaattcaatgctaagagttcaatgaaaagagagtcattttgctggcaataaataaaggagaagaatacaaggactgtatgcttatatcctgtttctaccatgtttctatgcagtgttgagcaagtcactatattctctcaacttcagtttctaccatctgtagaaatgggcaccataaatacacttgcaaatgtgaattataactaccattttttaaagatccatatgttgtataagaaaacgatttcaagtgtttttatccaacataatgacagctttaaaatgttactaggtgtcactttatagatgacttaaataaatcttttcatgggaaggaacaaaaatgcatttctatgcatcctgatctattcaacacaagttcctatcaattgctatagccttagatgtctcataatttctggtcttaaactatctcttaattgtttcattgaagtttttctcatcttctgaaagaattaatagcagaaaataaggtcctctaaagagaactaagcatagctattgaaacaagtaagtattaaatgagatagctcagtgtctccaattaacactggccagaaatggttcttactgattctgatcaatggaaagaacaggactggtaaccctgagtcctatttccatttctacccaaggatagctgggagctcttaggtaagtcagttaactctttgggccagaacctcatctataaaataaggtattgggagctgaccttctgtttaagattatgtttaagctgaccttctgtttaaaattcttataaactttaacactgataccaaatgttttttggaattactgatatggacagtacacacggaaatatggggtagaagaggggcagctgcccacaaaggctgcaccctcaaggctggaaaccatggccctaaatgagaacaaaaattcctgtttttgtgcccataagttgccttttggcccacccatccctctatctggtacccatataaaccccaaacccctggctccatgagcagaaaagaagatgaacagaagggcagaagaatggcagaatggtgtgacagacaaaagagaggagcatctgaacatcgagaggagttacactggggacggttggagaggagatcagctgctggatggccaaactccaggggaagatcatcttcccactccatcccccctccagctccccatccatcctgctgacagccacctccatcactcaataaaaccgtgcattcatccttcaagtccatgcgtgaattgattcttcctggatgccggacaggacctgggtaccaagagagcactgagctgtttaacacttaagccatctgcagatggcaaggctaaaagagtgcactgtgacacatgcctactagggcctcaggagtcacagacacccacgcctggatgctactgtggggctggatcccagaggtagttgccccaactcctgcacctgccaatctgtgtgctccccctcccataagaggtttcagtgtgcatggcagcccaacagacaagccacaaccctgttgcacatcctgcaaggggggtcagggaactctctcctctcattaccagctttgtctcagtagtccagtgctaccgtgtaaactctgagacaatgcttgttaaacaaaaggtaatacgtagatttttcaggggcagaaagactgaaaaactcctgacgaacttgcaacattgtcaaggctagctaactaaaggcgtaagacagcatcttttgtaacagaggaagctccatgtacggaggtgattatgggtggattaaaggagaaaagtaaaatgagggtggcaggtatctctgaattcctccaggtttgggtacctagtaacaagaaacatattctcataattccgcctagaatatccaagaacaagatattctatatacctataatttctcagattcttgtatatataaaatgaaaatcatcagtaaaattaaattattccttcactaatactggaaaataaatgtctttatggtgtttgtgttagacttaggaaaacaatctcataatattgctatcattttctttataaatttttctcattgtatataaatacatctgcacaaaatattgtatatattctttgataaaacagcatttataaaacataaggatgaagaaaacatatgcagtatataaaaaataatttataaaataatgtcaattttcagtgtcagctattttaaaaatatacaaacatattcaaaattaaaatcaattttttaaatatatctactaccaaactacttgactttacaaagacagctgatgtcatttataagctcataactatttgcaaacgaatttttttaattacatagggtgcagatccatatagatcaggcatttaaaaccttcattacgtaaactttaatgctgactggctgaacaaaaatgattcaattatgcactaacacttgttgattcacagattccagtgaaactaataaaaatatatttctgatagagtaaacaggtaaatgtcacaaaaatcaaaagattaatatcagtaagattcttctgaaacaaaagaagaatcaaatatttcaccataaaatgtaagcaaaaggaacaataaattttaatgatactagggatgggagaaaattctttctataatatttcagggtagcttttttgccctggttagaagctagtaataaaagtaccaaatgaatatgtaaaaatctgtgggttgcataacactcgttctctttgtcatgtaaaactgaaaaataacatttgataaagcaaaatcagatgttagaaaaaatgcattttaataccatatatcaccactgaatacatgaggaaaatatgctaaagtcagttattctgtggatatttagcaagggcagtgttctcccactgattaatgctaccactgatgctaatggtttatatgaattttgatgcagttttaatatttcttagcttaccaggtaataataacatgacaagaaacacaatctaaaaccacacagtcaaaataaaagcaaggctttaaaaaaaaggctgtgtgtattggtagcctcagtaacatcacacattgatgttgaggatgggcatgcaaaaataccaccttgttaagcaaattagaaagcgtccaccccttttgattgtagcagagctgtcccttcaacccataaggcctcatttatcaaattcattgcattgcttacatggtaatcttcaggctactaatcactgggttttccttcattgaaaacatatttttatttcgttttcttgcttttatctgccccagactggccaccttatacatgtgtgtatgtgtatccatatttctttacatatatacatatgtgtgtgtgtgtgtgcgtgtgtgtgtatgtgtgtgtgtgtgtatacacacatacctctttgtccataatttacttataaattacctactatgtgtcaggctctgtgcctggtcttggagatggaaatatgaccaaggtgtaattcgtctcctcaaatatcaagcataattataaaagtgcccacctgtttggtttgcttaacacatgtgccttcaatatcacttgctgatgaaccagccagctcttttcacatgtgtgcctcctctgtttcaaatgattcaacatagtctggttctaaacttcccatcagcaaagttctgtggctttatgattaggtaaatcataggcacattatttttattactaacacatcattaggctgaccgtaggcagtcattccatatatgccaattggttgactgcttggttgaaccagtagtcagcatatatttggaaacataacaataacaaaataatggcagctaccattaactgatatcttattagataccagataccatgccaagcactttacatacatcctcacacttaatcctaataaaggtattattatgcccatttgaaggatgataaaactgaggctttgagttttaaataacttgcctaaagccacgcaggtaggaaagaattcaaagttttacgcataatcattattgctatactatctctcaaagagaaagtccctatctgtagttggctcaatccaacaaaattttgattcatagctaactataaatggatcaacacaaacagctaagttaacctaaagtacatagcaatcatgtacatgaaaactaaatattaaagattagaaagcatataaactacatataatataagcatgtttgcgtgtgtatcgttaagattatatgccattttaggatacagagaccatcttttctctgcattagcacccattgtcaagacttgactacatagttttaacaactgaaagagattttgtttttaaaaatcccactatgtgttagccaacaacaaacatgtatcttatctctgtcctatcctcaacatccagcacaatgcctgccatatagcagatgctcaatacatagcaatattaaaataaaatcattaattcttcaagttctgttctaaagtgaatgctccacttatatgaatgcgtgataacacatgcatctgaaatatcataagcagaatctgtgaagcagcatgtattttttatttttttattttttttgagatggagtctcgcgctgtcgcccaggctggagtgcagtggcacgatctcggctcgctgcgactttccgccccccgggttcaagtgattctcctgcctcagccacctgaatagctgggattacaggtgctcgccaccacacccggctaatttttgtatttttagcagagacagggcttcaccacgttggccaggctggtctagaattcctaacctcaggtgatccgcccacctcagcctctcaaagtgctgggattaaaggcatgggctaccatgcccagctgacattttcaacatatcaaatttttcaccactatttcttaaatgcagctatggaaatataaaacacattaatgcaatcttctggctaacttcataatttcataaattagaattttattttgaaaaagttgaaaaatttagcattatcaccagaactacaacctgccaatagatacattaaatacatgtgaccattagacacaatcaaaacaaagcatgacatagaactaaatgacagctgttttcaagactataggcctaaatttagcaacataagcacatttaatcataaactcctaacttacattttatttccttgctttaccaattactagagaatttatatatatatttaattttatatttatatgtaatttttttactactctatatattaatatatattaattatatatattattatatatattaatagtagcaacatcttatacacaacaaaaagcggaaatgtaagcaaagcactaagaaagtttcttcctagaagtttatgagtagttttatgacaatccacccagtgctaattcctttcatcatagatttaagtaaccctgattgagcacatacgtgcattcatttggcccatgtatatagtgtctcatcctattaaccatactttgatggtcattttttacatttgacttctattaccttcaatttcaaacccttttaggaagtgggtgaaagagaaaacaaatttaaatattctgtttcctattcttagttgactttttgccacaagagaacctcaaaagtagtgacttctaaaaatatttattattctatccaacacaatatatgaagtcactcaataattttacacatctactcaaaggaaagcagtgagcctggtggggatgtaccaaagttacaaccttcttaccatgagaattaatagttacagtgcctacctaccacataagtgaacacttaattaggtaatttgaacctcagttttgtcactcaaaagggagcaataaaacctaattgctacagactgaatgtatgtacccaaaaattcatagttgaaactgaatctacaatgtgatgataattgagggtgggaggtgatttgggaggtgattgggaggtgatttgggaggtgaatgggtagaacccttatgaataggattaatgcccttataaaagagaccccagagagctctctctccacttctgttatgtgaagacacagcaagaagaagcatctgtgaaccaaaaggcatgccctcaccagacactgattctgccagcaccttgatcttggacttcccagcctccagaaccaagagaaataaatttctgttgtttttcttctatccagtctatagcattctgttatagcagctcaaacagactaagacactaactcaaagagttgtaagacttaaatgatggatagacataggtcaatcagttggcataaatatctgacttatagtagatcctcaataaaccatcattcctttttttctacttcatttctaaatttctattttaagacagaaaaaatttaaaatcaaattcttacccttcaaatgtattagaagctgaatgggtggttgaaagaataaaaatcacagcattctaataaactgacttttttggggggcaccaatacaacttccctgtgaaggactacaattatcatttgttgatatataaaatattttctagaggaaattaaaattgaaattagaatttgaaattagaattcactcatatttttaccctttcttctagttgatccttcaaacattgatattttagcttcagttttttgttctcattttcattctgggttaattcctctgtcagtctgtcacactgtgatttcaacttctccagctgaccacgatgaattttagccatattcttctcttctaaactttcagcctgagaaaaagagaaggaaaaaacagaaagtccactagccatagccaaaatacaccaaacacattacatattttatcagtggaaaaacactgcaagatttcagctcgttcaaagcattcatatataaatattaaaataaacacaaaggaaatgttctttgcagttattcaatcgctcatcagtatttaccaagcatttacgaagtggtagatactggactagatgctaaagataacagatatgaatagtaagagagtcagatgcaacaatctatttgacaacactgaaagagaagtgcttattaaaggtgtaagctggatattttggaaatccaaagaagagacaccagctctgctaagaggggaaggagttattagagaagtgtcccaaaagggaaatactatgagatgttactaactgataagttccctcgtctatagatggggcttaacattcctgttcaccttcacttctggtttctatgaaataatggtgtactttttatgtaagtcattatcaatactactcttatggggctaaaaaaattatgaagtataacaatcaagaaactacaaacttaaaatgaaaaagtttaccagttattttttcaacatcagtagtgtagtacaatatctatttattgatctttatttagggtataaccagaaccagcttttaaaaaataaactttggaaataatctattctatataggaaattcagtaaagatttgtcaggtatgtgaacttaaagaattttaaaataacaataatgtaaacactatgtgccagacactgctctaagacttttctgtatacagtttttcctcatttcatcctcgtaacaacctgtgagaatcaaataaggtattatgattgtccttattccaataataatgagaaataaaagcaagctaatcacttgcccaaagatacacagtgaataaatgcagagtcaggatttgaacccaggaattctttctaatgtccctgctttcaactacgccacacttcctcccaaaaggtacaatatcattaggttttaaaaaccaactgggtgcaactagaaatgctaacaaaacacacctaccagttgctgacagtctgtaagcaatcacatttaatctgtttaaaatatatgctttaatgcctaaaatatatgtttcttttatttttataagtttatcatatgagtttaattaggtatataggaacgcaatcaatggaaacaatttcctgaaagaaagaagttttgtgagttttagacaaaatctttattttatttaccccacaaaatttacctgagagctgatgccacattaaattaacaaagaaattgattttttatgagcaatcctatattcacagcccaaaataaatttacaaaataaaatctctcatcaggaaaattgttcaactatgattttaagtttcagtagaatgcttttacttttctttatgtcctaacaaaagcataggtaaatacaaagaattccccctaaagtctgtagtgtgctgcagccagctcatagaaactgtcaaagccaactgggctcttctcttcccaacttcacccctccccaatgatgtctcatttgatagcttgaaatcagccaagaaaggggtattcagaacccccaaacttggcaaatgctataaatcaagggttttccacccaccggaagcctgttttcaaatatttaccagcacaccaatgcgaagcttgactaacaacttacttattgttgtggtttttattacgtttatatttcatttcagaatttacaaagtgatgtttgtgcacaacaacccagtgatatagaaggacattattcctattttaacagtgaggcataaaaaggtgaaataacttgaccaagatcaaatggtcagcaaatggcaaaaacacagaactccaatcctgcatcttctgaatccaaaaaaaggctctacaaaatgattttgttgaaattgcaatgaggtaatagaccaatatcctgaaaatattaatagcagatacagcatgtcattaaaacattttaaatttaaatttaaaaataggtatgagaggggtgattctagaaggaggaaaaaaatagaactaatttgtacagagaaaaaatatggatggcttatcagagcttattagactcaaaaatgtaataagttcaaatgaagctgaaagacacagaaatacaacatttatagagctacttgtctaaaactccgttgtgtgcataattcagtatattacatctcctgtgatggcctttgctctcaactcaatttaattaatataaataagtaaaaagtatggatatattaataaaatggcatgaagtggtgatttttccttaagggtaaattgtttggtttcacaggaaactgctgggctcacacaatctctggccattcttccaactctagagcaacttcaataccacattagggaatagctttaacacccctcccagatctcaagctttcaaatttaaaaaaaaaagaaaagtccaaaggtttcagaagatccgcagaatgcttataaattctaaattctttacacatagggaatttactaaagctttgttatcatctcacaacaaatgaactcaaagcacttcctcaaaaaaaatgaggaaatcaattttcccacattacatggagaaatccaaaccaaacagatcattgagcaagttaggagcaaatgctctgatttctagctttttcaacatttcaacttatagccactgagcatcttctgtatgtctggaacattatgctagacaccataagaggatacaaaatagcttagatctaatgcctgtccctctggagacttatgaacatgcaacaaatcaaaatacaaggcagcctaaatgtgctgtacctggggcaccaataaaagacctatggaaatacagaagaccaagagattagctccacctcaactgaaatttattccaacttcagtggatccataaaagaagtacaaaattgggccttaaaggatttggcagaattcttcttcctgcagactaggaggccgattcagatagagaatgagcagtcaaaagtatgcacagtaatctatatttgtatgaggaatgttggagagcataaaaggtaatgaacgcgccaggcagtggctcatgcctgtcatcccagcactttgggaggccaaggtgggggggatcatgaggtcaagagatcgaaaccatcctggccaacattgtgaaaccccatctctactaaaaatacaaaaattagctgggcgtggtggtgcgcacctgtagtcccagctacttgggaggctgaggcaggagaattgcttgaacccgggaggcggaagctgcagtgagctgagattgcaccactgcactccagcctggtgacagagcgagactccgtctcaaaaaaaaaaaaaaaaaaaagtaatgaatgtacatgagtaaggtagaatcatttcaaggggggctgggctggagtggagactttattacagagacagtaaataattaacgaaggtttttcagtagaaagtgacacactcagatatatattttgggaaaggaaatcagagagtatccggggggctaaaggaaggggttgcaggtagagaaaggaactagagggaagtagggaggttacttagaagtatggctacattgcaagttagcagtctgcattctgttttctagtatgacatatgatatattgtccatatgccaatgtatccatgagcaaatgcagttactatttctcactgaagaatgcatatcggaatgtgagaattatggccttacagagatgatcttgaacatgctctaactgaaaaaattattactaactcctgaccattgtgttgattattatacaacctaaataatggtgataagacataagtactagtgagaaggaaggttctagtttcaacaacactctcaagaaaactgcaagcttcttaaaacaaaccatttctctatgccatgccagtttctcctaacaaatcattacatgcttgtcctcatgcaaaaaccctgccttcctttcacatcacactatttctcatcaaccccctctaccttgctggcaacagctgactgaccagtcaccctcttcactgtggtttttggcatgtgaccaattaatgccttcacaatatcttaaatagccaagtgtccatcccacaagttaacttcaaagttatttgacctgttctttcccaactaccttcaccaacatcgcacaacagcaaccactgcatgaccacaccttagacctcaactctgaaaattcttatattgcacttcctgaccaaatcagcaacctctgacggcagatttttatccttcagctttctcattcctttgcccacaatctttgttcttcaatgttagccacatggaagtactttacacgctcctagactagtctcggtcagtttgtaccagtcttcataccagttttcatcttcactgctcctaatttcttggtgcactactgtcctattctacttcagagagaagaaaggctatcagtcaagattcacatcaatttccccagatcatccctaccaacttacccagtcttactggtttcctccgaatccttcagaggaaagatgccttgtctcctgttgaatgctatatactcttattttttatcaaatcccctcacatctcctcatgtactttctccatcaacctctgttgaatggaatgaaggctttttatacttcttctttcagcttgcctgtcacatttatcactcttgattataactttcttaaaatgtcttacctgggtttccaagacatcattctcttctgattctcctcctgtcatatggccttttatttttatttgctaggcccttttagtaaattctttccttaaaacattagagtttgagagtctcatcctctttttattccctgcacaatctcatccaaatcccatgatatgaactaccacccaagagttaactggctccgaaatatttcactctaatctcaatttctccctcaactcttgaccctactaattattatgtactaatctgttccacctagactttcttggttaagcttaaagtccctccccttaacacaatatgctaaaaaacaacaacaaaaacaaactagatttaccactgttctcttcaaatcttctattctgtctgtattctctatgttggcaatagtatcattatccacctaatctcccaaagtcattacctacctgtccttgagtctaaacttttttccagactagcaaagcagttaagaacacagttaattacctgagttcaaatcctttccctaccactctcctgctgtaagaccgtgggcaaattacttaaccttctgtgtcccaattgcttcatcagggagaaaataataccacacaatctgcaaggtgaggtgggtattaaatgattaacacttgtaaagttcttagagcagtgaccggcacaaaatgttgaaaaactgattgctggtagtattgttattgtcacagccaatcaatcaacatgtaatatatattttattttctataagatcagctcttctccatatcccaaactctactttctatattcatcaactctaaaagattactattccatagttcatcaacattaaaatgtgtatcttccacatttgaccatctctgacctgggagttcttacacttgatagcattatgatggtttcataggcaggaggcagcatttttatttcttaggagcatatgcatctagtaataacagcaatgatgcatcttataaggtgtcttaggtttaatgaaatatagtaagggtcttttacctattttagcctccattctgacctgccaatcccaactgaagaccccaaatccactaatgccagaaggctatctaggactggggaaggactcatagaatagctacatcattttacagatgtcaactatttcaatatcatttcatcttaaatcataagcattttgaaagtagtagttgcatttcaaaggcttttgaaaaacattataataattaaccttcaaagatttatccattcattcattcacctattcaatagatatttacaatgttccaaaaaactgttgtaggcactggggatatagctagaagcaaaacagactaaaatccctatcctcagagagtcttcatttcaataaggggatattaaaaaataaataatatggaatctatatcatatgacacgtgttatgaaaaaaaaaaaaaagacaggaagaggaacagatttatcacactcctgacaatcatgttataaaatgattgccctgcatggtgataatgctaacaacattagaccttagaaacatttcctcaaatgcaagatcccaattaggcatttacccaggcaactttgatttggaaaagaaggagtaaatctcgaaagccttgggtttacacagcccataagctgatccactttagttaccatacaaataaggactgtggttatagcttctctggccttgacgagtctttgccttttatattttaggaggtcataaatgttgaatgagggcacgtttcaggtccatgacttactgccacctctgcctttcctgaactccccaaacagctaaacgttctttataaagggcttcaatgctctgaaataggtgctcccaggtggctgttataactcatttcaacctggccgaacaggcatgaataagcctctttattgttggttttatcttcccttcagtgcttgggaatacagaatgatctctaaaagtttacgctttattaacttcatgagccaccagaaaaattccttcagtatcatcaggataatttagcagaggtaccttcagagtcctgatatgattctcagcctcactcttttctttcttaaagtgcttcataagctcctggatattctgttcgtgttttgttttcacactctgcaatgatgatgtgagatctttcagctccctctggtgcacatctcgttccagctttaactgtgtgatgattgtagctgtttcttcatccctggattttgcctgtgcagtgaggtcagaaaggtccttaagcactgctttcttggctctctcttcctcagccaatttattagcaagatctgctcggatggcactcaggtccttgatggactcttgcatctcaagaagtttagctttgtcctgggcctggctcttcttgagctctgcaatttcttcctccaagtgagctttctcaactttcatctggctttggatcttactctgctttttcaattcgctctccagtctatggatggtatccagggaattcttaacttccaattcaaggtcagcttgatgagacttaatatcacgtaatttctcctccttggagtgaagctcctcctcctgaagggcacgctttgttaggacatcattcaattcctttcgaagattctctatttgttgtaatgctgcatacagctgggttttcaattcatccttttcttttaaaatctatcaggttaagaacatgaagcaaaagaaaaaaataaaagttactgtaaaattcaccatagactctgccagtcagcaaaacaatgtttaacccacaaggaaaaaaaaaattcatcaaataatttttgtatttttcccattttttaataaaaatacttttaggccagaaaggtgggggggaatatataattgtcctgaaatagcaacacactgaaatatgtatttcaaattttcatcaccaaaacttatttcaatccatggtcacaaataattatttaaatgtaagataaaattgagcaaacaaatggggaaagcaaagactctcattataaagaaaacttactacaggttgaaataatacactattacctaaaataatactgatgtacattccaatgatacacttttaaaaaggagaaaccccaaaacagagatggaaaataatatagggaagcatgcagatacaatacaagaaagtttacggtacattcagccattatttttaaaatatcaatggtgacgaaaactcaccaatatgcaactgggagcctggaagcccacaaagaaatgagattaagtcaggaaaggttgggaaagggctcaagagaaaagtcaagggcctagaagtccatcattctatgccagcctctctaagatttacatggaaggacagaggccaagggttaactcttctggcctctaattctcaccacctaatcattgcaaataaaataatgggcagccaagggagccaagattgttttctatacaacactggcaccaaagataatctccgtgaaacaggagggaaaaaaaggaaccaattaagactcatttcagaattacaaataatgagttaaaatgcaaatatttgcaagacatttctacacttcacattttatacttcagtgtaaaacaatttatgacaaaaatttaatgagtcaatcactccaaaaaaaagtttccccaatcctgctcagttttaactgaaagaaagaaagagcacaaagataacatgagaactaacaaaaggagatgaataagcagttgagctctgaccagaaagaagtgaatttgattttcagttcaatcacgggcaattctatggcctcggggaaatcatttctcttactagagaaaataataatagctatttcataagactgtgatgaagattagtgagaaaggggaaacaaaaagttggagtagaatttaagttcgaggaggtattagggtctcagggaggtgtttatgcaaggtagtgatcaaaactgtaaaaagagccaggcccagtggcacaccctataatcccagctatttggaaggctcaggcgggaagatagctttggctcaggagttcaagaccagcctgggcaacatagcaagaccccgtctctactgtgaaaagacgggataactgaggagaaggaactctggaacacagatgaaggagttcacttccgaaagaatgtaaggtaggagaaatatagatgagcctaagggtagatgtattatttttctattgcttcataacaatttccaacagacttagtagcttaaaatacacattttttatctcactgcttccaataggttgaaaggccaagcaaggtattcagcttaaggtctcctaagactaaaatcaatgtatcagctggccagggcgcttgtctggaggttctgaggagaatccatgtccaagctcattcaggtttctgatacaacttgtttccatacagttgtaggactttgggtccccatttccttgctagcttttggtcagcgattattctgaacttctagaagccaaccttgttccttggctcatggactctgccatcttcaaagcttgaacagcttgatgaatccttccgaagctccaactctctctgacgtccccttctctcaatagccagaaaaaaaaaaaccttctattgagggctcatgtgataagattaggcccatccagataatgtgatcacaggagtaatgtcttatcatattcattggttccagaaattagtgtgacttctttggggagggtcattctacttaccaaactggagaacacaagaactgatagaatcaaatttgggctgtaaagatagcatgggagggactgagcgagggtagggaccttcaatatagtgatatatgtttgaagcagataacttagcccccttggcatgagttgagagacttataggcagtgctgaggattaaaatcatattttcataatgaagtcataccatgtaaagtgtctttaattatgaaatattatatcttcctgaagttggattaaaaagcaaagatatttctttttcacacataacagtaagtccagagacaggatggttcaagaagaatccctcaaagctcaggctctgctactctataactctccatcttttgctgtctttgcagtgttccaagcttcacatcaattcctgacaagggtgacagccagagggcagacagtcacagaccatgtgagtcaagtttggaatttctttggcaatacagatactaaaaactaagctctgtcgatctgattctggttaattgcttgcctagtagccacagcttaagattctgtctaggcattttctctgagtctgaaaatgtcagtgtctttactgtcatctcaataccctggacatacccagggccctcaaatgaatagcctttatcttgaggcaaatcaaaacagtggaattgggttctctttgtctggccaggatcttttttttttttttttttttttctgtttcctgactccctcttgtgcttgcactaatttcagtttggataaataattcaacttttccaaacctaaggggttccaaattatcagactcataggcaatttggattatagattgtagacttcaggctccccaccttaaacaaacaaacagaaacgaacaaaactctctgcttttagacagaccagtttcaacctaaacttgtctttctcttgtaagaccttactgaaggctgaaatatgtacacaacatactccaacatcctaaagttttcctaccagtcacttaatactatcctcttattcacagcatcaatgcccctaaatatgatttctgtttaaaccaattgcttccaaccacatagcaaggtttaccaactttccctttagaacaatatgatcctctcttgccccttaccctacttctcctctcggtcaaccctacaatttaggctattttacttatggctccttatttctagaactcaaagtttccataaacttgaattttttctgctgagggtaagagaaaatcccaatccgaaatggcttaacccacaagaaaatcattccaggcagaactgctccagctctctgcaatttgacagtatgtcaaagctttggctccagctctctgcaattttgtacctagtgatggtcttacattaattattgaatggaatggatagggggaggcaggaggtaaccatgaatactatggaacccaactgatatttctatggaagttttgctgttactgttaaggagaaggagtggaaaaagtggaaagtcgggttgactccagattagaaatcggtaaaatatatgagggagaagaaagaaattgaagatgtgatgagaacaacatcaaagtagctttcaatgaagtccaatgtgacaggaaaaaaactgaatccagaaactggctagtaaaccagaggaatgtagaaagatcaaaattgggtatgaatagttaaaaaagctagggtgtagggaatagaagaattatgaaagatcagagactgagcttcggaactgaaggcttggacatgaaacaattacagatgaagataaaatttaaacacagaaattagacgctgaagtagaattatttcagtgacggtcactataaaataagacattagtgaattataaggatacagacttcagtaggttgcagacttgaactttgaagttactaaggatgacggcaagaattaatgtcataaaacaggttgatgcaaagccaagtgctaaaatccttgagaaatgtaggggcataaatgaaaaatagccagcagtcaagagcaaaaatggggaaagaatgctctaaccaggcaaaccaagcttccaaagaaggggcaaaagaaaagattactgaaagaaggcctgaaaaaagctgtgcgaagccaaaagaatgatactatttaaaaccatggcaattacagaaacagaagccaactcctcaaagacgtgaatacaaagtattatatacgcagtttggttttttttttttaactaactaaaaggtagatgaggggcttgctcaatgttttttttgttgttgttttgttttgttttgttttttacctgcatgtgagggaaaatgcaggcagatggctggattatactaatacatactctagcatttcttgaactgtatgtgataggactccatatgcattcaaaaaatcatatactttggcactgatccttcttactttcaaccattcaaaaattcagattttacaagatagcatatattacatataactctttttttctgtcagcaggaaggaaatacacagaaggaatagatggtaatttaagattcttgaagtcaaatactatcaagcaaaaagctcaatacataagcaagccaattattctgccaattcagcaggggaaacaaaacaaaacaaaacaacaacaacaacaaaaatcccaagaagtattcccattatccatattaaaaaagaatatgaaaaaaaatggaaacattcagaaaagcatatactatgattggagtccaattttttcctttatcgttttcaaagcaccattacaaaccaatgatttcaaacagtaccttaaaagaaaaagagaagcaaaaataccacaacttacgactagattatttgtatctataaagttttcagtctcctaatatgtgttacctacatatccctgaagtacaccacaattccctgatgtaaatatccattgcattgtctttgaggaaagtgtacaatttgatccatctgggttttttttttcccctgcagtgatacgcgatttgatattacacatccttcagtaatgaagtagttttgtaatatgatatatatctgataaccttactaagattccagaaatgtaaaaagcaggaaaaaagaaataaatcagagaaatttttaagagaaaaaaagctttttgccgttttgtatattttttaagtaacaaatcttaaagcagaaaataaattatgctagaaaaagagaactggtggtagacacagaaccatactgcaaatatgaggagagcatcatatgatcatataaaatgactcagtaaggctacttattaagtaatttattctttaagccacaatatgttatatttgtaaatcagtataatttttattttaatacacccttccaaaataccttgcagtcactttttgaaaataattagccctaaaaatcaaaaagaaagtagctgtattataaatgtgttaaggtggctttgtgattttattgagaattaaatatccctttgaaataatattcagtaatacatttttaaattttttttccaaaattatttaccatgtatttccacatcacagatttactgagcacatttcttactcttttttccttgaaaaaccattgctctaactgcaacatgctgcattaatttttaaggcttttaaaggagaaattacaatgcctgctgtgataattgtgatacgaccctaactgtggcaatcactttaaaactgcttctttgcttatcattagtaatgctaagtgataaaaataattggaagtattctgggaaatgattgttaaacaatttttaatattctgaaaactcaacctagaaaagtctcagcaccatggactggaattactgtatgataacatggacccttctaaatctcttctaattaagtaaaacctccagatgagattttcaatcaatcaattctctcaaccactcctctcgctagctacctacctaccttacagtcaggctcattgagccagttgccagatcaggctgacaacagaataatcaagatagagcaatttcctgggatcagatcagttcagacacaagtctgaaagcttcagaactgctttacttcagggcaaccagccacccagtatgtgtcagatgggttaaaatgaaaagcaatccacagtgagtgcaaaatgatcatttctttcatcttctatatgtccgagaaattcatatgtaaaagataaagcatcttttccatgacagctcatctgaaataagtatctgtcactcttaaatgctgaaaactgattttataaatataatgccctatattttgttttcttttcaaagaaagtcaacttatccaaatgattattcttttggaatgtacagagttctcgacaagtgacaaatgacaaagcacaaatgataaaccaagaataaacatggataaaaaaatcaatcacgactttcctgcttattatcttataaacatctgggtttaattcaacccaaagatatatcagatgagaatcaacataggagcataaaatccatttaaagtaactgattatacaagagaaaagataatgtgaaatgcatacatatatcagtgaaatgcgttttgttgctatcaaaagggcataaaagcaaagtcttgaagagggttgtgatcccataacactgctcagtcagtgagatcctcagtgtcacgcatttaagtaagcccatcacagttgctgccagtaaatggccctagtaactactgcattttttaaatgcttctttctaaccaatacctagttgaaaatatataaataaatgagattttaaaataaatgcattgggaggaaagttgtgtgaaaataacaaagatttagtcattttttttccattggaatattagaagattaaacaataattcaatataggaaacttacacctaaattggggcaaggggtacatctatttatgggccaactctgaaaagccacataatattaaactatgaaaaggcttaagtaaaaaatatttaaaaattaacttttgtactttgaaacagccaagacataaggattcgtctatcaaggacatattgattatatgtacagtatggcactcaagtgttttttcaaaggatagatgaatgaatggttgaatcacattgaaaaccgttccttaggaatgtggcttttatacctgattattcttgcctgtcagttcatcaacagtttcagattgtttctccaacgctcgttctaacttcttatgcttaagcttccactgcctaatggattcttgagctttcagtttcaggtcttccctcctcttctccgcctcctctttcagagcctctgactgctggagctcactgaggtaccgctcagcctgcttggttgcatcctccgcatggcgagtcagctctgagatctgaaggtcagcatgcttacgctcggcctcacatgtgtcaaagtgattctggatctccttaagtcgatccaacatctgcagttgctgtttttccccattctccagttcacgtgttaaattctacgaataaagcatgcaaaacattaggaacaaatccttgtcaaaattggatgtgtagcatatcatcaaacaagaatctctaatgtcactgaagtggaaatcatctgtattaaaattcattagcaatcaatttagaaatcatgagtctttttctttgtattttataaccacattagttgggaataattttttatataaatattccctttcttggactattttatcatccaaaaagggaaaatatgtgtttccaattgactgtcactaaaatagaaggcacttttgaagcgaacaatgtgcattattttagtaacaacctagtgttttgtccagctgaagaaatatcgatgttttaaaatttgtcaggttatcagagaactattagtagcaatcatatataacattttgccttctggcagcaaaacagaattataataaaaaataaaaataagtaacaatagagtgacagaaacatcagcatagataacatattaggttcccaataaagtgtttatacattatttccagataaaccaacataatattatacattgaagcacttatctcaagctgatatgaatcactatagtacagatttataaatacacttaatttaactttattttgaatatttctctaatcaagaaaaaaaccttcagtctagcttccctgaagccaggatggtgattatatatttggaaattacactaaatcatcatgattaatacatattttaagaataagtaaatatctattttaagtttaaacatgagaagatattgttttatgcaagtttatacaaataaaataatcattaacattaagccattaaagaatcattaacattaagccacttttgtaaagctttgtaagaaagtgataaattcagaaataaagcacttacaatgagtcacataagctgaccctcctgagccttagtttccaaatacttagtggcaacaaaagtaacataaaaaggtcatgtgtccgaataagaatgggttccaggggttggaatgaggctgtgagttggataaacaataaataacatctccactgtactaaggtccggacaaatgaaactagaaacatttaccaagctcctttggccccaacagcagaggttccaggtccagattctatgatctatggctcaaataaggttaaatataatttccctcatgattaaaatcatggtttgacattatggcaaacatttttttaaatgcctcaaaaacaaacttcattttctgggcgacaggtttgcatttgtccagtttgctaaattcaatgcagcctggaagatgtctcatccacccaaatggtaaattgagaactgtgtacttgtgtgtgtagaaaattctaaaataagatgagaaaacccttgtaattgtggtttaccttttgctcttattctaaaagttttaccaatatgctagaaatcaacttgattaacaagcagcaatcaagtgattcctgatcaaaagagaaatggaactgatttttcttttcaacaaatacttggaaagaaagtggttatacttcctgttcatcaagcatatggtttatagaaatattaataggacatagttttaataccagagaagctaactctaattagggaggtattctcactaaccactaaattatactagatagtcctaggtgctaaaacatgatggagagttacctaaaggggtctatagactacaatgtggctgtagagagtctcccataggaggtgatgcataagctgagatttaaaagaaaagaagctagcaataataatcaaataactatgactgtgactgaaatgcattgagtactcgagttataccaaagattgaatgctgtatatgaattacctcattcaatcccaacacaaatctaaaatgagacaatattatccccatttcagtgaaaagtaaccaacatttgctggagttaataacttgctcaagatcacacagctaataagtgagggcatagggatttggacctggatagtctgcttctagagcccatgttatcaacctattgctaaacttccagattctcagatgaccccaactccaggcctcttcagtcacccactgccatggttttatcttggtgtttttatcagaactgccacctttaaagcaaggggttcctgactccaccctcttcccataactctggatttaattaccaatctaatcagctattacaccctcttccttctgtgttatctgtgcttcattgtcaaggagatgaccactcccttgagatttcttttgctagctttaaatcctggctctctaacccaaacactgtattttttcactttagccaatctcttgcttacacctagactccctctttaaactgttcattcactgaacataaacaacaaaaccaccaactctaggtgaacttaaaaagttcctaattcctacatcaggttgagtcctgtaagaaaaatcacacaggactatcagttgatgtgaccacatagagagtcaactcactggcacccagaaagtcttccacatgcctcaacccagctcacacaagggccattatgacaaaaagtctcatctctgaccctaccatttttacctttggttttagtatgtactataactcctccttcagaagtaaaattgggcaggcagttaatgcaggataccccaaatatgtcctacttgtagtattttaaaatttaccaatggtcagtttcttctcttttccagcctccaaggaaaggggattcttccttagacaaatagcctatctctgcgattttcctacttgactattctgctttacttctctcatctcaaaaactaacagtaaagattttaaaaaataaagaaaagaaaaacaacaccaacaaaagcactttcctcaatcctacattatcttctacccagtaccatgtactcatcttcctcttaagccaagatcctggaaagagtggtccatacttgatgcccctacaaccttatttcagttcacttggttcactacatctggtgtccatcatactatgaaaacagctctcatcaagatccccaaagatcacctacagccaaatacaataactctttaaaaatcttactttgggaggccgaggtgggcggatcacttgagcccaggagttcgagattagcctgggcaacatagcgaaactcctgtctctactaaaaacacaaaaattagctgggtatggtggcacacgcctgtaatcccagctactcaggaggctgaggcataagaacagcttgaacccaggaggtggagtttgcagtgaactgagcttccgccactgcactgcagcctaggccacacagcgagattcagtccaaaaaaaaaaaaaatttccttcacctagtttccttgtagcaggtgacactgttaataaccccttgctcattctaactctctgcttccttaactttcataatactacttctcactagttctctatcttcttattcttcttctttcataatctcctttcctgagtctctcctaccatttagcctcttaaatctaaataactctataaagttccagtattatgcatcatcccacctacacaataccctcggtagatgagtatttaggtagacagatattagtaggtattagtgagtcctacattcagaagccatactaacccatcatctccagactttcaaatatctaatggcttcataactttctacacttagaaatctcacaggcatcttaaatttagcaagtcaagaagtaaacttatctgaggaccaactcctaacaaaaaggcagtcctactaaaatggcaggaaagtggctctctgatgagggaggatggaaatgagctgaattgtgtattttaatagtgagcagatctgaaataatcactgtaggaaaagaggaaatgaacaactgatagatgtctaaaagataacaaacagaaataaggttctagttagataatctcaaatttataatgggcccaagagtataccaaattctttggatttctccagcaactcacttgaacccagaagcaaagtaacttcagggttatttaatcttctgtaactacagagcaacaacagggagcacaggattaacatattcaagcccagagcttacgcaggcaaactcttttgttctcacatttaaaaactgcggactcttatattaacatgctacatgcaataattcactttgaataatatttgaaaagatcatgtcattgattgggtatgtgagtgtaaatgaacagaaaagggtaggatcttcttgtaaataattgtggttttcactactcaagagaaagcaggtttgaatttgtcctggatgaacacctcttctaactgccctaagtctggaaactatcagtagctactgctttgctatcagcctgtgttatgtttcaggtaaaattcatcatagaggtccttcctatattctcctaaggatcctattcagccattgtttcggcatttctttaatccattttcctcaaataaccaatcagaaaaatctaactgtaataaatatttatcccacatcaatcaaaggactatactacagaaccctcatatcaattcccaacacacatacactctcactcacatacatatgaacatatacatagagcacataagtgtacaaacacataataaatccatgcataaatgctttcagggtatttatagtaaatattaaggcacaagtaataaatattattttcctaatgcactacatgaaatgctaaatgaaaagcattttacttatttattccattataatgattttcagttctattattactattatatattcctggaggcatcttctacactgaggaactttttacatttagattgtgtgaaattatctcagccactaaagcagaatggttaaatttcatatcacttaattaagtccatgtttatttcttgctatataagcagtgtcaaaaaaaggaacaactcaaaaacagaattatccatattaccataaattcttgcccatacattgccaaaaggcttataaaagctccatctaaatctaaaactttatacctttcaattctccttcttttctctttctttcttcaactgggaaaaaatggtgatgagtagttgggttgaaggtctcaggtttgctggtagttggaaggatttataggactcggcatattacagtcataattatgttaagatttattaaagaggaaagaaagaaagcaaaataagcaaagagaaaaaggcacacgaagtgaagtccagtggaaactaagagtccacttccagtgaaattacgcaagacatgttcaatttctccagcagtgaattctgacaacacatataaagtgttatctatgaggaaagctcattgtgtccaaagttttaattaggggctagtcacttgggcaccatctacctgtatggagcaaaattttagactctcagtaaccaggtggtcaaaataaactatattttttgtagtctagacacagtgaattctccttattattatttaagtaaaactttatttcagcgtagaaaactacttatcatccaagttctcaaatgccagaaaagaactgctaagcctgcatttaaaacattttccatgagggtttaagagacataaagtagactaccacacaggtggcaacaataactactcatttgttcactgatggaatgaacgtataatataatatagtgcaatttttcctctactcacacttgacagtgaacacacacaagagattgggcaccttggtgaacatttaaaaacatacattgaaaatggaaaatctacccccaaataaaccaggataaacaatgcatattttaaataatcattttcatttatagtatttatgtgctttgtatagaaacttgtaagggtaagtgagaaaactgccagactgtaatgactcaaaagtcacatctctaggaagacagtggcatatcatggaaacagaatgagtcactcaggcttgtgttcaaatcccagctctgctatcctgtgaccttagaagggtgcttaaccttcatgaaccaaagcaacgttgttgccggaagtcagggaccccaaacggagggactggctggagctgtggcaggggaacataaattgtgaagatttcatggacatttatcagttcccaaatagtactttaataatttcttatgcctgtctttactttaatctcttaatcctgttattttcataagctgaggatgtatgtcacctcaggaccactgtgataattgtgttaagcgtacagattgattgtaaaatatgtgtgtttgaacaatatgaaatcagtgcaccttgaaaaagaacagagtaacagcgatttttagggaacaaaggaagacaaccataaggtctgactgcctgcagggttgggcaaagagccatatttttcttcttgcagagagcctataaacggacatgcaagtagggaagatatcgctaaattcttttcctagcaaggaatattaatattaataccctggggaaggaatgcattcctagggggaggtctataaacggccgctctgggaatgtctgtcttgtgcagttgagatgaggaatgagatatgccctggtctcctgcagtaccctcaggcttactagggtggggaaaaactctgcccctggtaaatttgtggtcagactggttctctgctctcgaaccctgttttctgttatttaagatgtttatcaagacaataagtgcaccgctgaacatagacccttatcagtagttctgcttttaccctttgccctgtgatctttgttggacccttatcagtggttctgctttttccctttgtcctgttctctcagaagcatgtgatctttgttagacccttattagtagttctgctttttgccttttgaagcatgtgatctttgtacctactccctgttttacaccccctccccttttgaaacccttaataaaaaacctgctagtttgaggctcaggtgggcatcatagtcctaccgatatgtgatgtcacccccagtggcccagctgtaaaattcctctctttgtactctttatttcttatggaaaatagaaagaacctacactgaaatactggggacaggttcccccgatacaatgtcacttataaaatggactcaataacaccgacttccagaggaatgataacctacatgaagataaagcacccaaaagagtaactgacacattttaggaactcgataaagagaactttttatatcttgctagcaacaatgttagaattagtgacataatccaatgtctacattttacagatcaggaaattgaggcacaggaagagtgatcaatccaagataaggcagatagtttttggcagagaaaggactaaacacaggtccctaatattcaatccagtattgattccacttcactatgataatgatttggatactattcaaatgacccctttaataactaagttgccatgttccttctagacaagaggaactcctgaagaggaatcatacgatcttgatgcagaggtgtttcctaaatgtttgtgaactgagaaaaaaaaatcacaggataaggttgacttgtgttaaaactaaaccaggcatcgactagttatttattcctttctatgttaaagacactaggttaggcactaaggaagtacttcagtataagtactgattggggtgcatatgaatgagcaggagagaacagacattgctattaactattagaaaccagatttaagttagtatgtttcaagagaaactactctgttcagcaagacctcagaaagaagagaaatgaaacatgagaaagaaggcaaactaaaatgtgaagaagagaaaagattgggtcacttatggaaaggaaacgaacattcactaccaaaaaacatatgggcaacagatttcaccactggtggctgattatgacaagtaatagcttgagagggctaaagagagattaaaaaataaggtcagcttgcttatgagttcaaggacttttttggctgagatgatggggttttctaaatataaaatcatttcatctgcaaacagagacaatttgacttcctctctttctatttgaatgcctttatttgtttctcttgcctgactgccttggccagaacttccaatactatattgaacaggagtggtgagagagggcatccttgtcttgtaccggttttcaaagggaatgcttccagcttttgcccattcaatatgatattggctgtgggtttgtcataaatatcccttactagtttttgacatacgtcccatcaatacctagtttattgagagtttttaacatgaagagatgctgaattttatcaaaggccttttgctgcatttattgagaaggaacttaaacatatttagaagaaaaaaaaacaaacaaccacatcaaaaagtgggcaaaggatatcaacagacacttctcaaaagacaacatttatgtggcaaacaaacataagaaaaaacaactcaacatcggtcagatgcggtggctcacacctgtaattccaggactttaggaggtcgaggcaggcagatcacaaggtcaggagtttgagatcagcctagccaacatagtgaaaccccgtctctactaaaaatacaaaaaattagctgggcacagtggtgggtgcctgtagtcccagctacttgggaggctgaggcaggagaatcgcttgaacccaggaggcggaggttgcagtaagccgagattgtgccactgcactctagcctgggtgacagtgtgagactctgtctccccaaaaaaaaaaaaaaaaaaaaaaaaaaagctcaacatcactgatcatgagagaaatgcaaatcaaaaccacaatgagataccatctcatgctagtcagaatggcaattattaaaaagtcaggaaataatagatgctggtgaggctgtggagatacaagaacacttttacactgttggtaggaaagtaaattagttcaaccattgtggaagacagtagggtgattcctcaagaatctagaaccagaaataccatttcacccagcaatcccactactgggtatatactcaaaggaatataaatcattctattataaagatatatgcacacgtatgtttattgcggcactatttacaatagcaaagacatggaatcaacccaaattcccatcaatgatagactggataaagaaaatatggtatatatacatcatggaatactatgcagccataaaaaggaatgagatcgtgtcctctgcagggatctggatgaagctggaagccatcctcctcagcaaactaacacaggaacagaaaaccaaacaccgcatgctctcactcgtaagtgggagttgaacattgagaacacatggacacagaaagaggaacaacacacaccaggggggcctgttggggagtggggggtgaggggagggaacttagagtatgagtcaataggtacagcaaaccaccatggcacacatataacctatgtaacaaacctccatgttctgcacatgtatcccgtttttttttattttttagaagaaataaagaaaaaaaaagaaaagtaaggtcagaaattgacttggatactgaaatccagtttaagctttcaaaggttttctagcaggagaataacatgattaggtatgtgcttgagaaagattaatcaccaaaagactttatgctaacactaggatattaaatattatggcaacattaaaaataattgaacataatccttttaaacaggaatggacttttagaaccaattcttttctcatctgaattgaatttcagcaaccaaatccaatggagctggcttatcatacataagaacaaactgtggcatttgaaagactgaaaaaggaaagaacgcatttgtcagtttttctgaagacaatacacgttttcattcaattcaataaatatttactgcattcagcaatatcctagttgctgagacatgaagatgaataagatagcatatttctgtgttctattgctccagagaaccacagggcatagtaggcaagaccgacatctaacagttatttttaataaatgtgatatatatgagccattctttgtgctctatttcaaatcttgcctctcttccaaatttatgctgcctagtatatgctaacacctcattcctgagtgcctttatctgattttatggtgaaggaagaaatgatactttcttcaaaacaacagccctatgttaaaaaaaaaaaaaataggtagtggctaaggaaacaaaagaagttaatttaacagttactactaaaagtattaaaaagaaaaagagtgggcagtggggaaaaaagagacagaaacagaggtggaggaaataaaatgaattcccatgccagccaatcccggaagtcacacagctcccaacaccactcatgccaaagtatgcctagcactgtcttctttcaggatcaaagttcccttaataccagtgtgagtaaaggagaggaaaatggggaagagaaaaaagatcaacatgtgaatctgatcaacaagacaccactcccaaatattcacaagtaaagctttttgtaagactgcaaattaatttgactctacaacatttaaaaagaatgaccccaagataagggacaggacaaatggaaaatcaattatttgtaaagcctctatttcatcctgaataattagtgaagaaaaaaagccacttgttcaatttattcctttttcccagttttatgatatctgagaaaacctcttctaaattttaggacaaaaaaattaaccataaattattaatgtttatactagctaaactgtcagttattggtataccatatacatgatacaatagttgtagatttacagttacatttttatatatttacatatatataaaacaaactttttagtatactagaataaacatgtgtactgcaaaattatgtggatgtttacattatactcattttacagaacataaagaataattttaaaattttaatcatttttaaataattaaaagtttttataactttgaattaatgaaaaattcattttaatataagtgttttgtttataaaactttggtatgcacacaattaattacaatatttcttatataaaaacacacaaaccaaactgcaatgatgtgtttcataatacagtttccagaagcacagtacagtgaaaagtagcaattgcctaaatgtatcaaaatcatatactgcaatgataatgatatttcaaacacaggcatataaagttccattctctccaagggaaatgcagtaacattaaagctaataagtggtagacaagccaatgatagaacgccacttgaaatataattcaattaattatctataatactgaccctatgaacaaaaattaaactaatccctgtccaaaatatgacttctttaaaatagggacaaaatgaaaatattgaatgaatataaacgctgcatctaaatgggatacaaataccacagtgagaaaaatagctgactcaagtgtaaaaacatatatatacatatatatataaattgtattcctattttgtatttattgaaatcagactgagttctagcttgttggaacgttttacagtttccttgtgaccagttaattgcatttagagatgctttagttttaactaaactaaaatggagtagatgctttaaaaaatcttcaaagaaattgtatattgcatataacattactgatgtgtgtatatgtatttataaatgtgatattaagattaacatgaattcaaccgacattcacttgggtgccaactatggacacaaggctgctcaagggcaatgaaaaatacaaggcaagttcctgttcttcaactaaaagaaaacctgattactggcactgtcatgtacaacccaatagcaatcagcccccattgccacctccctctaacatgttctcctatcatatggaaatcccaaaactgaatactcagcactctcttgaggttttgggataaacctcaaggtttatcccaaaccttgataacctagataaatctaggagatttaacctagataaatctctaggttttgggataaaaattaggatctgtcaattagatgcaatgtttagagatttggaatgtggaaatgaggcagggaccatattcttgctaatttgggcatactagtcatacagtatagtcatactgtatgctactagtcatacagacattatttattttgttctgtagtggatctcgccctttgtcctagctaagaggcctttgcagcagcagcttcccaatccctggaagcctaagcagggccaagtctgccaatgatattataaacacttactaatagaacactagagcagttttatttccagtactaacccctaactgatattataaagttttgcttttattgaataaactaaagaattaacaaatttaatggagtttcacctgaaattttcagattctcaatcaagccatcccctactcatctctattgggaaattagtttgacatatgcttgcatgtcttgatgaacttaatttattcatttcagtataatttgagtgtttcatgaactgatactgagagcacaagtaatcaattttccacagtcagaactaaggcaagtctctttgaataaaagaactccaatcaatcaaaggaagtctgggagccctgaactatacctacatgaagctaaattaggctgtcattcattgagaccataccatttcaaatggtgttttttaaagtagtgattggttgaaagtagaatactatattaacattttagtcaattcttttcaactcaagcaaaactactaacaatctttaaaacttgattcaaattcttaatgagtgaattagcagacaaataaaacatcaggggccatggtaataaccatatcccatatattattcctttaaaatatagcctactgtcttctctatcattctaattttgaccacatatgccattatcattttctttttgccaaatggagcagaaacacacaaacaatatcaatcccaaataataggttcttcagtcttagtgattaaaaatagttatttccaaacaaatcctacgagaggcttcatacaacctctttgtactttttaataaaacatgatactaaacttaagcaaactacagaaaatcatgttctattaattaaatacactcatctctttgggaagaaataaaatattaacttctctttcattcactagatgttcactacatggaagattttaaatacacatttcttcagagtgtttaacttaaaacacaagggacatgtaattaacatctaggcctcagtaatgcacgagggaaattctgaccctggaacacatatctcaaagtacatttctgttttcttaatttatctcacaccctattagactgataatttcaatactgcaactctgatgtttaaagtaggcactttgggagaagaaaattttaataaaaataggataaaactcttctgcttaaagtagattggtatttgagactgcttttgattgaggtagaacaacttggttatacatttgctatgaaatgcgataggccaaagcaagtatcaataaaagacatacacctatatctcaccaatattaatgtggcagcagagaagactaagagaaattacacagatcaatttaaaaaaaaagttattctgaaatataaaacaaatattgagggagagaaactaaatataacacaacacctaatattattggcttacatcattatagagcattatggtttatttgaaagagaatagacacattatctcacataatacagtaactttgtgcacttggaagaaagcaatttttctattttaaacatgaggaggaaacagaaactaaggaaagctatatagatgagagaccttgtttttcaaaaataaatattgtttcaaataaatataataatctttttttttattcaagtagacatggaaaggggtggctttgggtgatttttctttaatcaggccctcaataaaatgcatcaacaccttccccataaagccacccaatattcaaataattaaagtaaaatcagggtactttctatgccactaagaattcaagacatggctcctaacccaatttcacaccatccaatcacattgccacctattaatttctacttatgtttaaattaagtaaaattaactattaaagttaaaaatttaggtcaatttgaattcaagatggctaactagagacacagacacccgctctctgcagaagcaagaaccaaaattacaaatagagtctcatacctcaaatagaacatcgaggagagaacactagagtttaacagagaagtctcaggaaacaccaggggctaacaaggtacaggaagtaagagaccagctcaactgggatcagctgaagacccagcggggctaggttttacagaaaaagggtaagtgagagaacttcagctgttcacattcccaccacaaactgctgcaatctgaaacactggagagctcctttatccacatgaaccctaacactagcaaggacagagatctgaacatcccgtaagggccctgcaccagacgggaacttgtgctaggttactcaccccaacacagagacctaagcagctacagctgggtgccactgtgagagcacagccatcataggtctacatcctgccctggaacgacagtcccaacatctacacatcctgggtgcccacggacatctccctgtgtcccccagaaggctacagcagcacagaactggctgaacccaaagatagtgcagggtccctagtactctagcacacaggaagtatgtcccagggaaagaaggatagagcacatcaaaaaagcagcccctgaaacaaaggataccaaggcaagcaccttccagagcccaagaactcattgtctgggaccaggagaagtgaccccaccaccagtagtggcacaaactctatgcttggcctcacaagcagagagtgagatcccctcccactggcagtggtctctgtgctcagactcacaaatagaaaagtgagacaccttttgcccttctgcaaactgctgcaggcacagccaatacagtagccagatgtctgcctgtatggggctgtgcatggcaactatgccccactggcagcataacctctgtgcccaggcttgtgtaaggtcaggatccctccccacctctgcatgactctgcagtactgttgccatagaaagcaggagagcctgagagctgcatgtctgggctgtgtgtgggaaccctgtactgtacctaccaacaacaccagcatacacctgttggaacccagagggtcatctcaccactgctactgccatcactcataccgcagcacctgcttagggatctgagaacacaatcaccaacctggaccaccgctaccactacctgcatgcaagcaagccatatgaagacccaaaatctgccctggagcccaagatcaggcatgctcggcccaccattgccactatgaagaccgaaagacttacctacctgacacctttatcaccaggaaaaattcaccacagcctccactaataactgtaccctaaaccaccaagaaaacaatggataccactgacgctgtttacagctgaagaaatcatacagagactatgctaccacatgcacccagaataaaagcctaagggcccttcccaaccaacgccactaatgtgtcttcaggaaacattcctcccctatgaaagcaaattcaaaaagttggaaaaaaacaactattacgacagatatacagatatcaatgtaagaatgcaggaagcatgaaaaagcaaggaaatacaacaccttcaaaggaaaacagtaattccctagcaaactatctcaatcaaaaggaaattcacaaaattctgaaaacacaattcaaaattgtgaaactaaagcagctcagtgaaagacaaaaaaattacaaacaaataatagaaggaagtcagaaaaacaatttgggatataaatgagaaacgtatgaatgatacagatatcataaaaatgaaccagacaagaattctggaattgaagaattccttgaatgaaatacaaaacacacttgaagtcgtcaataacagactacaccaagctgaagagagaatctcagaaattgaagaccagtcctttaaaatgattcaatcagaattttaaaaaaaaagaagaaacagagcagacatgatatatgagataccaaaaagtgaccaaatatatgaattatcagtacacctaaggtgaggaggaaagaaagtgattcaaaaacctacttaacaaaataatagataaaaacttctcaagtcttgagaaatatttagacaacaagatacagatggcccagggatccccaataagatacaatacaaaaagatattctccatggcacattatagtcaaactgtctaaagtgaatcacaaagaggaaattctaaaaccaccaaagaggaaagcatctaatcacttataaatgagcccacatcagactaacggtgaacttctcagcagaaactttatataccaagagggaatgggaagatatatttgaggtacaaaagcaggggaaaaagcataaccaataatattatttttcatatataaaaaaaaattgtctcacagacaagccaaacctagggaattcaaaaccactacaccactattgcaagaaatgctcaagggagtcttaaacctgaaagtgaaaggacagcagttaccacaatgaaaacacatgaagatataaaactcactgaaaaagcaaacataaaaataaaaaaaagactcaaattggtaccaccacagaaaatcagcaaaccacaaggacaacaacaaggacaataagcaaaaaagaaaggaataaagaatatacaaaacaggccaggcacagtggctcatgcctgtaatcccagcactttgggaggccaagctgggaggatcacgaggtcaggagatcgagatcgtcctggctaacacagtgaaaccccgtctttactaaaaatacaaaaaataagccgggcatgattgtagacgcctgtagtcccaaccactcgggaggctgaggcaagagaatggcctgaacctgggaggcggagcttgcagcgagccgagatcgcgccattgcactccagcctgggcgacagagcaagactccatctccaaaaaaaaaaaaaaaaaaaaaaaaagaatatacaaaacagccagaaaacaatgaacaattcgacaagaaaaaaaactcacatatcaataatatacctgaatgtaattaaattaaattctcatattaaaacatatagattgactgaatggatttttaaaaatgtgacctaactatatgcttcctacaagaaatgaatggatttgatttccttgtattttgttgaggtttttttctttcccatctatgttcatcaggaatgttggcctgtagttttctttttaggttatgtccatgtctggttttggtaacagagtaatgttggtcttgtacaatgcattagtgataattgccacctcttcagtttttaaaaatactttgggaagattggtattagttctctatacacctggtagaattccacagtgaacccatctgatcctgggcttttctttgatgaaagaatttctatttattttaagttctgagatacatgtgtaggatgtgcaggtatgttacataggtaaatgggtgccatggtggtttgctgcacctatcaacccatcacctaggtattaagtttagcatgcattagctatttttcctgatgctctccctcccctaatgccccccacagaccccagtgtgtgttgttcccttccctatgtccatgtgttctccttgtttagttcccaatcataagtgagaatgtgcggtgtttggttttttgttcctgtgttagtttgctgaggttaatggtttccagctccacccacgtccctacaaaggacatgatctcactcctttttatggctgcatcatattccatggtatatatgtaccacattttctttatccagcctatcattgatgggcatttgggttgattccatgtctttgctattgtgctgcaatgaacatacatgtgcatgaatctttataatagaatgatttttatccctttggtatataccctgtaatgggattactgggtcaaatggtatttctggttctaggtctttgaggaattgccactctgtcttccagaatggttgaactaatttacattcccaccaatagtgtaaaaatgactccacagcctcaccagcagctcttagtttttgatttttgtttgtttcttttgagattaagtctccatctcattctttttcttaagagtttctctaactaatggatgttgaattttcacaagtgctttattggtacctgttgctttattttaaaaagttattttaaaatcattcagaaaatggcatatatatataggcagaagagagactagggcagaaaccctagtttgtgtgtttgtgtgtgtatgtgtgtgtgtacagacatatgtgtgtgtgtgtgtgtgtgtgtgtgtttgagagtgtgggtgtgtttgtatgtatgtattatccagatagacaggtaacagtcctttggttattatctctcttctgcgtctgtgtgtgtgtgtgtgtgcacacgcatgtattagatagatagatagatagatagatagatgataacagtcctttggtaccctgcataaagcaaaaactttatctttttgattttccacaagatttatgtttttaaattttttccaatttttattttaggttcaggggcacatgtgcaggtttgttacatgggtaaattgcatgtcatggggatttacatagtacccaatatatagttttagtttttcagtcctcactctactatcaccctccaccctccagtaggccacagtgtctattgttcctttctttgagcccatgtgtaatcactgtttagctcccacttataagacagaacatgcagtatttggttttctgttcctgagttaattggctcaggataatggcctccagttgctccaactatgttgctgcaaaggacatgatttcattagttttatggctgtgtagtattccatggtgtatatgtaccacactttatttatccagtccactgttgatggggatgtaggttgattccatttctttgctattgtgaatagtgttgcaatgaacatagacacctatatgtctttatggtagaaagcctcatattcctttcagtatatacccagtaatgggatttctgggtttaatggtagctctgttctaagctctttgagaaatctagaaactgctttccacagtgggtaaactaatctacactgcaatcagcaatggataagcgttccctttctccataaccttgcctctggttgttgttgttgttgtttgtttttgagacagaatctcgctctgttgcccaggctggagtgcaatggcacgatctcggctcactgcaacctccatctcctgggttcaagcgattctcctgcctcagcttcctaactgggattacaggcacgtgccaccacacctggctaatttttgtatttttagtagagacggggtttcaccatgttggtcaggctggtctggaactcctgacctcgtgatccgccaacctcagcctcccaaagtgctgggattacaagcgtgagccaccgcgcccggcctgtttttgtctgtttgtttgtttttttaacttttcattaatggccattctgactggtgtgaggtggtatctccttgtgtgtttgatttgcatttctctaatgattagtaatgttgagcatcttttcatatgcttgttggccatgtgcatgtcttcttttgagaagtgtcttttcatgtcctttgcgtattttttaatggggttgtttgtttttgctcattaatttatttaagtttcttacacaatctggatattagacctttgtcagatgcataatttgtaaatattttctcccattctgtaggttgtctgtttactccgttgatagtttcttttgctgtgtagaagttctttagttagatgtcacttgccaatttttgtttttgttgcaattgcttttggagtttttgtcatgaagtctttgccagggcttacgtacatgattgcatttcctaggttttcttccagggtttttacagttttacattttacatttaagtccttaatccatcttgagttgatttttgtatatttgaaatttgttaaagtctagtttataattttttttcaattatgattcatgtttttggtgtcctaagaaatcactgttcatccaaatgttgtgaagattttctttgttttcatgtagaaacaattactttttacaattgttttattttctcctgtgtatgagcttggaaagtatatattcattattcttattttagtaatacactaaaaattactatatacatccttgatttgttaacatataaatttgtaattttaaaactttcttcactttagaattgagaactttaaaccatattaacacaatacacactttccaaaattaagcagtattattgatgcaattctagttttataaataatctaaataagagcattactgttttctaggtctatattcatctagacttttcccaaacttttatcctatatattgaacttcattaactgctacatctttgttctttgtttctccttgagaaaaaatttttatatactttccttagtgctgtactgctgaaattcaattaatcaatttttgttgcgcagaaattactttctactttttaaagagaacttcactggatatgaacctaggttggcaattattttgttgcagcactttgaaatatgtttctattcttcttgtttccaatttgatcttttaaggtaacacgtctcccttgcctcttgctgcatttgagattctgcacattcaagatggttttactaatttcacaaaaatatatctagatgtgattttcattgcattcattttacctggggttcttagagcttctaaaatatgtgaattgatgtattttctcttcaaatattgcttctgccctcgtctctctctctgtctttaggactccaattatctatatctatattagaatttcagacctatttactatgccccatatatctcttatgaacttttctgtattttctatcattttgtccccttattattcagagtaaatattttcttctgttacactatttctctcaaagagaaggacttccagaaagatagtttaaagagctcaccagatcctcttcctagcacaatccaccattatttggttaaaaaaaaaattattggtaaaaaaaagaaaaaataatgtattgtatctggaaactgtcctaagggccagggcaaacaaaaatgtatttattccattacctctcaccatatacaaaaatcaactcaatgtaagtctttaaatgtgagacatgactataaaaatactagaagaaaacctatgaaaaattcttctgggcgttggtctaagcaaagaaattataattaagatctcaaaagtacaagcaacaaaaacaaaacagacaaatgggacttaattaaattcaaaagcttctgggccaggcgcggtggctcatgcctgtaatcccagcactttgggaggctgaggcaggcaaatcacgaggtcaggagttcgagaccaacctgaccaacatggtgaaaccctgtctctactaaaaatacaaaaaattagccagaagtggtggcgctcacctgtaatccctgctactcaggaggctgaggcaggagaattgcttgaacctgagaggcagagattgtagtgagccgagattgtgccactgcactccagccttggcaacagagcgagactccgtctcaaaaaggcaaaaagaaacaaacaaaaaaaaacttctgcacagcaaaagaaaaaaatcaacagagtgaacagacaacctgctgaataggagaaaatatttgtaaactatacatctgactgataaacagaatttacaaggaactctaacatctcaacgaaataacaataataataataagttcattaaaaagtggacaaagaacaagaacaatcatttttcaaaagaagacatacatggccaacaagcatatgaaaaaatgcccaacatcactaatcatcagagaaatgcaaattaaaaccacaatgagatatcaccttacaccagtcagaatggttattattaaaacatcaaaaaatgccagatgttgatgaggttgtggaggaaaaggcaatgctggtacactgttgatggaaatgtaaattagtacaaccttatggattgtagtatggagatttcaaaaataactaaaaaatagaactactgttcaagccagcaatcacactactgagaatcaacatgaaagaaaagaaatgattatattaaaaagacacctgcacttgtatgtttattgcagcactattcacaatggcaaagataaggaatcagtgtacatgtccatcaatggatgaatggatttttgaaaatgtggtgtgtatacacacacacacaaaatggaatactattcagccataaaaacagggaaatcatgtcttttgcaacaacatggatgagactggggtccattatgattaagtgaaacaactcaaaaacagaaagtcaaatactgcgtgttctcatttatacgtggaaggtaaataatgagtacacatggacatagagtgtggaataatagatactggagacccacgtggaataatagatactggagacccagagggtgggagggaagtttgagatgagaagtttcttaatgggtacaatgtgtattattcccatgatggcaacacaaaaaaaaaacccagacttcaccattatgcaatatatccatgtaagaaaactacacttataccccttaaatttgtatacattttttaaagaaatacttatttaagacaatctattaaaaatcttgataagaataatcagtatctatggcatctgagtcacaagctattcccatcctgtcccctcccaactcagttgtctgaatctccactctagacaggcatagtcaaaaagacacagtttcctctcacccttgctctcagtatagggctacagattcacccacagagcggcaggcccctagcttggtattgcggaggctccattccaggaagacagagctaaaagactggggcttccttcccccaatcagccccaacttgtagagcagaaggtgtggcaggccaagaatgggagacccaattacccatactccaattcactcaaacagtgaatgttctacaacagaagaggcaagctgagatgatcaggggctaccatgcccagccagcaccctacttcctaagtaggggtatcattctggcaggaagcagactatagtctctaccaaaagctccactacagttgtgcaagatcgtgctgagagggagaggccttatgaacagagagttcaaaagctttacctaaggagactgactttatctggaacaaggcatgaggaaattgacggctaaggacgctgtcaaaaacaatggagatctggagagtgatcagctaagagaatcgtaattttgtaagactggtagcaacaagtaaaacagtggatcagctaacaaaaaaatcaaacaaagagacggctaagagccctcttgggagtctgagaatgccccaaagattggcaaaaccctaatcctgctaagaggtcaactttaattaagttagactatggcacaatgtatgtgctacgttattgtttaaaaaaaaaaaaaaaggaacaactaggtagcaatcagtgaattagcagaggctaaaaattgagtgagatatcaacagaattagaccaaccaaagcttaatgagatcagggaactagacaatcaaagagaacccagttaaagctatagttatcccagacagcaatagagactacacacatgatggagaagtgacatcagtggctacacactgcagggaaaataggtttcactgaactattccagccaattcactaaactactaaaaaaaacccaagacagaaaaacccaaaaggtagagaacgaatcagtattcaaagttaatacaaaaattatctaaaatgtctaatctcaaaaaaagttacaagacatgcaaggaaataggaaagtgtgacttatacaaatgaaaaagaggatacaatataaaacagcctttgaatgggcctacatgtcaaacgtaggagacaacgatttcaaatcagctagtaaaaatatgttcaaaaaactaaagaaaaacatttttttaaaatgtaagataatgtctcatctaatagcaatatcagtaaagagatggaaattatttttgaaaaacaaaaattctggaattgaaatgtataataactataataaaaagcttacttgaggccgggcgcagtggctcacacctgtaatcccagtactttgggaggccaaggcagacggatcacgaggtcaggagatcaaggccatcctggccaacgtgatgaaaccccatctctactaaaatacaaaaaattagccaggtgtggtggcacgcgcctgtagtcctggctactcgggaggctgagacaggggaatcacttgaacctgggaggcggaggttgcagtgagtggagatcgcgcaactacactccagcctggtgacagagaagaaaaaaaaaaaaagaaagaaaaactcacttgaaagccccaaaagtgaaatttgagttggcagaagaaagaatccacaaacttgaagattatcgatagatatgatgcaatctgatgaagagagagataaaagaataaaggtaaacaccaactcagagaaatgactagaaatgactcagatatgtaaaggtaagaacaggctaagtgcagtggtgtgatcacagcccactgcggcctcaacctcttgggctcaagtgatcctctcacctcagcctcctgagtagctgggactacaggcatgtaccactatgcctggctaaattttgcttttacatagagacagggtcttactatgttgcccaggttggtcttgaactcctggactcaagcgatcctcccacctccacctcccaaagtggtaggattacaggcacaagccaccgtgcccagtctactaaattcttatatccagcaaaactatcctttaaaaataaagctgaaataaagacatgcacagatcaacaaaaactcagagaatctgttgctagtagattagccttacaaggaataccaaaagaagttcttcaggcaaaaagcaattgctacgcaatcatatttcaacacagccctgtgactccaatccctggccacagatggctagaccagtggattaataactgaaccaaagacagccatctagaggtagctcaagtttacagtctttgcaactaacagtcttaatgatgacccaggtcatgtgtagtaaaatgtatgaaatttgctttctccctgaagcccagcagggaatcttccaagatagtttcttgcttcccttaaattaaacacccatctgagtgtctccattacttgcaacctagaaggaacaaacaaatatacctgaagaatgttatatgataataaacatgtgaaactacaaaaccactctttcagattttcaaccagaaaatatcaatttctatttaaagatatttcagctactttgtcttctgagtctttgcttttaaatatattattctgtccttgaaggacaggagccatccttttgcaataggaatggaagagccccaggcctatttcttaagatttagagttcccactgtcctaatcctaatttcaagtctcactatgattatgcctgtagttcaagatgctttaacaaagcaccacagactgggtggcttataaacaacaaaaatgtatttctcacagtcctggaagctggaaatcaaagatctgaatactatcttgcatggtcagattctggtgcagaccttctttgagctgcagaccgacaactttctttatatccccatatggaggaaaagcagcaagccagctctctggcatcttcctttttttttttttttttttttttttgagatggagtctcactctgtcacccaggctggagtgcagtggcgcaatctcggctcactgcaacctccgtctcccgggttcatgccattctcctgcctcagcctcccgagtagctgggactacaggtgcttgccaccacgcccggctaattttttgtaattttagtagagacggggtttcactgtgttagccaggatggtttcgatctcctgacattgtgatccgcccacctcggcctcccaaagtgctgggattacaggcgtgagccactgcacccagcctctctggcctcttcttataagggcactaatctcattcatgaagacagcctcatgaccttattacctccccaagtccctacctctaaatgtcattactttggggattagatttgaaattttgaattttggcggaacacaatattcagtctataatactgtccatccatgccgaaagggcctggttgttctaggaaaaccaacatttcagtgctgagtgtgagttcaatgactgtcactttattgagagcaaggattgtgtggatttgtgtactcctagaacctagcaccaaactcaattcttaacaggccttaaatcaaaatgtattcagtaaaatactgaataatttttttcattgccaagtagaagataggaaaaacagaacataaaacctgaaaccaaactacatatgaaattatataatctaatcagacacaaagatggagacctcataaaatatttgagtaataattttaaaaatgtgtctactattctcttaaactctacctacataactatccagctcttaatttcaattatattttggatgtaggatttgtagttgattctttttataacttcctgacctctgtaagaatatatgatctaatttcacaatatattaacaataattattttgaagttgtttttgataactccaatatctgaagagtctatatgcctattgacatttcttgttttttctcgtgccttttggtagaatggatttgtttcctgatatgccagttagtttgattgaatgctagacactgtatatgacaaattatagaaatcatacaaacctctgaatgatcatatcttcctccctaaaacatttacttttgtcttgatgggaagttaggacaggggcagacccaaagctatgttacaatgctacagtctttgtgagtagagaaagtgtattttgagttcatttagactcctaggggcttagtcctctgagcatcccaatcgtgaaatctttaccagagctcttcctcttcagtgggcctttaagctctgcttatgaatcagaaaacatttcaggagaaaagtagtggcaaatgtcagaattgccattctgaacttgcctccgcaacaaaatacttgaaccctcctgtccttgctgcctagagatagctctctgaaaccttcaaatatatttttaaaaacatgtcctagccagcttttctaaattgtaccagtataaggtttacactacagaacactagtccatcactcacaaaagcagaaactgtttctcttcctttaatgagaattgccacaagtttgccaaatttattaatcttctctaaggaagagcaaaatacaatctaacattttatcattataggttcccacaaaataatatattctatgatacaaacacattcttcacccaagtaaagtactagaaattaaacacatttaatgtgcttgaaaaaaatcttcctaatgttgaccattgtttatattagtcatatgttatgtattaggaactaaaagaatgttttctcagtgcatatgaataagttagctttactttttacaaagataatttgtactatttgaacattttgaagagcataatagacctgttgaattttgttactgtttaaggctgagtgcaatctcatttccttatgcccttagagagaactacctgaaagcaaatatctaaaaaacaatttaatttgctacttaaaatgatatgctatcaagttgaaatcactctaaagataaggaaactaaaaagactacaggaataatgtatgaacagttaaaattggctcattataaagaataccaaccctctttcaatggtatttcaggtagacaagcattgaataactcttaattacttactcaaggaacattaccgcatttgtttagtgccacccttttttccatagcaagtcctcaaataagtattcccaaagctgtattttatcttccaaattgctttaaattttcaatagatccatagataataaaaagttatcaatacttcatattttctgaggaactgaagttatatgtcacacacatacacacatacacacacacacacacacacacacacacacacacacacacacatgcacacaaagctaagaatcacaaggccccatttaattttttttttttaagagatgaagtcttgctcttccacccagactggagtgaagtggtgtgaacatggctcactgcagcctcggcctcccagactccagtgattctcccgtctcagccccctgtaatactccattctcccactgcagataaagacatacctgagactgcgcaatttacaaaagaaagaggtttaaaggacttacagttccacatggctgggaaagcctcacaatcatggcggaaggtgacaggcacgcagacaagagaaaggagcttgtgcagggaaactctgctttacaaaaccatcagatctcatgagacttattcatgatcatgagacaagcacaggaaagacctgcccccgtgattcaaataccttccaccaggtccctcccacaacacatggggatccaagatgagatctgggtggggacagagccaaaccatatcattccgcccctggcccctccaaatctcatgtcctcacatttcaaaaccaatcatgccttcccaacagtccactcaaaagtccatactccaaagtttcatctgagacaaggcaagtctcttccgcccataagcccgtaaaagcaaaagcaagttagttacttcctagatacaatgggggtacaggcattgagtaaatacagccattccaaatgaaagaaattggccaaaacaaaggggctactggccccatgcaagtccaaaatccaacagggaagtcaaatcttaacacttcaaaatgggagcagtgtgaagaagaggcgagaacgaacccctaaccaaccaaagcccgtgcaccactgcatcccgcgtccaccacctacatcctgccgccaccatgcccaagagaaaggctgaaggggatgctaaaggagataaagccaaggtgaaggacgaatcacacagaagatccatgaggttgtcagctaaacctgctcctccaaagccagaacccaagcgtaaaaaggcccctgcaaagaagggagagaaagtacccaaagggaaaaagggaaaagctgatgctggcaaggaggggaatagccctgtagaaaatggagatgccaaaacagaccaggcacataaaactgaaggtgctggagacgccaagtgaagtgtgtgcatttttgataactgtgtaaacttctgttgactgcacagtttgaaatactattttttatcaagttttataaaactgcataattttacttttttttaagctatgttgttagcacacagaacacttcattgttgtttttgggggaaggggcatacgtcactaacagaatgtctccaaagctggactgatgtggggaaaacacctttcccttctggttttgagagacttcctcttggctcccaggaggagggattccctgacgttgacacacatggccaccttggcacaaaagccttgtgctatggaaaaacaaattcatttctatgtcctcttctccctttccatctttcagcaaagacttaactcccttaaacccagaccactactgggacctgacccctagtcattggttaccaatgtgtcaggcaatctggactttccagtgatgccactgagatggcacctgtcaaaagagcagtggttccatttcgagattgcggatcttcagataaattctgccactttcatttcacttcctgaaagtcagggtcggcttgtgaaaagttgttaaacaacatgctaaatgtgaaatgtcaaccctcactctaaactttccctgttcagagcatcagatgaagacttcattgggttttacagtggctttctgatttttggcagtccactgaagaagggaatttgaaagttgttgtatactgttaacgactgtctgcccatgtcctgcctgaaataccatgattgtttatggaaagtatctttaataaagctggatacagtttggcttgggaaaaaaaaaaaaactccaaaatgatctcctttgattccatgtctcacaaccaggtcatgctgatgcaagaggtgggctcccaccgccctgcacagcttccacccctgtggctttgcagggtagagctcccctcacggctgctttcacggactggcactgagtgtctgaggcttttccaggtacacagtgcaagctgttcatggatctaccatgctgggatctggaggaagtggtcctcttctcacagttccactgggcagtgccccagtagggacaatgtgcggggattccaaccccacatttcccttccacattgccctagcagaggttctccatgatggccctgcctctgcagcaagcttctgcctaggcatccaggcatttgcatacatcctctgaaatctaggtggaggttcccaaacctcaattcttgacttctgtgcacccgtacactcaaaaccacatggaagctgccaaggcctggggcttgcaccctctaaagccacagcctgagctctacattggcccctttcagccacggctggagcagctgggatgcagggcaccaagcccctaggctgcacaccacatggggaccctgggcccggatcatgaaaccactttttcctcctaggccactgggcttgtgatgggaggggctactgcaaaagtctctgacatgccctggagacattttccccactgttttggggtttaacatttggctcctcaatacttatgcaaatttctgcagccagcttgaatttctcctcagaaaaatgggattttctttccttttgcattgtcaggctgcaaattctccatacttttatgctctacttcccttataaaactgaatgcctttaacagcacccaagtcacctcttgaatgctttgctgcttaaaaatttattctgaacagatatcctaaaacatctctctccagttcaaaattccacaaatctcaagtggaggagcaatataccacctgtctctttgctaaaacttaacaagagtcacctttgctccagttcccaacaagttgctcatttccatctgggaccacctcaccctggactttattgtccataatgctatcagcattttgggcaaagccattcaacaagtctatagaaagttccaaacgttcccacattttcatgtattcttttgagtcttccaaactattccaacccctgcctgttacccagttccaaagttgcctcaacatttttgtgtatctatagcagctctccactcctggtaccaatttgctgtattattctgttttcatgttgctgataaagacacacccgagactgggcaatttacaaaagaaagaagtttaatggacttacaggttcacgtggctgggggagcttcagagtcatcgcggaaggtgaaaggcatgtcttacatggtggcagataagagaagagagcttgtgcagggaaactgctttataaaaccatcagatctcatgagacttattcactatcataagaacagtacaggaaagacctgcccccatgattcaataattacctccaaccgggtccctcccacaacggtggggattcaagatgagatttcggtggggacacagccaaaccatatcaccccccaagtaattggtattagaggcacatgctaccacacccagctattttttgtacttttttgtagatatggggtttcactatgttgcctaggctggtcttgaacttctaagctcaggcaatcctccagccttagcctcacaaagtgctgggattacaggcgtgagccatcatgcccagccctatttaatttatatgtaaaaaacatgaggcagaaattattacggtttcagaaaacgaagaaacttgaaaatagatattttatttctaaactgttttactgaccacattcaaatgacaaactaatgtattagcaataaatacaaactattagtaattagtaataaatacaaactaattagtaattagtaataaatacaagctaatgtattagtaatacattcaagaaaaaattaaaatattcagtccacttctgctttctgcaactcagagagttaaagaaaacagaaaaaccacctttcctcataactcccaaaattcattttttcatacagatgaaagatctgagaattaaaccaagtcttctaataggtataaaggcttatttagttatagggattttacttgcagaacatctcagccaggcatggtggctcactcctgtaatcccagcactttggaaggccaagacgggcggatcatgaggtcaggagttcgagaccagcctcgccaacatggtgaaaccccgtctctactaaaaatacaaaaattagccaggcctggtggcacacgcctgtaatcccagctactcaggatgctgaagcaggagaatcacttgaacccaggaggcggaggttgcagtgagccgagatcgcaccactgcactccaccctgggtgacagagcgagattctgtctcaaaaaaaaaaaaaaaaaaaaacagctctgccaatagtcatctttgtgaaaaatacagaagtatagggcattcagtaatgtgcccacaaaccagagtaaatttggttaataacagaagcagacctcatttccactagataccataactttattaatagcttctctctacaaagttgtggccaatgtttgttttctttataatctaatctaggtattaaaaattacttgctattcaggtaatagcatattttacaatatgcacttagataaggaagaaattaagattttagaaatgaagttgaacatgaaattacaaccagcataattaaggtctctaagacctttggtctccaaaaagggtttaatctcattattaaaagtaatattaaagcgggcatacagtaaaatggtcagctttatgaaacaaatgcatgaatcaagagtttatggtaaaagaaacaaccttccttctatttgtattgtactaatcataaaaataagctattattgattatcctttcttttttataccatcctcttttaaaaaaaaattaaaatctcccattatagtcccaagtttctgctaatgaattatcatgtcagttgtcactcaattatcactttcaacatttaatctaaattatgttcagcatcttgttttttcctttctttgaagttctttcttgaatttaaaagtcaaattttttttcaagaagagtaagttgacggaagatggaggcaaagattaaatcaggggaaataactgatcaaggatgcttagaattcttatgaatacaaataggctatcaaggttaatgaggttcaacttgagtttacaagaagggaaaagtgtacttagtattttctatgcatatacagatttaagatcttaggtacaatttaaaaggtaaattatgcaaactcaaatgtagcttccttccattgtttttttaagagccatttttactgtttttctctaatgtaaaacaactgcttgaaatatatattctggatcaacaaaaactaatgcaattagtaagatatagcaaaggtccccttaaatactgacaaatcttccagaaatggatgtgcttttaagaaatgactagatagcaaatattagtttaaaaagaaaaaacataaattttttacaacatattatttcattcaacaaatactaattaagcacctagtataggtaagactgtgtgggaacacatagggacacagagataaaacttggttcttaacccatttataatctcaacaggaatagaagctttaaattcataagtggctcccagaatgccacaactctgaattataacatcagtgcatactagtaagtggcccagagcaaaatccgtgcacagcaacatatcaaaagaaaaattaaacataagactgagcatcagagcgaaagcatagaagattgctggaatgagaagagatgtcagttcaacacactccaggaataaagacatagaatctagctgaagtgtacagtatctctggttgtaaggactctgtaaaaagggaggtgggaggttgagaatttctactataattatgaacaaacaacccttaaggcatcattattctctgattctgtgttcattaagcaattttttggttactaattctaaagccagaagattaggagattggtgccctgcataagagaataatgttttcatatctgtatagggctcccacagggtaaatcagtgaagtggtactcttttgtatattaggttggtacaaaagtaatctcagtttttgcaattacttttgcattgacccacacctctctcttctgagtttcattgttaatatgagccagtctcctgggtcacacacagaaaactcaagtttccagatgtgaggacaagaccttgaaacatgatgtctccaccaatgtaagggcaccaaagttcactctgtcttggtgacagggcagctggctttttcctgagtctctttttctactttattttggcctactttgcttcttttttcttttttttttttttttttgagatggagtctcactctgtcgcccattctggagtgcagtggtgcgatctcggctcactgcaacctccgcccccaggttcaagcaattctcctgcctcagcctcccaagtagctaggattacaggcacctgccaccacacctggctaatttttgtacctttagtagagatgtggtttcaccatgttggccaggctggtttcgaactcctgacctcaagtgatccgcctgccttggcctcccaaagtgctgggattacaggcgtgagccactgtgcctggccccactttgaaatttttaacaaaacatacccagattacttcaagagagtgtgagaaagggggcataagaatattagtgatatggacaaaaggattattcagaaagaagaaggatcacttacagctgatttaatccaattccacttttacatgggggaaaaagtttaggatttccacaaaaagaaagaaaagacattcaaagttgttcacagaaacagtgaacaactggcacaaaggaaaaactgatggagctgagtagggaagtttaagaaaaaaggaattatttgacaagaccacatatgaggttctgtaggagaggtgtcagaaagtgaaggttaaaaagaaacacattaatgattgaataaatcataagaactgttactatatatatgttcttgggcctgaccaatgatctcattttgtgcatcttttttattcatatttggtctctgaaaagcaactaaagaagattaatctctcttttttaatagaatgtataaggcaacagctccatactacccaatattttctaaaaataaagcagagactaaatttcaagaaaattctcaattgttagaggttacaatcgagtaatctatgacctaatatctcacaaagtctgcacgaaacatgactttgagaacagcttgggaacaaagatattcaaatggcctccaaaaggtgccataagaacattagtgatacagacaataaacttgttctaacttaatagttcttttatgaaaaataaaggaaaatcagacgtgtcactaaatcagaaacagctgcaaatttaattaactattttattgttcaaattaagaaaatcagaaaaaatgcaactagttaatgctaatgtcttacagggataaacattgtctttgtgatgtcctttgcaatggcaactggaaaaaaaaatttcattctcaaaaagaaatttattcttagaagcaagacaaactcaaagaactttctgcatcaactttatttttatttacttattttttagagacagagtcttactatgttgcctaggctggagtgcagtggcacaatcacagctcgctgcagccttgaactcctggctcaagcaatcctttcacctcatcctcttgagtagccgagactacaggcacaagccactgctcccagcctgcatcaattttagatccactgtgagaaacaaggaatcggctgcatttgtgttctttgctatgttgccagcacttagaacagtgtctggcatgtaacaggcagtcaataatatttgctgtgttgtaaaaacctttcctccaattgtttttcacacccaaactctatacaaccaaaccaaactaacccaagaggactcaaattcttcccctaacccataagaaattgtaaaataactactaagttaggacaaggggaaagccaggaatcttgaataagagcattattaggctattacaaataatttttttagtgctcacatatttgagatttttttccaatgtataccatgatggcaagtgaaaagaaacaatgtgaaggaaggaaagaagggagggaggaccaatgtgtggttatgaacatagagcaaagggatttttctaccttttagatctatccaacatactttctttttaaatacgtgacttcagcaaaataatcatattttagcattttcatcagcaggatcaagggctaaaataatacccatgaagcaaactttaaaagttgtataattaccattgctctgagacaatttcaagtaagtctttattaaacatgtagagggctttgtaaagagtatgtcaatatttcattatctttacaatccaaatcttgaaccaaatttaaaagacattttctattgatgtgctgacaagatgaaagagaaacacagatgagtaacattaaatatttcctttgggttatataaaattaggtgcttttaacactaattttctacctttcattttaattttggaaatacttgaaattagaacacaacttcacttacaaaaacagatacagggaggattgatacatatctatttccaaatgtgtcatccatgtttaatctaatttgcataattgtaatttcaattaaaccatttccttttatgaggtcttttcctttgatttttaatatatactgataattacctcatctatgctagataaaagcaggaaatggtagctgcctagttatactccattcacggttaccatatcatccatgattgctacacaactctaaattaatggaggcattgcaattccacctcatgcagaacaactagaggtctgaaaacctttatggttccaaagaagaattattggtaacaccttttcactatgcattctgccagtttcacccgcaaaataaataataattcactgttctctcaaacaaaaaaggtcccttctgtctgtagaaagggttcaattgctattagaacaaaaatattttcaaatttaaaaatagtaaaggatttctctgtaaaataataaaggaaaatcatccaggttcctggctttggggtcctgaatgaaagagaaatgaacccataggaatttctacatataagtaaatcagtcattaatataactttatattatcaatgctcacactggagttcataaaataacacatctttatattaaaatttcattaagcaattccatgagataaaattaaaatatttcgaatatgacttaaaaagagcaaagtcacctctacttgtgatgccaaatgtgctttctccttgtcttttctctccatgcaccgtttcacttcctctaactcagatgccattgcgctgaagttcagctgcactctcaaatctgacatttgcttctccaggtcctgtttttcccgctcaaccccttaaaagataaaatgtaaggctcaagggttgttctttattcacagaagaatgtactttcaaatagtactgagccctgatgtttcaatattctagctatcataatccatttattgacagttactcaacagactttgccagcctgttgtttcaagttttatagctttcaaaaacatatacattgctatatcatcaaatattattccagtttgatactaaaacttaaaatgttacctgatttctactgcaatttatttcaagaaaatcacacacatttttaaattttcctcacatctctacactatctccaaacagtaaaaaaaaaaaaaaaatacaaaaagagttttcaactaagctacttcatctacaaaatattttttttgcaacataaacaacaaatgatgctattaaatctctgattgtgtatgaccaaccaatttactaatccttactcatctggagattattacctgaaattaatatatcatttaacaatataaattgacttagtatttaaatcaacatgaaatacttgacctgtgctacacaggggactataataccttcttctaatataaggacaaataacaaaacttcatcctcaatgagcttacatcctgatgtggtttggctctgccccactcaaatctcatcttgaattgtagctcccgtaattcccacatgttgtgggagggaccaagtgggaggtaattgaatcatgggggcagctctttccatgctgttctcatgatagtgaataagtcccatgagatctgatggttttataaaggagagttcccctacacaagctctattccctgccaccacgtaagacatgcctttgcttttcctttgccttccatcatgattgtgaggcctctccagccacgtggaactgtgagtccattaaacctctttcctttataaattacccagtctcaagtatgtctttattagcagtgtgagaacagaataatacacatcccaagaatagagacaaaatataaagtactctatggagtctaaaatgtcaacaactggaacatatactgtctgtcattttaaaactactgtctttctagtggtttcctttccagaaaaaaaaaaggaggcaatgaaagaagaaaacactaacaaattaaatttatacatcattcataaaatacattcccacttcagaatattagtgttcaaaattgtacatattagaatggaagacatatgggcatttcaataggatgataagagcgctgatacatacatgtggattatacagaaacagtacaaacagtaaaagggattagctctgtctcagtgaggaactaaagtaggaagaactgagaactaagtcagacttaaagaatgaatacaaaatttcaccaagcaaaggagaaggagttggggtgtttttagggaaagcacataccataaagcatacaggtacaaaactgaatttaacattcaggtaattgcacacacagaagtttcaagtagctaatacatctcatatgttacaagggtgggaggagggagtgtcaacagagtttatgtgttgctaggaaacttagaagaatttatcctacaaaccaagcatcagcaaacattttctataaaggatcagataataaatatcttagctatatgatttctgtcataactactcaattcaaccactgtattgcaaaagtagcctagacattgcataaatgaatgggagtagctgtgttccaataaagtctatttacaaaaacaggtggcagtctggatttggcccatgagccctactttccctacttctgataggtaaccaacctgaaaatgtacatatttatctatttgtaaatgtatttgtttattttataaatatatgtattttattttatatgtgtatatttgtgtgcatataacatgtctcaataatatgtatatattgatacgtttcttgatatatacacatggatgtaacattagaatgaatatatattatataaaatatgaaggcatgtatgtatacatatatgtatactttatgaaacatatatatttgatatggagatatattttggtatgtttacatatatatatactagtaaagataaatatacacacacatctatacatacatacacatgtagtatatgtaatgaaacatttcccaaaaaagttaaaatatttaaaacaaaaagtataaaatataaacagcattacaaacgctccattttggagaatgcttggtcagtataggatagcagttaagatctcaaatttggggaaaaaaaaaaattggagtctgctacttccctcatgtgtgatcttgggcaagtaactcaacctctttattcttgggtcctttttataatcattaatatagaaataagaaataagaatagtgccctttagtaatagaaaagaaaatagattacagagaagccagaataggtaagacaagagagtactacatgtcctatactgaccaaagcatgcttaagccggggcagtgggaataagaaagagaatgttgcaaattcaggagatatcaggatgtataaataggcatgaggtagaaactaattatatggaggagagaataaataatttctatgttctttgcattttaggcttggatgtctggatggaggatgatgccacacactgagacaggaaagaaaaacatgttttgaggagacgatgaattcagctgtgtatcaacatgcattctgaggaacagcatatggagatatccaatgagcaactccatttggagggccaatggttaggagagcaaatagagctagatttaggaattatcacctctaggtgataatttttaatcaattcccaggcagacatactaagtaacaaaagccatgagtaggatagtaggcaaaaccaacatttagaagacaaactgtgaacacagcaaaaagattcaaatacaaagaatgtaaataactaagacagaagaattaggaaaggcaagaggcatagaagtcacaggaagagtttcaagaaggaagaagaaataagcaggtaacactaaaataagtaatgcaacgacatccttggaattgacagaattgctagcaaattggaattgctagcaaatcatgcaaagtcaattttacaaatacaggtggaacccattttgcagtgggcagaggaagaaataccagctgaaaatatgataagtatgatttctaatgtagaactgtctttaaataatctaagtattctgtaaagatgaaaaactctacaattgttaaacggtgaagaagtccattatcacatatataaaaaaacttccaaaatttttttcatacctgataagtagctaagaaaagctcaatatttttagtcctcaaagacttacaacagaaataattacattttatgaggtatcaaaacataaaaaatgtgttggtctttgttccaacaattcctgtgtgcatctttatgaagtttgatgaagaagctaacagcttaggattgtttaaaaacaagtgatattctgggtcaaatgatacttaaattatatcacatgaaacttaatgaaacttaatggcatacaaataaaaatatgctaaggcttggatatagtttatttgtcctcaccaaatctcatggtgacattttatccccactatggctgttaggagatggggcctactgggaggtgtttgggtcacgtagacaggtccctcatgaacggcttggtgtccttcttgtagcaggagtgagttcttgctctcctgaggctggactggttctcaagggaactgattagttcagacaagagtgggttgtcagaacgccaggacatcccttgaatttggtccccctttacacatccccactccccatttgacctcttttgcattgtttggatggagcacaaaactcctccccagaattccagcagatgctagagccatgcttctggtacagcctacagaactgcgatctaaataaagcttttttctttgtaaactatccagcctcaggtattcctttagtgtaacacaaaacagactaagaaaatatattagaatagctttgtcaaaatttgtcatccattgaagattttctggcaatgtggaaattctagcttaggcaacatatggaggtgtatttggaaagcctggggcaatatttaccttccctgaatttaacagtacatccaacacttacaaaaatttcaccaatactttgagcatttgagtaggaagcctcattattgggataatacagaagctgagcaatgtgaactcacctaatagaaacaattatataatctcaatattatcattattaaacctgaatatacatccagtcattaaattccataatttaaattaacacctccactgagaaggtatcctaatatttttcaaacacaaagtattcctaaaccacataaaaagccagtgatacagctcatgaccactcctgagttgtgattaatttttgtcaccaactccagacgacaaaaaagatagggtactgactttaatttctcttatactgaaaattgagataagagaatgtgaaagacagagcaacatttacaatttaagtacaaagactggtacacacttacacatatgcacgtatatttgggcatgggaatcggaggctggaaaaactactgcttttgcaggctctttctaagagaaagccccatggttaagtaggtctaataacccaaatgggtttgaaccaagcagggaagatattaaaatgggatgatgctgaattattatcaacttatcagaaaatgtttaatagatcaagaaatagtatgacgtgagcatcacaaaggaatgcaattctgaggatgaaaagtattttctaagaaaaaccaaaaagcccccacacacattatcacattattaggtacaaatctacttttacctctcctaaatctccagtcctccccttgttcatcctgatagtttgactgttgcttggaaatctgagatacttgatgctgtaaaccctttcgatcaccttctgctttcgtaagttgtgtacgcagttcttctacctaacacatggtcaaaaatcaaacatcggttttcacaatcagagaaagacctacttcaaatgggctattgtaaacacaagttgaatccaggttaatctccttccaagcatagtggaacggtttcctgctccatttcctcattcctctcatctcttccacaaagaataaatgaatggcttttccttctctgtgtccactgaggcaaagaatggaatgtgactagattttttttttcatcacttattttgtcctcagtctactccattactattaacccaaatcaacttcaattaagtattatacttcttatatttttcaattttcacccatttgctttcatgtgaacatggtctattggttgttaaattcaagataaatgatcatgatttagcatattttgatactaaaatcatgctcaaaataagtatgtaatagatgctgttgaataaactctaaactccttgaagtcagaaactgatttgtttatctttctatccttagactgccaaattacctagcacatagcaggtacttccaaatgaacattaaacaagttaacagtggcaaaaagattcagctaaaatcacaatgacaatctaaacaaagaaatctcttgcttccataactgaaactggagattataagttagagttccaaacaaatcagaacggaattaaatacaaatataaacttccaaaaaggaaagtttgaactctgccaaaattaattccatgtgaccactggctgcagaacaaagtcagcgaatattttcaaaggttttgtaaaacaggtgctatcttgtattttcagcaccaattgtcagaatgtaatactccttctgaacatctataatgcttgacatctttgcttacccttagcatattctgaaggtgtgttatataacatacacttcaaaacagaagaaagtataattgcagtttgtattaaacacagacaggcagttagaaacccatatgcccttatccaatgtatgtaagatggttatttaaagttactgaactttaaacatcagaagcgccaaactcccattatgggctgatggaatgcaaaacgttatactttaaaattaagccttatcggccgggcgtggtggctcacacctataatcccagcactttgggaggccgaggtggggaatcacgaagtcaggagatcgagaacatcctggccaacatggtgaaaccccatctttcctaaaaaaacaaaacattagccaggtgtggtggcgcatgcctgtaatcccagctactgggaggctgaggcaggagaatcgcttgaacccgggaggctgaggttgtggtgagccaagattgcgccactgcactccagcctggcaacagagcgagactgcgtctcaaaaaaaataaaataaaattacccttatctttggtttaaaagggtcaagtagtatcttgaaaacatgaattaaagacaatgacgttattcaaagtaacctaaacatgcaaaggtctgctgcatgtagtttacttcttcctttacttcccagtgcctcctggaataaaattaagctcctgggaaaattttatcttatacattcagtcttacttttacactgctcatgctaagacagataagtagtaagttgtagcagcaatcagcaagatacaccatcacagtggggactctggctggtgtttgtactagctttctctgaatttccctgaaagaattttatcctttgcttaggtgtgctaatatacattccttaggaaaacattttttctagacctagttcttttttttcctttcacaaagacatttaaatagagctactcaatcctgatttaatgtaaaagtatattataataacttgcatagacttacctgatgcaaaagtgtttctcggctgccttctgattgattcaataaccttcgagatagctccaattcctgttcaagctagagtttcaacaaaggataaagaaaaatgcccaatggagcagaagataactaaattattatgggcacagtttaaaaggagaaaagtggaaaagttttcagaagacatttacagctaatataaaagaataaatatctcactatgaacatatatcaatacttccattaaaataatgtgaatcgtataacataaagtgaaccagaccaggcctcaggaagtctgggatctagtaagtttcatctcaactgtgagccagtccaagtctctcctcctctggcctccattctatcatctctaaaataagtattttatattaaacagtctccaagatcccttccagttctaaatctctttaatctaaattctaaggcaatttttttctttaaattagaatacacagtgtcaaattaactaaagtagaataaaaactgcagggacccaataactcaaaagtttcatctaattggtgatttcctacattcctaatatttctaatatttataagacattccttaaatttttagatgtctaaattcagaatgagacatttaaaatttccttaatgatactgccattagataaatatcgataaaaaatgtgaccagttcaggagatcaagaccatcctggctaacacggtgaaaccccatctctactaaaaatacaaaaaattagtcaggcatggtggcagacacccgtaatcccagctactcgggaggctgaggcagaagaatggcgtgaacctgggaggcagagcttgcagtgagccgaaatcgcgccactgcactccagcctgggcaacagagcgagactccgtctcaaaaaaatgtgaccagttaagtgactaaatattctacaaactcctaacatgcctagatgatttcaagttgaaatatgtaataggatagaacacaagtttcttaacaatttagagcttatatgtgctagacttgtttgcattctgtaacagtaagatagttttataaaaatcacacatttatattaagatgcttgtaagtgcttagatttgtaacacttatcctaaattatcatttcagttgaacaactgctatctgtatattaatcatttaataactgtacatgtggtaggtgtgcctatgaaagaacatgagggagccttgtggtgatagaacagttctgtatcctgacggtggtagtggtaacaagaatctatacaagataaaaatggactgaacttcacacaaacacacacacacacacacaaatacaaatgagttatatatataaagctggtgaaatctgtataaactaagtagattgtaccaacaccaatttcctggttttgatattgaatggcaattatgcaaaatgttaccattgaggcaaattgggtgcatgggacctctctgtgcatcttgttttacaatatcctataaatctataattatttcaaaatatatctttaaatcccaatatataattttttaaaaattatacatgtggctcataaaacaaatgtcatattaaaaaaaagtaaagtataagtggggatcacagaatccacataaaatactgtcctgttcttcagtctctatggagaaatagagtgaagaaatcatacttgaagcaaaatgactttgaactcaaccaaagcccatattgatcataatccctgtgtaatttcaacatcgcaactcccaaagggcaaatctgatggcctaacatacttcgcttaccctaaaagcagcagggaagctgcctttacatgagttggtgaaataaaataaaggaggcaatggtaggtagaaaaaagcaataatacggagtaaagaacagggcaaattttcacttcatcattcattactttgagctcatccttaaatctacttatttgcaaattaaggaagagttgtttggcctctgaattcctttctaactctaaagtgctaagctctacgtgttcatagaaatgaacacacagttcataaacatgaacatatgtcaaagatcattgatatttaatataaatagagaatgttttcagaactggctgcttactatatctgtccactataatgaaaatgaatataaccaaaatattcagtctccaaatgacaggtcttttctaaccctgcaacaaagtcaagttctttaaatgtttccaacaagaaaaagtaaagtttaattcacctctcagaaaggagaatggtcatagatgacaaggtagcaaacaacttgcttatctgttttcaagagcaagtcctagcaagtagaagagccgttgaaccaattgactccacatagaaagataaagaactcacaatgttctaaaggatcctggggacacttttcaaggcactcaacaaataccattggccccaaaccactttattctttgaaagataacttttaaaatcttacttgattcttctcagtttcagtttgtcttagcttattttttattgccccctcatgctcatctgctttagcttcttgtttctttagtgcctggaatgaaagaggtggaaaaaaattatcccaaaatatgtacaaaactgaaagtcactactagaatttattatgtattagggctgaagaagacatggatatgagttacacaaaatctataaattacagtctgctcataagaacacttcagtggggataaaatataaacaattcctgatcaccctaattaatattcactttgtttcctttttttccccatctttgggaattttactacattatttagagggcctagatagctaacagttttcttggaaacaaatattcttttctacagattcccctctttaataaaatgaggaaaaagaaagttaagaaaatacacatttcaaaagttaactataaaagtgtttgctttggtttgtttctatgttagaacaaaattaaacttaaaggggaaaattatacttggaactgtctttcataatatctgaaatgcattccatttgtttaaaaaatatttttaacaattttagtgtttagacttagcaaggtgtatgtgtaaagtccatacagcttgtgaaaagccaactgccagaagctttttccaacaagatcaacagaaaaacaatttttaggcaaacagcaaaatatgttaaaaactgctttgatgcaagtatactcaatcaatttcagctccctctgccataattcctactctcaaatagaaattgagtaaagaggcagagaggcatcaacaaaatgaaaaataattttgatttgagaataacaatattatcatgcttttatagtgtttagtatgtccaggcattcttcttcttacatataataaataaatatattacatatattcaaaatatacatttactcctcatgatgattctatgaattattattattccaagcccattttattaaaggggaaattggagcacaaggagttggatcatttgcctaacgtcactcacctacttagtgacagagacaggatatagattctggctgcctgcctcttaacaactgagggcactgcttcttcatattgaaataataataccaaacttatagggtagtggtgaaaactaaatggtttgatatctgtagagcacataaagcaatgtctggctcctagcaaatgtgcaataaaatgcaactattattattggtaataatagcctgggtaacagagtgagaccctcaaaaaaattaaattaaaaaaatccaaatttctatgtttaagttggttgaataaaagaaactctaattctcttggatacttagaaatttgctaaaataatattgtgctactcctttcttccttactttccccttagaacatctgataagttgtttataatattgattttccaaaataatgtacttttctattatagctctacttgctgcctaaaactttatttaagtctccttttttcaatttctccttttactgtaagtatatgtaagtcttaagaaatttttgtcaatgataacttaaattctattgttttcaataagaagcaatagtgagatactaaggaacaatccaaagcaaattactacatttccactatatcatctagaaatgccattgagtttgaacactagctctgctttctatataccatgagtcagtcaacaagtaaacacaaatgcaatattctagcctagaatattgaaccagtttttctacattacctagtttaaaatgaaagacaaagaaggaaaatctgacacttaagacccattaaatatatcaatgatgcacctgtaaacactgaaaacacagataatactcaaagagagatatttttaaatcaaccaaatcaaaatcacaagccatttctttaaaccttaataataaacgtgaactaatttactacctttttttaagggtgtaagcctgcactggatttcttttccatttgacttaaatcaagcaacttagacttatattaaaacggacccagtaaaagcagttataaaagaagaaaaaaaaatcacatgccaatgaatttcaataattatgttattttgtcctttaaagcttgtttgtctcctaagagcagtttagctaaaaactatcatgtgccctgctccaggatttagattgtcttttacacgttgaagatcacagcaacaacaatgagccttaatagagggtccccggggcacatttaaatctttaataacaacaatttttcttctttcccttaagtgtgtcatatcgtgtattgtactactgcatttccttagaggtaggtgattctaaactctcatagttatatataataaaaaaaaaggtagtttttcttttcagagagtagtaaaaaggggaaaagaaaaatgtttgtagacctctcacttaaccataaaaatctctacaacattgacaacaagcatgtttatcaagaggctctaacagataacacactccaagatgtagaacaaatagggaattaaaggccctttgtctgctttaaatggaccagcaagcttggttaagaatgatggcatgggaatgaaataaaaatcacatgttaattcccacacagtccaatgaaatttccggagaaaaattataaacataacctatcccaagttctcctaatcactcagcagtgctacagttgcacacctttggtcacaagggcaagaacatgtagatcattcactgataaactaacaacactatagaaaaacaagtctgtgctcatattaaacagtcagcatcatttacttgaaggtacaaactatcaaatcagattttttttccagtaacaataaagaatgaaaaagttatatcactgaaaactagaaaatagttgttcttactatattttgtaattaaattcttcacatgggtagaaaataaaagccagtgaaaaaatattttaagcttaacagaatatgatgtgattccaatccaaagtagactacacgagctataaattgaagttacaagttgtttatatttatgtatattaaaaatttgaggtagctttagggacattttcaatcaagcaaaaactcaatattaagtactgagtatgtataaaacactatcatggaaactttaattaaaatttttttaagatggaaatctgatgtctatctctaaaattctttttggacgcttaaacacagctccaaagccatcaaacatcaataaaataatacatatttttaaaaggactctatgcataatacagcaggattttattgctcagaacatgtactactcatttatattaacacatactttttttgtcatgttctttgaatttctaaattatgctttttctcaaatcaaattagagattcctcccccatgagaactagctaaagtaatggaaaattttagcctttaagttcatccagttgaggattatctgtgccaacaaaaaccaaaacaaaaaaaaattaagtttcttttcaaggcaaaaaaaaacaaaacaacgcattcacattctaaatccctgaaccaatatctaatttaaaaatagctaggtgggtattacttaaattgttcaaagaaatttatttttcagccatgaccaaggaaaggaaattctataccaacaactacaacttaaaaaataaaaaataaaacaaaccgcacacaccacacactttggtaggtgaaaagtagaaatgcttgataaaagtccaaaaggaattcaatattgatactattatgataccatacatacttgagggatatcaaagtaagggagaaattcaaaaaacttggtatgaattgaaatgtgtgtattttcccgatggaaatggtaagcacataagtcaagtcacaaaatacaacaattcctctttttcaaaaggtaatatccaatatcacgtagttaagtaggattgatcatatgttaaatactatttctaatagtaacagtaatccttaataacattccttaaagatatctatggtatttaaacataaagctcaaggttttattttaagaatggcctagatgtgttttttgtttttttcatttttctcttcttataagatgtttattatttcaagaatcccaagaatccacaagggctcttataggaattatcttggtggaagagatggatgctttttctgacctattttctccaatgaacaaacttcttggttccactatgcccatacctacggaatccaccactgtttagggcatccagtgccaatgaacccaaacaaggtcatgagtttaatcaccaattccctttgctctgtttcgtggacacaatctttaccctaaacctagccaagggcctcacagaaggctaactagaccagagactatgaatgaatcagcaaaaattcaataccatgactacaaaaataactcaaaggtaaacccctgttgacaagtgtcaggatttcattcttcaaatgttataaatttgccaatctgcaaaacaaaaccttaattacttcatgaaaaagccagtatgctaaaaagacatacaagtcttttaacttctttaattcaaaagcaacaatggtaatgagtattattccctaacatgccattgcttttactggaacagattatatttttatgcaatcttttacttaataaaatcttgcaagtaaagttaaatgtgagcccaacaagtgcactttccaggatttccttcaaaatcaaaaaacaaatgctcctagtagaaggtctgtttttatccgagtagtttcctctcaaaaagagatgcatagttttattagaaatccagagtaatataatacttcatttgactttctaaatgcagggccactgagttaggattgttgacaaatagaagatcatagataattatggaaatttaatttagaatttctcaagttgtatatctttgaacagaaagctctgtaaatatacaacatcttccagtgtccagagttaaaggatgttattttatgcctttgggtttagaagggttttttttgtttttcactattttctaataaaaataaaacagtactaagccaatgaataagtctatctgtagcaaaacggtttttgtttgtacaatattactatgcactcagtagttgcccaataaatattaattgataatgatggaaatgggctttataaacagatggcctagcataaattcactgaaaacatagatagaaacattccactcttcaagaaaagcgtaacatagaaattgaacaaatcctgcacacagaaaatctcagtctattgtcaggcagctgttcagtcaacaggggcagcagacatttttcatcatcgtcatagcattaacggcattaaatgtctatttgcatatggtgctgcacaaagtgactcacacagattcacgctagccttatttgttataatttacaatgacaatattggcaagaacatataagtacacatagcaaagtaaaagtgattaaacataatttgagatctagtaatatttggcatgaacataaaatatgtgtcaggcttaaacacaactcacagtagcaatcagagtatttatttaacatataaacttctactattccccaatagcattacagatgctttacaagacgcttacacatatgctgaaggattaagtagaataaagagagaagtcagagtccctaaaagaataagtaatgactcttcaagaacctagaaagtgaatataatctcaatagttaccagtggggaaagaagagataaaagaagaacaaaagtcatatgggcactagctcacggttagtaggatggtaagatcaaggaagctataagcaaattgatcaaccccggaaggcatcctgaaaaacacacactttacaaaaatacttaaataagaaagtgtaagataacatacatggtagaattttggagaaagacagttaaaatgaggaactgaatggagcagaaagtatattgcaagcatttaataattaatagcctttagtattattttcttaataaagtaaaaagcttcagaagacatgacataaatgttaattatatagaaatcagattacaagaatttcatgacaacttacatttatacatcatcttgtaaaactgcacccttcaatgaatccaaaagctaacagctggcatgctactacttctgtgatgtagaatacatttctaaactttcaacttttgttttatcattattcaatactaggccaatgaaatatattatcaaactggaatattctttaatccagccaactatttcccaataccagaaagataatatagcttgtagagactgtctacaatatctaagtagctagcttgctctgtaaatggaaattcaagtatcaagtacaaggttgaaagagacatcctccaaggtctcttcagaattctcttctatagaagctttgggggaaaaaatatctttcactgaaaaaaacatcaaaagtgttttagtgtcatctgtaagaggctgaataagagggcaaggagggaaatcaagaaaaagactaaagaaggtgactgaaaagcatgatgtatctcagacctgcatgtttcaagctgtgccaaatagtgttcaaacgcctttgaaaactaaatcctataatagtcaatcattcttcaccatccattttctttttatcagcatgtcgacattaatggttctctcacagtcttatagagaacaatgtttatttcatctttgcaaagaaaaaatttgttatttgttaccacaagtaacaaatataaagaagaaaataattagtatggtgtatgatgataggacaaagagcaatggtatggataaaaatgatagtaggtcaaaatttatataagtgtttcagccattgattggtaaagtgcttgacatgttaacaacaagcagtggggcagaatcacattcatgaagaatttcctaaaataatgtgaaaatacagtcttagcaaaaatgccacctctctcacccaaactttccccaaggggccataaagaggtaattatttcccctctgagatattctgtagactacacaaatgtggaataatgcccttactgcattgcaaagatagttaacatctctatttcctcaactaaactaggggtccctaaaaggtgagatagtattttaggtatctttaaatccctagtccccagcgcagtacctgaattatattaggtacatgatagtattggccaaatgaatattttactgaatgaatagttactatacagtaagcaatatttattcattcattccttcaagaaacacttactgggcccctactctatgccaagcactggtcctggtactggggatgcagcaacaagcaaagcaggtaagtccctgcctccataaagcctgcattctgctcaaggggacagatggttgacaaataatgaaagtgttaagaaaacatacaacagtgcaaggggctcaggagtgaaggagtgttttatctatgatagtcaataagggctttctgaagtagagttctgaacatgagcgcacaaaccgtacaactgtttcagagctgaaaattcctagctgtgggaacagaaagtgcaaatgcccaggagcaggaggtacatggtatatccatggaaaagcaagacggccaggatggttggcctagagttggcaagaagaacaacaatagaaaattaggggttgggcatggtggctcgtgcctttaatcccagcactttgggaggccaaggtgggaggatcacttgaggccaggagtttgagaccagcctggtcaacatgacgaaactccatctctacttaaattacaaaaaattagctgggtgtcttggcgcatgcttgtaattccaactattcaggaggctgaggcagagaatcgcttgaacctgggagtcagaggctgcagtgagccaagatcgtgccactgcactccagcctgggagacagagtaagactacatttcaaaacaaaaaaaaaaagaaaaagagaagaaaggaaagaaagaaagaaaattagggtgagaggaattcagaaaccagatcagaggggatctattgtctataaataaaccattgattagccagacatggtgggacatgcctgtaatcccagatactcgggaggctgaggcataagaatcacttgaacccaggaggtggtggctgcagtgaaccaacatcatgccactgcactctagcctgggcaacagagtgagactgtctcaaaaaaaaaacaaaagaaaccattgaagggtcttgaagaaagatgtgacattatctgattctgtaaaagaccacaaggaggtaagaatggaagcaaggaggctacagcattagccccagcaaaagaggagatgtagtggtaggaaatgaacagtttccaatttaaaaaaatattttttaaatagagctgacaaaatttaatgatagacttggtgtaaagaacaggagaaaaggagaggcaaagacataaaggaaacatataaaggttttaaaatataaaacaaattattttatcaagatggttatctatctgtttaagaagaaacattataagatgaaccacacaaaaagagtaagattttgcaccttccaaacaagttcacaggtcaggaggagaaagaactggaaactgggagctccagagacccaagttcgcccacactttgtggctttgaatcacagcatcactgtaacttgattgcccatccaagactaacactggcgaggaaagtttcaggatctcattctcagataataaacataaaactgtaacttttttgtcacaaccatacaaaatccattaaacgatgaaataatgaggttatagttctaaatactatcctaatacttgaccacagtatggacaaagatatataagaaataacagcttttcattttttgagcaatgaataattaataccacaactttaatattttttaaaaagggatttggggtacttaatagaaatacaaattaactagaaacacaatgagtcatgagagctataaaaaatgcttttccaacaactaaagaaaaaataggcaaaggataatctatctgttggataaactatccaacagaacaccaatagaaaataaatataactgggtagatggacaacagtgtacaaaaggaaatcaccaccaaaaacaagaaaataacaattaggagaaagaggtttaggtctacataagatgaatatttatagaaagtatctttgggaaaattctgcatgcacagcttcgaaatattaaaagtggaaaagggaatgggaatatatgattcccgcgaaaaaaatgctcatatcaaattataatctgttttactagatataaatagtttcttccatagagggagggagggaaggaggaaggaagaagggaaaaacctgtaatcctgaagaggaagcatgaaactataatacaaaggcaaagaaatgacagttttcatgataaatacagcaggtgtcttcatataaaatacacaatgtgtcatactttttaacagcagagggtaacaccgtttcaaatttaaatttgtaataacagacagttaattagatttttttcatttgtgaggctagtgccaagtacactttcagaaagccctaagagttgagagtatacacactataaataattgtttttcaataaatttggccaactttaataaacagtgtctactacttcacaattaatggttcaatactgacgactagtggtcaaaacttgtagtaattccctatcaagtattctatgacctttatcaatttatttaaaacatttaatgcaaattatgtgaaaatctaaattaaaagatattgccctcacaaacattcagaaaaacacgaagaaaaggaattgtatctacaaagtctctttaaaaattctttctgtccattatttgcagtatcccaaaagaaaagtcaatcagcatttgctgtcagctcacaaaggaaacagttccatgaaatgtcactttattcacgctcacacagctatgttaacattcttcataaatccataattaatatttcaaagaggtctacatttagaatgcatgtatctgggcatctccattctaaatttctttttcaaactttgttaaacacaaagatatcaaaaatccagctgtctttattaagttgtcagtatagtttgaaaaccagcaacccactatacgaaaatgttatttttatagagttgaattatgtttaatttaactatgattgaattcttgaagaatgtttatggaattttgaatatatcattgtaactactatataaacttcaaataagttaaaattgtttaacttttactttctgtcttcaggaatgagagcagtagagtaacacaaggtataaaaatcttggagtgaaatttaccaagaatgttatatgcagctgaacaatcacttacatttggaaacgtcaatttctttagcacctgttcagtgagctctgtgtgataaaccctgtactacctgtcccagaaacaagggtaaacgagatgcacaaagcccctccaatggagtctacattctttggcaaaaggcatataatagcataagcaaacaaacaataattatagtttgtgttaaatgctatttttaaaaatagagtaatatgatacatgacagtgagcaatggaactgaaggggcgattttagaaggcgaggaggaacgggaaagttttccctaaagaggtcacaattgagcctgaggaacgagaagggagaaaaatgttccagtaagacactgagaagaatccaatgtagctggaacatagatatcttagactaataagtactgtatgtttaaaatcttagaacagctatcaaaagaacagaaatataatctacagctccaaagcaaacagaaagtataaaaatgaatatataatatactccactccaaatagaaatgggaaaaagaaacaaaaagagaagttaaaaaaaaataaataagataaaaacactttaaaatattccaataatcgcagtaagtataaaatgactaatgcaaccattaatttataagataaagttatttttaacaaactataaggtgttttgtaagaaacatggaaaaatggaaatactaaggaaagattaaagagggaaaatgatatgccatgaataaagtaatcttaagaatgttaaaatcaagaggcacactaggtaatattttttaaataattgaccaagaagtaatttaattatacataagataccacatgcacaaaacagataaaagaaaactgacacaaatcacacggagaaactgataatctctataataatgagaagctttagatatatgtactaagaaaacagaagaacagaacaacaaaattcacaaatgacctattaaatttatatatgtgtgtgtgtatgtatgcatgtatgacatgcacaagcacataaaattctgcatccaaaacacagaaaaatatttgtttcttactctggagtacttacaaaaaattggtcatagaattaggtcaaaatggaagtttcaacaactttcaaaggagttaaattaaaaacaataaaaagagtttaaaaataagcacacatatatctctgaaaataccaaaagacattcctaaataagttttgagttatagagaaaattgtaacaaattataaaagattttgaaaaaaaattaccataaaagtataacaaagcatatggtaatttggttaaattttcattattcattttaaaaaagcagaaaaatcaatcaagcattcaattttcaagcctaaaaaataaaacagaataatcctttaaatgaagagaaagagagagtaacagagttaagagcagaagttaatgaagcaataaacaaagccagtcaaaaagaaaactaataaaataatactatttctagcaagactttaaacatgaattaccaaattgacttaataaacaggctatacaacccaataaacattaaaaaaaattagtaatctgcagcaccaaaaagatattagacacaaattgttttatgggtaagtttcaacagacattcaagaaatagataatccctctcttacacaaaactaaaccacgaaataggaaaagaaggaatccatctaattcattttatgacactaatgtaaccatgcttctaaaaccaaaaacgtcagtgcaaggaaaactaatctcaatcataaacacaaatataaaaatcctaagaaaaaaatagcaagttaattcagcaatgtataaaaaaaaattataatcaaataaagttctcaggaatgcaaggagggctcaacatctattgatggaatcaaccatatttaaatcaatatatttaaatacccaaagttaagtgcacagcaagaatatctgataaatttcacaacccattcatgatttttaaaataaataaataaataacagcaaacatctcttggcaacctaggaatagaaggcaatgttcttaatgcgacaaaggttagcactaaaaagtaggggcaaacaccatacaacatttaacacttaagaatcatacaaatatagaagtaacacaagaattcttgctatctttgcttccatttaatattagacttcaggttctaaccagtgcaataagataaaaaaaaaagaaaagaattataaagagactaaattgcctttaatttcaaatgatatgattatctatacactaagatagtatgtcagtaaagctattaagaaattataaggactaataagggcattgagcaaaattgttggatataagaaccatatatgaagccagttgtacccctgtatactaaaaataaccaattagagatgcaattttaaaaaaaaatcccattccagatagaaagaaaaaccataaggtacctaaaaataagtctaacaaaagaggtctaagacatttatacagacaattataaaacattattggaaaacattagaaaagaccttctctttaaattagtctgtacttaatacaatcgcaataaaaatgccagcatgatttttcatggaataggacaagagattttcattatcatttaccaaaagataataaaacctataataattaagaaagaattatattagtatagggctagacaagcaaatcaatggcaaagcatatagaggtcagatagatattgtaggaaactagatatacaacagatgtggcatttaaattagagtggaaagaaccaatttttattcaaaaatgatgctgaagcaactgatgagtcatataaaaagcaaattagatcctttcctctctcctattaaaaaaaaaatccccggggggaaagagagaaatcccaaataatccaatatttttaaatgagcaaaagtcatacataggcactgtatgtaagcacaaatgcaaactgccaagaggtgtgtgaatagatgctcaaattcactattagagaaaagtgaataaacataaaaatgagttaacactttatactgatcagatggcaaaaacttaaagaattataaccactacttctggtaagaatgtgggggaaagagctacactcaaccattgctggcagaacaacgtgcagtttcagaacctctggaaaaataagatctaccaatggcaatataagattacattggaaccatgtcagctagttggatgaacttccagaaaacattggcaaaaaaaaggaaaaaacaagaagcagaaatgtatactaaatgtgatctcattttctaaaaacgaatacatgaccaaaaagtccccatatatatgcaaaggtgtatatatagtctatatacatcagtccaggtaattaaaagcaaacagaaaaatataaagggataccttccaggccgtcaacatgagttcctttttttaggggtaagagaagtggttcatgatgaaagaacagagttggaagagatgtaggaaaaaaatcagccatgtaaataaataaataagcctgtattgtaagagaatgtctgaatatttcatatgatcacatttagttatattaaaaaacgctttttgtactaaatatttaataatgaaatgttaaaagaactacgtgagaaataaacctagttaaacacaggaccaaaacagtgtattaatgtggtcactacttaacgtattaaacaaatatttagtaagtattatcttcaaatactagaaatgaaaagtgttcaaaataggtaaaattaaaagagagaacatatcaagaatcagtaacataaataatcggggacaaagctctcacatatgtattaccagaaactggacagtgaaagaaaaaaaaatgccatctttacagaagaagaaaaatagtcaatgggattaaagctggttaaaagaataaaaagtgtggctcaaaataagccccgatttatactacacacacaactttaccccgtgaagaataaacactggagtaggagttttaggattttcacttgctacacgcattttccaacaaagtagtacatgtgtggttgtcctgttgtgatagtgctttcagcctcttggtggtttgagggctctgacaccctgcctgtgttactctctgcttaccgaaccccatggggctcacacagtcctgtccaaggactcaattctagggcttatgtcctaagaataagaaaaataaagtacatcctctgagttttcctcctgctttccacaggattgtgtttgacttttaaactttcatttacttgtaaactctattggtccttctcaaagattagagaggctgctgggatgatcaatacgagagtgattttaatgggcatttataacatctaacaatataatagggaaaggaaaacttatgaataactatgcaaaatatgaatatgaataactgtatgcaaaaatgtacgagatgactacaaaaaaaaaggggcattggttatggaaacaagagggaggcaaagtgaatgatcaaacaaaagttttacaactgaaccttgaaaaggtaagcaaaggcgagtccaagatctgccagccttggaaaggcctccacgactccaaacaaagtaggggagtctggaaagaaagtgcaggaaaaggggttaatgaagccaggttagaatatttgcctgactaggttctcccctgctgtgtgatactcgaaatatcacagaagcctcaagggagacgcaaaagctattaagaacacattagaaaaacatcctaggtttcatggaagcttctcccttaatgagtccaaactaaatacattaataaagggtacccgaggcttttcttatgtggtatctgtattactcagcatctctggggccataattacatttctggacaaaaatgaatagctacttcttcattaggtttttccaaaaaaatgaagaaaaatgttggaaaaaaagtatcgattactttaatttttcttcatatggccttagtttattgatgagcttcacataacctggttgtccctcagaacagactaaaagccactgagctgagctcccatcttaaacacttaatttctcacttaaacttcaccatcgtctattaagattccatgcccttgcctatcccacagacttccccatgaaacaaattttaattttaaggcatctagatcatatgtaagcatagaatattgttgatacagataagggagaaactactgacttaatatgctataaaatgctctgaagacggccaggcatggtggctcacacctgtaatcccagcaagttgggaagctgagacaggcagatcacttgagtccagagtctgagaccactctgggcaacatggcgaaacctgtctttacaaaaaatacaaaaattagctgggtgtaatggtgtgcccctgtagttgcagctgcttgggaagctgaggtagaaggatcgcttgagcctgggaggttgagactgagtgggccatgatcacaccactgcactccagcgtgggtgagtgtgaccctgcctcataaaagtgctctggagtgtgcctgcgtgtgtgtgtgtgcgtgtgtgtgtgtgtccagcatttatctcatgtttttcttttcttttttttttttttttttttttttttttgagacagggtctcaatctgtcacccaggctggagtgcagtggtacaattccagctccctacaacctctgcctcccgagttaaagctattctcgtgcctcagactcccaggtggctgggattacaggtgtgcaccaccacactaatttttttgttgctgttgtttgttttttgtatttttagtagagacggggtttcaccatgttggccaggctggtctcaaactcctgatctcgagtgacccgcccacctcagcctcccaaagtgctggaattacaggcatgagtcaccatgcccagccatgtttttcattttaagtaattcggctgaagatgaagaaataatattcaatgtatatgaaatagccagtaaaaaatgagtcaggagtttccaggatgcaaaccagaagtttaaatttttatctaggattttatgtaaatattgaacctgcaaaaaaagtggttttggctttttttttttttttacagttttttttttgttgtgtgtttacagtctacatacctctttcccaacactacaacctaccaagcctacccccactccactaaactaaccaaagttatgatactatcaagcacctcatcaaaaggagtttatagtatgataatttacctcaatgttatatacttgactgtgtacacagaaaaggctgatgggtataggcttaacaacacttgaatttaggtcgggcgtggtggctccctcccgtaatcccagcactttaggaggccaaggtgggcaaatcacttgaggtcaggagtttaagaccagcctgggcaatatggtaaaaccccatctctacccaaaatacaacaacaaaaaaatcagctgggcatggtgatgcctgcctgtagtcccagctacaagggaggctgaggtggcagaatctcttgaacccaggaattcgaggctgtagtgagccgagatcatgctgctgcactcctgggcaacagagtgaccccatctcaaaaaaaaacaacaacaacaacaacaacaacaacaaaaaacatgaattgaattagtaaagttcaaagtatcatctacaatttaagaaagataatattaaaagaatatagtcatacaacccatttaaaatactcatctctcttaaagaagagacttccatgagataaccaaaccaggttgtttaaaatacaatgtatgaaggtccttaccaaataaagaaaatctggccatactgcccaaggtaatttacagattcaatgccatccccatcaagctaccaatgactttcttcacagaattggaaaaaactactttaaagttcatatggaaccaaaaaagagcccggatcgccaagtcagtcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccacatatctacaactatctgatctttgacaaacctgagaaaaacaagcaatggggaaaggattccctatttaataaatggtgctgggaaaactggctagccatatgtaggaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgcactcaaacaaatttacaagaaaaaaacaaacaaccccatcaaaaagtgggcgaaggacatgaacagacacttttcaaaagaagacatttatgcagccaaaaaacacatgaaaaaatgctcaccatcactggccaccagagaaatgcaaatcaaaaccacaatgagatatcatctcacaccagttagaatggcaatcattaaaaagtcaggaaacaacaagtcctggagaggatgtggagaaataggaacacttttacactgttggtgggactgtaaactagttcaaccattgtggaagtcagtgtggcgattcctcagggatctagaactagaaataccatttaacccagccatcccattactgggtatatacccaaaggactataaatcatgctgctataaagacacatgcacacgtatgtttattgcggcattattcacaatagcaaagacttggaaccaacccaaatgtccaacaatgacagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcgcagcagcatggcacatgtatacatatgtaactaacctgcacattgtgcacatgtaccctaaaacttaaagtataataataataaattaattaatttttaaaaaaaagaaagaaaatctggcattcatgtgacttcaatagcacatgagtagctgaggctcaaaaaaggaagtggattcctgggcgtgcatggcccttttgttcaaatcaggacaagaaacagaaatgagtgaacaattctttaaaacccctacagaaaaggaaaatggctttcccttgaccaatttccaatgattaacactgtgcttttgcattaaatgggaataggtaaagctctgaggacctaaggacccgtgagataacagcagcagattttagccaaaaccacagaatgcctccctgtaatatattataccttcaaatctctgcatcctataatttcaaataaaaactcttaatgtcttaagttttaaatgtcatatttttcattaacattgaaagatacattttaagaaggcaaaagagcacagtggctagaagttcaggcccacctgctcaattatggatttaatttttcaccataaacaggaaaaaaatgcatcaattactattatcatatggtataggaatttccataagtatttttaataaaaagaagggaaagtgtttcctctccttaaacatgacctttccggaacagtttaagccatttaacatgggagcaggaaaatacatcagcttaatctttcctagcttccactactctgtttataatctaaaaccactttttaaaaacgtataggtcactgcttatattaaagtaacaaaatatgaaattaaatagttcttatcaatagtgatctcctattgtattgtcagagatggaattccaaatcacagctgaagcttttagtcaaattgacaatttcaatggaaatacccaggctctggtatcttaagaaaagtggtgggaagcaatctttttctccctctttctttgtaattttgtgcattctgcaaagagagaagaaaataagtacagaaaatttctctaattttctcttgcagaaaagaacaattgtctctttagtactattcttatgctcaccagatataatttgctttgagaacaaatgtataaaaatcaaggttaaaaaaaaaaagcttacccacatgctgtatctaattattcaacaacatatcctcttcaaagtaattaccaacttacaagggtatgtcttcttttgtgaaatggaaggaaatggaatttcagaaaacaaaagcagatttttctatcagcttacattaaatttcagtgttgcaatttttgttcctaattttcaattaacagtgaaaaaaactttaaaaaatctgtcgattaataaagattaacgatctacaagcacacataagtgtatttttagaactcttagaaaaatcatttcataaatgaaaagaattcccatttgttttgaatcttttgtgtttcttgttgtttctactttttatattttatgtatagaccaaagaaacacttaaagggaatttcaacaatattctaaaatgatagtaacaaaatataaccaatataataaaataaaaatccatgagtgcacataacaaaaagttctttcttacagtaggattctataaatgtagaaggaatcataaaaaaatttttaaatcactatctggcactacttatagtagtaattgtttcatatgagtcaataatagatgctaaaattagtgagcaaaagtacaatagaaatttacaatagaaagtacaatagaaaagtacaataggatatgttcaagtcccaaagataattttactttataggataacttaaatttaaataacttaaaattatttaaataattttaagagaataattgtaactttaacagtggataaatccacccagtaggcaacacaataatcaagtgttcagttttcaccagtaatgtaacaaatcaacattatatgactcctgatatgatactatgggaaggacataactccaattatctgagtttcaagccaaaagtccataacctgaatctagtcatgaagaaacatcaagaaacccaaaatgaaagccattctacaaaataaattgtttacaccctgagaagtcatcactcatgatgactgaaaaactgttccagattaaaggaaactaaagagacatgacaactaaatgctatgtgtgaacctatattttatcctggatcaggaaaggacactactgtagtagcaaaatttgaataaaacgtatagattaagccatagtattttactgattttaatttcctaattttgattgttatactgtaactataaaagaaaacatacatatcaaattatatagatgaaaaatgatttattttttaatcagttgactttaagattcacagataagtatgtatatcatgtctgcaaattaaaaatgtttcacaaaaaattacatatatgtggatgtatctagaataaatgatgaagcaagtctggtaaaatatgaataataagggaatctaggtaaatgttatacagaaattcttcattctaaattttcaactttatctatgtctgcaatttcaaattaaaaagagtaccttaagggtaactattctccattttaaattggtttgataataacctaattcaggagttgtcagactttttctgtaaagggccaaactgccaatactttaaactccatgggccatatatacttgtgggctacaactactcaactctgccattgtgtcacacaagcacccacagacaatctatcaatgaataggagtggttgtgctccaataaaactacttacaaaaatagacaatgggccagctttgacctgtgagccacagtttgatgacccctggtctagtctatgcccagaaaaattaatcagaataattatactttcagttaacattttccgagcatatgacaaacagtatgttaagagctgtattggcattaattcatttatccttgcactaatctaattaggtcaatactattattatttccattttccacagacaaaactagcgcctagagaagttaagaaacttgcccaactaatgtcacatggacagcaagtatgaaaccagggaggtctgattctatacactgaactataaccaatatgtgatattaatacttctcagatgggttgaattatactgtcacatgcaataaccattttaacatggctaaataaacatccaaattcaagatttacattccatgaaagtgtttttcacaaacctcctgtagctgcagggacatgagtcccagttgatcctggcgtctttccaccagctccctttctgtgcgcatctctctctccagttcctgaagccgccgctccacccgatctgaaaccttaataagaattcagagaaacagcagcattatagagctagcaagcaaaacagactaaattgagaagatagttttatagcagatacactactgcttaaagcatttaagattgttttgtttgcaaagccccttctaatgacgctaacatgaaatagctggccaaaaagcttactgaaagttacaaaagaaagtcatcactgatctccaaataatcgacacctggatcccaataaatgcctcaaattttttgaggtatgatataataattcagtagatcagagttaaaagtaatacactagaaaagagtgccctctggtgagttagaatgaaaataccaattttgctaaaaattgcatttgttagccaattaatgataaattgttcgacctaattagtccttttctatttttattatccatgagcatgacctgcctatgaaggtattgatgtttatttgtagtaaataattaagagggctttacattagcttatcaatcttttctactgcaatctgctaaaaataaaacaagctataaaagatcaaaaactaaagtcaaactgaaaatgtttaatcaggactctaaacgtgaaagaaagtcaaactgaaaatgtttaatcaggactctaaacgtgaaagaatttttctctctgacacaaaattctccttactaaaagttgcataaattcaaacatatctcatgtatttcattatacagcccactaaataaaatttacactattgacaatgtctatatttggtacataaggacacagaagacatttgtattcatataagagaagcaataaacacagctgttataagaaatcttttgtcaccaattatttatatgacaaagaatcaagaaaagtcctgacaaggaaccttattggggtcgtgtaaatgttctaaagtgaattagggaggtagctggataactcagtaaatgtatggaaaaaaaaagttattgaattgtacacttaaagcattaattttatggtgcattatagctcaatcaagttttaaaaaaataaataaacataagtttacttaggcagagcagaagtttagtttactcttgaacaacagggattttaactgcaaaggtctacttataagtggattttcttctgccactaccactgctgagatagcaagaccaattcttcctcagcctactcaacttgaaggcggaagacctttatgatgatcaacttccacttaatgaatggtaaatgtattttctcttccttataattttcttaataactgtttcctttagcttactttattataagaatacaatatataatacatatacaaaatatgtgttaattgactatgttattgtcaaggcttcctgtcaacagtaggctattagtagtgaagttctgggggagtccaaatttatactgtatccccagactctgccttcaaatagcttgctatctattgaagactgacaatgaatgagtagttaaaatttctctgattaaattcaataagttgaatgacttctatatttcagaaaagaaggctgctcttattagaatcctatcaaaattaaagcagtccaagtaaccacatactgaaatcaatatccaaaattatttagacatcagcaactttgtcaccatagctaatacatatgatgatacagagttactatacttggaagattgtttctcaatttttttttttttttgagacagtctcactctgtcacccaggctggagtgcagtggcatgatctcggctcactgcaacctctgcctactgagttcaagtgattctcccgcctcagtctccctagtaccagggattacaggcacctgccaccacgcctggctaatttttgtatttttaggagagatgttgtttcaccatgtcggccaggatggtcttgaattcctgacctcaagtgatccacccaccttggcctcccaaaatgctgggattacaggcgtgagccaccatgcccagcctttgatttcttctaagtaaaagtttttttgaaacataatttcatgtattaatatacatatacattgtgaaataactagtcaagccaatcaacatatctatcactttacttagctaacattatttttgccaatactgtagtcaccattttgtacattagctctctagaacttattcatcctacataagggaaactttgtactacatatccccattttcctgacccctcccaaccctgccctgcccctagcaaccaccattccactctctgcttctacgaactagactttttggagtccacatttaagtaagataatgcagtatttatatttttgtatctgccttacttcatttagcataatgtctttcaggttcatccatttgttgctgcaaatgacaggatttccttctttttaaaaattgaacaatattccattgggtgtatatacgtgtgtatgtgtatttctttatctgttctttggtcaatagatacttaaattgtttccatatcttgactattgtgaataatgctgcaatgaacatggggtgtatagatgtctcttcaagacactgatttcctttggatatgtatccagaagtgggactgctggattatttggtagttttattcttaattttgatattaacatttctcttacacaacttctgacataggtcccaatgatccatgcttcttggtattcatgcacttgtgtaatcctctacccttgagtgtaggctagccctagggactttcttctaataaagaggacactgcagaagtgatgggatgtcacttccattattagattgcaaaaaactgacttccaatttgctagcatcttccctcttgccagtcatcttcttgtctgcttgttctaataaagcaggctgccatgttatgagatgctctacggagacgccacatgtcaaagaaacaaaagaagccttttaacaggtcatgacaaactgaagtctcaaatccagtaacctacagggaactgaatcctgacaatggcttgtcattccagtcaagccttgagaaaaatgcagcctgcaagtgacccagagccaaaggacccagcaaagccacacctgtctctcaacccactgaaactgccaaatgaaatgctgttttaagccagcaagttaggggaaatatgttacattaaatgctaattgtacatacccagacaccatgaccatccctatggacccagtatacaggtcagcccccacagatgcaggcaccaggcccacctccaggaactcaggttccaggtgcacctcagtactagactggcccctgtaagcacaggctctgggccttcccccgtgggcccaggtaccaggcccatcccaacaccaggcagaccccaacagacttaggctctagtctcaccacagtgccagaccagctcctatgggcataagctccaagcctatccctaagaacccaggcactagggacacccctgcagacccaatcaacttgccccacaccagtagaccctcgtgccaggccagccccagaggagccaggatccaggtcccccacagaagacccaaagtcaatgtctgccccagtgaatacaggctccaggctcaaactcataaacccagacaacaggctagcctctgggacccagataccagctcaggccatctgctgacccagtcacaaggccagctcccaaaaagataccagcagcaaagctcattaatgagccctgctagagagcctaccaaaaatctctgcatagactcattaagtaaagggagtcccctgccaaagccagtctataaagtctggaagaagtgcctgcttcttcaaatgcacagaaactaaggccataaggatcataaatgatcagggaaacatggtatcactaagagaacaaaataaagcaccagcaagcaatcccaaagaaatggagatcttcaaactgcctaacaaagaatacaaaataatcatcttaaataagttcagtgagctacaagagaatacagtagtcccattttactcatgcaggatacactgcacaatccccagcagatgcctgaaaccgaggatagtatcaaaccctatatataccatgaacaatttttcccttcataatttcacagacagtaaatttgttcatatcacagaaattaaaaatctcagtatatattttttttctttccttactaagttgagagtttcacattttcaattagaagaaacactttatggcttctctttggcattgccaaactgtcaacctcactactctgcactttgaagccattatttagtaaaataagggttacttgaacaaaagcactatcaggttactgagacagtgaacctgataactgacatgactgctaagcaactaatgggtgagttgtgtctatggcatggatataatgaataaagggatgattcatgtgccaagagggatgaagtgagactactgaagatttcattgctctactcagaatggcatgcaatttaaatcttatgaattgtttattaatggaatttttcatttactatttttatattgcaattgaccacacgaagctgaaaccatagagagcaaaactatgggaaaggacaagcttctgtacagacaacaaaatcagaaaattgttgcatgaacaaaattagaaattcagcagagatagaaaccatcaaaaagaacaaaacagaaattcttaatctaaacaacacaatgactgaactgaataattccagagcaatcttgaagcaaactagatcatgagctcaaagacaggtcatttgaaattgcccactcagagaaacaaaaaaaacaagaaagaaaaagaattaagagaggctatggaatttatgagatactatcaagtaaagaaatttactcataatggaagtcccagaaggagcaaagaaagagaaggagatgagaggagtttacttaaagaaataatagcagaaaatttcctatatctggaaaaagaacacccagatccttgaagatcaaataactacaaatagattaaatataaagagatcttactgaaacgcacaataatcaaattctcaaaaggcaaaaacaaagagaaaatgccgaaagcagcatgagagaaacaactcatcacatacaagggaacccttatgagactatcagtgaatttctcagcagaaaccaggagagaatgagatgataaattcaaagtcctggcagggggtggggggagacaggtgctgccaaccaagaatatcataaccattaatttgccttacaagaaatataaaagggagttcttcaagacaaaatgaaagaatgctaataacataaaagcatatgaaagcataaaattcactgtaaaagtatgaatatactcaaattataatactctaatacttataatggtagtgtttaagttacttttaactctagtttaaaagacaaaagtattaagaatatagctgctataattttaatggatacacaatatttaaagaggtaaactgtaacatcaataatgtaaaatgggaggggaagttaagtgtagactctgtatgcagtcaaagttaagttgtcatcagcttaaaatagattgttacaagacattttatgtaaataccatggtaaccacaaagaaaaaaacttgtgcatatttaaaagacagagaaagcagtcaaagcataccactacagaaaattatcaaatcacaaaggaagacagagagaaaaaaataaatgaagaaactataaaacattcagaaaacaattaagaaaacggcagtagcaagttcctacctataaataaatgttttaaatgtaaacaaattaaattctccagtcaaaagacatagagtagctacttagactttttctaatgacccaactgtatgctgcctaaagagactcataaatagactttagagatacaaatagaccaaaaaatgaagggatggaaaaaggtattctacacaaatggaaactagaagaaaacagaggtagctatacttacatcagagaaaatacactataagtcaaaaaatgtaaaaagaaacaagctcattaaataattataaaggagtcaattcatcaagaggatataattgtaaatgtatacgcacctaatcagagcacctaaatatataaagcaaatcttaatagatctgaagaaaaagattaaacagaaatacaatagtagttttgtggacaatggacatatcatccagacggaaagtctatagagaaacattagacttgatctacactttagaacaagtggacctaacaaacatatacagaacattccatcaaacagcagcagaatacacattcttctcaagcatgcacagaacattctccaggatagatcatgttaggccacaaaacaagtcttaacatatttaagaaaataagtgtccctttagatcacagtggtataaaactagatataaatgaataggaaaattcactaatatgtggaaattaaactacacaattctgaacaatcaatgggtcaaataaaaaatttaaaagaaaatgaaaaaattccttgatacaaatgtgaacagaaatacaatacaccaaaacttatgggatgcaaaaaagcagttctaagagggagttttatggcaataaatgcctacatttagaaaaagatctcaaataaataacctaactatacctcaagaaactaaaaaacaaaattaaactaaactaagccactgtcaatagaagaaaggaaatcacaaagattgcagcaaaaataaatgaaatagactagaaaaacaatagaaaagatccatgaaactaacagttgtttgggtaaacttttattttaggttcaggggtacatgggcaggtttgttacataggtaaacttgtgtcacagaggtttgttgtacagattatttcttcacccaggtattaagcctagtacccaggagttatttttttctgcttaaagttagttttttgaaaagataaagaaaactgacaaaatgctagctagactgaataaggaaaaaaagagtaatgactcaagtcaataaaatcaaaagtaaaagaggagacattacaaatgataccacaaaaatacaaagtcttataagaaaatactatgaacaattttatgccaacaaattggataacctaggagaaatgggtaaattcctaaaaacctacaacttaccaagactgagtcacaaagaaacagaaaatccaaacaaaccaataatgagtaaggtgattgaatcagtaatcaaagacctcccaacaaagaaaagcccagaacctgattacttcacaggtaaaatctaccaaacatgtaaagaaaagctaatgccaatccttctcaagctcttccaaaaaactgaagataagagaacatgtccaacctcatcctatgaggccagcagtaccatgagaccaaagacactactaaaaaagataattacaagccaatatccccgatgaacacagatgtaaaaatcctctgcaaaatactagcaaaccaaattcagtagcacattaaaagaatcattacaccaatcattacaccatgatcacttagtatttatccccagaatacaaagctgcaaatcaataagtgtaacataccatattaacagaataaagaataaaaatcatatggtcttctccatagatgcagaaaaagcatttaatataattcaacatcctttcatgataaaaagagaaacttccaataaattagacatagaatgagtttattttagcataataaaggccatatacaacaagccaacagctaacatagtactcaacagtaaaaatctaaaagctttttccctaagatcagaaaaagccacggatgcccagtatgaacacttccattcaacgtagtactgaaggtcctggccaaagcaagtatgcaagaaaaagaaataaaaggcatctagatgaggaaggaagaagtcaaattgtccctgttttcagatgacatgatcttatatacagaaagccctaaagaggcccctaaaaaaaactgttagaagtaataaacaaattcagtaaagttgcagaaatcaaaattaaacatacaagaatcagcagcatttctatacataacaactcaaaaaaaaaaagtcctgttcactatagcacccaaaaaatacgaagaaataaatttacctaaggtgatgaaagatttgtactctgaaaataaaaaaaattaaagaaagaggaagtcagcaatgtaaaatcttggtaaaagaaaatagccagtggaaaaaaaaatcaagatatacagagaaagccacataacgtaggcactatagaccatggtaaagaatttggaacgaaagaaacccaggtaggatttttaaacctggaggaataattaaacataatgacaatttaaaaaaataatttgcctgcagtgagaagcacagataaaggcaggtatgggagcagagggaccaacttcattggatgccactgcagtaaacccactgagaagagatggtagcttgaaaagtagtattagaagtagatggaattgagcaagatttcagaaattaaagggacaggattttgtaatggattggaagtatggtgtaaagaaatggatctagatgaatccttggtgaccagcttaacgtgctggatggaatatgatgccatttcctgagacagtgaagaccaaagtaagtaaaaacaaccctaaatgaaggttgtggaccttaacctaaagacatatatttatagcttttgagtgatgacataattcctaataataagaattattttaaagaaagtatattttagaacttctttattttttctttctctgagacctaagggaaaaatattagaaatgtaatccaatactaaaaaattcatatttaccagaataccattatcaactaagtttaagactagaataccaaaaattcctaaatctccatatttggttataaaaatagcaaaataacaagaataaaaattagaatggcttttaagattagtatttaatgaaaggtcaaacaaaagaaaaagcattctgtttaaaagatggtattctcgcttttcaatatgttgattcctcagatctttaacaatacctggtgcttcaaagtccacttaaataaatatgttatatatcctgctgctgtgatctatgcaataatcctgttattctaaatgcagtattgacagaattcttataaactctattaatggtcaacccttccagaaacagctggatccatgtttacatttttatttttaatagtgatcctcctatagaaaactaaaatagaattgactttttcctccaaaaataatcaaataacatgcagtcatatcacactcagctcaataaaatctagacaactaataaactgaaatttcccatatggtataaggcctatgcaatattgattgcgtatcaccacaattaagtgttaatagaaaatattttccatgacatcatactataaacaataactcttcccttccaatggacaatttgacattagcaaaaaatatttatgattcacaaaagattaacacatcaaatactgacatatatgacagcaaccacaactttttgtctctcaaagaaaaatgtgttccataagctttcaagatatattttagtcactgagaaaatgcatgataaacaactgtagcctcagaataatacacaataaacgtgattaagagggcttaccagtagaaagtgaaattggcaagaaataggggcagcatttattttcactttatgtatgtacaatatttaagtttgccacagtgaaggtgcatcattttggtaattttattttaaacttaaatctgaagcaggggaaacagctgcagtctctgagaagcttaacactcaaataatgaaaccatcttctctgacagcaggttatgaattcacaaatacaacacaatacatcgaccagttataaaacataaatgttgacttcaattggaatgagtcacaaagtctatattaagccctggaaacaaacatcatgtggccttcagaagaccttcttaattccaacaatgttattattaagtttcactttggacatttttttcttaatcaggactatacacacccataagaaatttgagatgcccttcgtgcaattatgagacaatcttactttgacagcaaattacacaaagcacaaaacaaggtgtaacatcacaacttgatgtaaggaactggcacatgaacaattcaactgagtgtacaattatgtgggcacaattttctgggtttagacaatataaaaggctgtgtcctcatgagctgggcagaggggatagctgggtaaactagcatgttttatacagcaattacaccaatgagctgggcaccagtgaggagtgacatccagttgcactttatgtgatatggagtcattcttgatgcatggcaataattatgtgaaagagtttgagctctctctgaattcagctaactgctaactttttactcagtggctacattttaaatacaaagtaaaactgtagactatatatagataatacttactagttttatttgctatgtgaaagaaatccaaataaaatgataactgtttattatgggttctcttgtcacgtggtgaaaggtgaaacaataaatgtaatgtgcactatgcaaattggtactattaaaccccaaattgaaaccatcctaactatctaatagtttcaaaaaacagcatgacagtacagctggatatgaccatggctcactcagctttacagggacctcagtagaatattaaggatatctgaatttagatcaaatcctgtttagaagtaatataatttggtggtgtccccacccagatctcatcttgaattgtaactcccacaattcccacgtgtcatgggagaaacccagtggcaggtgattgaattatgggggcgggtctttcctgcactattcccgtgatatttttaacatcacgaatattttaaataaaatattttaaataaaataagaatattttaaataaaattgttttagaaacgggagtttccctgcacaagctctctctttttgcctgctgtcatccatgtaagacctggctttctcctccttgcctttcgtcatgattgtgaggcctccccagccatgtggaactgtaagtccattaaacctctttcttttgtaaattgcccagttcgtatgtctttatcagcagcataaaaataaactaatacaacaagcatgttcacaagatgtatatctatatagcaagtgaaagaagcctcaggcaacagttgaaaaacttagtcaaatcttgtgcattagaaaacgtaccctgggtgcagtggggtggctcacacctgtaatcccagcactttgggaggctgaggcaggctgaccatctgaggtcaggagtttgagaccagcctggccaacatcgcgaaaccctgtctctattaaaaatacaaaaattagccaagtgtcatggtgtacaactgtaatcccagttactcaggaggctgacgcaggagaatcacttgaatccaggaggtggaggttgcagcgagctgagatcacaccactgcaccccagcctgggtgacagagtgagactctgtctctgtctccaaaaaaaaaaagaaagaaaggaaagagcaaacatagtaatgacatcggatatataaaaaagattaaaggagtttcacttccagaaataacagactagataattcagttgaaagtaactagaaagctagaaagaatattttaaatatagtttgtttgtttgtttctgagacggagtctcgctctgtcgcccaggctggagtgcagtggcgccatcttggctcactgcaagctccacctcccgggttcacgccattctcccacctcagcctcctgagtagctgggactacaggcgcccaccgccatgcctggctaatttttttgtatttttagtagagacggggtttcactgtgttagccaggatggtctcgatctcctgacctcgtgatccgcccgcctcagcctcccaaagtgctgggattacaggcgtgagccaccgcgcctggccaaatataactgttttttaaaacactgggaagttaaaaagtaataaggaaatataagaataacatgcagaagaaagaaaaccggagagaatggtctatcctttagaacgactttttcccctgaaatatcagctcatttcagaaaaggcagctgagacactgagaagctgaacaaagtttttagcagattcttaaagttaaatgagaaaaagtgttgagctgagagacttgcaagtaatgggtccctgattaatcactctcttagcctttggactggaatcctgaagggctatacgcaagtagtaagggtgaaccagaaatacttaagacccagtaccaaagtttattaagtatctcaacaacaagtaataagataatccaagattgctactgaccctagtctataacaaaaaataaatgtctatattctcatacgtaataatgtcctaagcctcaaattatctattcaaattttgttggcagaaaataaaatacgctttctgtcatcaaacaaaaataactaaagaatcaaaactaaacagtaggacaaaacaatgtgatcaaagtccaagaaaagcaaaggataatagacaatcgaaacagacacattgaagatctagataatgaagctatgagacacagataaacagattgatgattttggaaaacaattacaaagttaaaaacaatcaaatgaaaattctagtactgaaacttgcaatgacttaaaatgaaaatcagtgagtgggtttaataggcttgcctcagttgaagagagattaagttactaaataaaaagaaataaaaatttcctttctaaaggaaattctagatgggatactttcaggtatatgcacactcgccctaaagggaattttaaaatatgttcttaaggtagatgtgcaatctgaaaaatgcaggaaggactgaagaacaaaagacagtaaatctaagggtaaacctaaataaaccattattgcataaaataatagtaatgtcttctaaggctcaattaaatacaaaattaaataacaaaatagcataaaagtgaaaagcggggtttatggagttgaggtgctatatagaagaaaatattcaaaagaaagaaagaagaaagaattaaaactgacagaaatgagcataagagacaaaggggatgaagtcaaaagttcaagattatatgaaatctgaagtcctaaaagaagagacaaagaataaaagtaatttttgaagaggtaatggtactataagcagcaagcaacaagtcaaaacacacacacacacatgcacacacaactaagcttatcacagtaaaactataaataaaaacaaagacaaagaagaaaaacccaaaagcaattagagaaaaaaatctattacaccttaaaaaaaaagcatcaggccgggcgcagtggctcatgcctgtaatcccagcactttgggaggccaaggagggtggatcacaaggtcaggagatcgagaccatcctggctaacatgatgaaaccccatctctactaaaaatacaaaaaattagctggacatggtggcacacgcctgtagtcccagctacttgggaggctgaggcaagagaatcgcgtgaaactgggaggcaaaggttgcagtgagtcgagatcgtgccactgcactccagcctgggtgtcagagcaagactcccatttcaaaaaaaaaaaaaagcatcaataagactagtgtctgatttctcaatagaagcaataaaacccccaaatgattaaatttctttaaaatacagaatagagggaaaatggcccatctagaattttatatccagtgaaaatttttcaacatagaaagtgaaagaaattttcagacacatacagagaagatttttcaccaaagcacacgctctaaaggaaattctagacgggatactttcaggcatatgcacactcaccctaaaggaaatcttaaaatatgttcttaaggtagatgtgcaatctgaaaaatgcagaaaggactgaagaacaaaaaacagtaaatctaagggtaaacctaaataaacctttattgcataaaataatagtcatgccttctaaggctcaattaaatacaaaattaaataacaaaatagcataaaagtgaaaagcggggtttatggagttgaggtgctataagatctttgcattttctggaaagagctaaaagaattaatttatattagttttgatattttaaagacatatgttgtaatccctaggttaacaaaggaataaaaagatataattagaaagctaatagacgtggaatacagaaaaatgaaaactaataaaaacgaaaaaaaacacacacaaaaaatggaaatatagtaagtgggtccaagagaaagcaaatagtaagatggtagatttaaataaatgaaatcaacatttacattaaatgtaatacagcaaatcctccaaatcaaaacagtgttacactgacctttaaaaaaatatttaatgatactctataaaatagcatgaaagatatcaaattcaagaaataagttgtaaaaaaaatgtataagatataaaacttctttgagtgacatcagcaagctggccaactaaaagctcctagcacttttctccaccacaagaaaaggcacacacacaaaaaacacattttgaaccaaaataactacaggagagcaatgagaacagcaaggtagccacagaaattctatagggcacaaaaagccagaatggctgcacagggaaggaaaggaatcaccttgcctccaccatctcatccccccagttggggtcagccctacccacctagggacaagctacttcagtcactgcatatccccatctcagtcactgctatatcctccccttaagaccaagctgaagggatgccccactcccaggaacccagagccttgaagtgctagaacagtctcacaacagttgccacagacaagacaatacccaccccccaccgcaggtacctcaggcctctggcctactggagaatttatgcctctggagccagagcagatgtggcaccctaccacctgggtacctcagacctcctacataccagagaagtggcaccccgcatggcacagccgaggtagtgctctgtcacacagggacctctggcctcctacacaccagagaagtctccttcaacaccatgccattggtgaggcagcagcccctcccccagcagggaccctggtcctccagcatattagagcagctgcaccttccagcacacaggtgacatgacaccatatacccaggaatccagaggctctactgactcacgtagctgcacttttagcagtgcctcacatcccagggaataagagccatggctgagctgtgccactccaccctccatgcccaagaaccagaaaacaccccatctacctgaaactagattagccctctactgtctaagctactcaggcacctcacctcttcaaggaatggagtcatctctgtgcttctctccaccacttgagatccaagccacagtggtatattaccattcctcagtccttgctgctgttgcacctggcctcttaaaacttaggttactaccatatcccaccatcttagagtacagagtcaccactgcatggttcctcataacctggagtccagccttctactgtgccctgttggttctaggtcccaaattgcagttgtgcccaaccccagggcctgagcctctggagcaccccttcctcgttggagccatacaagtgtggtgcctgctcccatgggtaagaaccacagctgcttcccaaccccctgggcctgagctaccaggttgtcccttagagcaacaaaccttagcttactggaagaactgcatccactcatgccttggagagtgattctgtgcctcaagtcccaggtgctacaagtttcagaagacaatgtgtgcaagagtctgacctcacgaccactctgagcatctgtgttgtggatcccagtgccactgtagctgcctgtgaaccacgtcagatccaacttcaagagagatcctctcagctaagaatccccactctaaggaagacaaaaacaggagaatccctaaaatccttgctctaataacctacacagtcactgtcactaccacaaattccttcagcctagaccactgaggctctgcaggtatcactaacattgatcacaactgaaaaaacttcacagagactacaacactgcactaacaaagaagcagagccaccacactctgccatgccaggaccctcaggcccatctgcagctaaatgttttcccttataaaagccactctgtgaagtttggaaggagtgaccgtaccaccagataggcagaaattaacacagggacacacaaaaaaatgataaagcaaggaaatatgacaccaccaaaggaccacaataattatatagtaattgatcccaaagaaacaaaaatttataaattgccccaaaggaatttcaaaataatactctaaaaactccaatgagatgcaagaaaatacaaatagacaattcagtaaaaacaggaaaacaactcatgatctgaatgagaaattcagcaaagagatacatgttattaaaaaaagaaccaatcataaatcttggagctgaagaattcaatcaatgagacaagaataaaattgagagctgcaacagcagactagatcaaacagaagagacagtttgtgaatttgaagatgagtattttgaaatgactcaaccagaggggaaaaaagaacgaaaaagagtaaagacttataaaaaaccatcaagcaaacaaatgttcacattatgggaatttcataaagagaaaagacaaagaaaacaatgtttacttaatgaaataattgctgaaaaccccccaagtcttggaaaagatacagatatccagatctacgaagctcaaatgttcccagattcaactcaaagagatcctcttcaagtcatattctaatcacgctgtcaaaaatcaaagacaattaagagtagtaagaatatcaaaatttcttacactcttccaaaaaatggagctagaataactacatcaaaacacattttatgaaggattatcactttgaaacctaagccagataaagacatcacaagagaagaaagctatgacaatctttctgatgaacactgatggaaatcttcaataaaatatttgcaaaccaaagccaacaacacatcaaaaaaattatacaacatgaccagataagatttattcctggcatgcaaggctgattaaacatatgcaaattgatgtcatacatcatattaacaggacaaaagataaaaaccacattataatctcaactgataagaaaaaaaaaagcatttatcgaagtccaacatactttcttgataaaaactgtcaacagtttaggcatataaggaaagttcctcaacataataaaagccatttatgaaaagcccatggtggacattataaaaatgaagaaaaactgaaagcttttccattacaatccagaacaaggcaaggatgccccctccttctattcaacatactactaaaagtaacagcaagaacaatcagacaaaaaaagaaataaaatgcatccaatttgaaaagaagtaaagttatctctatttgcagaggaaatggtcctacacatcaaaaaccccaaagattccacacaaaaaaactattaaaaataataaggttcattgggaggccaaggtgggcggatcacgaggtcaggagatcaagaccatcctggctaacacagtgaaaccccctctctactaaaaaaaaaaaatacaaaaaattagccgggcatggtggtgggcgcctgtagtcccagctactcgggaggctgaggcaggagaatggcgtgaatctcggaggtggaggttgcagtgagtcaagatctcgccactgcactccagcctgggcgacagagcaagactccatctcaaaaataataataataataataataataataataataataataataatttcagtaaaggatacaaaatcaacacatagaaattactacatttttatacacaattatgtaactgaaaaagaaatcaggaaaacagttccatttatgatagcattaaaaaaaaaactgaagcaagaataaaccaaacccaaaatgagtagaaaaaataataaagatcagagtagaaataaatgaaattgaaattaagaaaatacaaaagatcaatgaaatgaaaagttggttttttgaaaagataaataaaattgacaaacctttagtcaaactaagaaaaaaatagagaagatccaaataaataaaatcagaggtgaaaatggagacattacaactgctactgcagaaattcaaaggatcattagtggctactatgagtaactatatgccaatatattggaaaatctaaaacacatctagaagaaaactcctagacagacacaacctacaaagattgaaccatgagaaaatccaaaagctaaacagaccaataacaagtaaagagataaaagacgtaacatgtcttctagcaaagaaaaccctgaaacccaatggcttcattattgaattctagcaaacatttaaagaactaatacttaccctattcaacctattcaaaaaaatagagtaagaagagtaatagagtaatattggccattttacaagagcagtattatcttaataccaaaaccagataaagacacatcaagaaaggaaactacaagccaatatccttgatgaatactgatgcaaaaaccctcaacaaaatactagcaagatgaattcaataacacattgaaaaaaggtcatcaataccaagtgggatttagcccagaaatgcaaggatggcttaacacatgcaaattaatcaatgagatacatcatataaacagaatgcaggacaaaactatataaaaaccttcaaaaaactgagtaaccaaggaatatacctcaacataagaaaagccatatacaacagactcacagcaactatcatcccaaatgaggaaacactgaaagcctttcctctaagatctggaacaagacaagaatgcccactttcaccaccgttactcaacatagcactagaagtcctagctagaataataagacaagataaagaaagggcatccaaacaagcacaggcaatcagagcaaaaatgaacaaacggtatcacatcaagttaaaaagcttctgtacagcaaaggaaacaatcaacaaaatgaagagacaacccacagaatgacaaaaaatattcatctgacaataaattaataatcagaatatataagaagatcaaacaactctatcagaaaaaaaaatctcataatccaatttaaaatgggaaaaatagctcaatagacatttctcaaaagaaggcatacaaatggcaagcaggcatacaaaaaggtcatcactgatcatcagagaaatacaaatcaaaactacaaggagatatcatcttaccccagttaaaatgatttatatccaaaagacagacaataacaaatgctggtgagggtatggaaaaaaagagaaccctcctacactgttcgtgggaatgtaaattagtacaagtactatggagaatggtatgaagggtcctcaaaaaactaaaaacagagctaccacatgatccagcaattccactgctaggtataaacccaaaacaaaggtaatcagtgtatcagacatctgcattcccatgtttgttgcagcactattcacaatagccaaaatttggaagtaatctaagtgtccatcaacagatgaatggataaagaaaatgtacttatacacaacggagtactattcagccatcaaaacaatgggattctgtcatttccaacaacatggatggaactggaggtcaaattagccaacacagagaggcaaacatcacatgttctcacttatttgtgggatctaaaaataaaaacaattgatctcatggagataaagagtacaaggatggttaccagaggctgaaagggtagtgggaggatgggtaagaggaagggaagtttaatgggtataaaaaaatacagtgaataagacctggtgtttgatagcacaaaaaggtgactaaggtcaataagaatttaattgtacattttaaaataactaaaagagtataattggattgtttgtaacactaaggataaacacttgaggtaatggatactccatttactctgatgtgattattacacattgcatgcctatatcaaaacatctcatgtacctgtaagtatatacatgcctactacctacccgcaaaattttaaataaaaaattttttaaaataaaatagaataaaggctgaatctttgagagtgggaaaaaacaaaataaagggcatccaaattgaaaaggaagaagtcaaattaattatctttgtttgcagatgatatgatcatctatttgaaaaaaacctaaagactccatcaaaaaactgctagaactgataaactcagtaaagttgcaggatacaaaatcaacatacaaaactcagtagcatttctatatgtcaacagcaaacaaactggaaaataaatcaagaaggtaatccaatttacaatagctaaagataaaaattaaatacttaggaattaaccaaaaaagtgaaagatctctacagtgaaaactatataagattgatgcaaggaattaaagagaaaccattaaaaaatggaaagatattctatgttaatagactagaagaatcaatattgttaaaatgtccatactacccaaagcaatctacagattcaatgcaataccaatgacattcttcactgaaatagaaaaaaaatcctaaaattaatattgaattacaaaagacccataatattcaaagctatcctgagcaaaaagaacaaaactggaggaaccacatcacctgacttcaaattatactacacagctatagtaaccaaaacagcatagaactggcatagaaacagaaacatagaccaatgaaacagaatacaaaacccagaagcacatccatacaatcacagcaaactcattctagaccaagttgcaaagaacttgtattgggaaaaggaacatctcttaaatggtgctgggaaaactggatattcatatgcagaagtatgaaactagatccctatctcttaacatatacaaaaatcaaatcacatagattaaagacttaaatctaagacctcacactatgaaactattacaaagaaacactggggaccaaactccccaggacattggagtaagcaaagatttcttgagtaataatccaaaaagcacaggcagccaaagcagaaacggacaaatgggatcacatcaagttaaaaagcttgcacacagcgaagttagcaatcatcaaaatgaagagacgacccagaaaatgacagaaaattttgcaaactatcaacctgacaagggattaataaccattatacagagagctgtcaagatggctgaataagaacagctccagtcggcaactcccagaaaggccaacacagaaggtgggagagttcttcatttccaactgaggtatcaagttcatctcattgggactggctagacagtgggtgcagcccacagtggatgagcagaagtagggtggggcattgcctcaccggggaagtgcaagggactggcgaactccctcccctagccaagggaagccgtgagggactgtgctgtgagggactgtgctatccggcccagacactatgcttttcccatggtttttgcagcccacagaccaggagattctcttgtgtgccttcaccaccagggccctgggtttcaagcacaaaactgggcagctgtttgggcagacaccgagctagctgctggagtttttcttttgtagcccagtggtgcctggaaccccagcgagacagaactgttcactcccttaaaagggggctgaagccagggagccaagtggtctcactcagcgggtcccactcccacaaagcccagcaagctaagaaccactggcttgaaattcttgctgccagcatagcagtctgaagtcgaacttggtggtgggaggggcatcgccattactgaggctagagtaggcagttttcccctcatagtgttaaccttgactgtgagtaacaccacagcaaggcaaagtacctggggccagactgcctctctagattcctcctcactgggcaggacatctctgaaagaaaggcagcagccccagtcagcggcttatagataaaactcccatctccctgagacacagcacctggggaaaggggtggctgtgggcacagcttcagcagacttaaacgttcctgcctgctggctctgaagagagcagcatatctcctagaaaagcactcgagctctgctaagggacagactgcctcctcaagtggatgcctgacccccgtgccctctgactgggagtcacctctcagcaggggtcaacagacacctcatacaggagagctccggctggcatcaggtgggtatccctctggaacgaagtttccagaggaagaagcaggcaacaatatttgctgttctgcagcctctgctggtgatacccaggcaaatagggtctagagtggacctccagcaaactccagcagacctgcagaagaggggtctgactgtgagaaggaaaactaacaaacagaaagcagtaacatcaacataacaaaaaggatgcccacagaaaagccccatccaaaggccatcagcatcaaagatcaaaggtagataaatccatgaagatgaggaaaaaccagtgcaaaaatactgaaaattccaaaaaccagaatgactcttgtcctccaaatgatcgcaactcctctccagcaacggcaccaaattggacagagaatgtgtttgacaaattgacggaagtaggcttcagaaggtgggtaacaacaaattcctctaagctaaaggagaatgttctaacccaatgcaaggaagctaagaaccttgataaaaggttataggaactgcttactagaataaccagtttagagaagaacataaatgacctggtggagctgaagaacacagcatgagaacttcgcgaagcatagacaactatcaatagccaaatcaatcaagcggaagaaaggatatcagagattgaagatcaactaaataaaataaagcatgaagacaagattagagaaaaaagagtgaaaaggaacaaacaaagcctccaaggaatatgggactatgtgaaaagaccaaacctatgtttcattggtgtacctgaaagtgatggggagaatgaaaccaagttgggaaacactcttcaggatattatccaggagaacttccccaacctagcaagacaggccaacattcagattcagaaaatacagagaacaccactaagatactcctcgagaagagcaaccccaagacacaaaattgtcagattctccaaggttgaaatgaaggaaaaaatgttaagagcagccagagagaaaggtcaagttacctgcaaagggaagcccatcagactacagcagatctctcagcagaaaccctacaagccaaaagagagtgggggccaatattcaacattcttaaagaaaagaattttcaatccagaatttcatatccagccaaactaagcttcataactgaaggagaaataaaatcctttacaaacaagcaaatgctgagggattttgtcaccaacaggtctgccttgcaagagctcctgaaggaagcactaaatatggaaaggaaaaaccagtaccagccactgcaaaaacataccaaattgtaaagaccattgacaataggaagaaaccgcattaactaacgggcaaaataaccagctagcatcataatgacaggatcaaattcacacataacaatattaaccttaaatgtaaatgggctaaatgccccaattaaaagacacagactggcaaattggaaaaagagtcaagacccactggtgtactgtattcaggagacccatctcacatgcaaagacacacataggctcaaaataaagggatgaaggaatatttactaagcaaatggaaagcaaaaaataaagcaagggttgcaatcctagtctctgataaaacagactttaaaacaaaaagatcaaaaaagacaaagggcattacataaaggtaaaggaatcaatgcaacaagaagagctaactaccctaaatatatatgcgcccaatacaggagcatccagattcataaagcaagtacttagagatctacaaagagacttggattcccacacaataatagtgggagactttaacatcccactgtctacattagacagatcaatgaaacagaaaattaacaaggatattcaggacttgaactcagctctggaccaagtagacctaataggtatctacagaactctccaccctaaatcaacagaatatacattcttcttagcactgcatagcacttattataaaattgaccacatcataggaagtgaaacactcctcagcaaatgcaaaagaatggaaatcataacaaacagtctctcagaccacagtgcaatcacattagaactcaggattaagaaattctctcaaaactgcacaactacatggaaactgaacaatctacccctgaatgactactaggtaaataacaaaattaaggcagaaatcaagaagttctttgaaaccaatgagaacaaagacacaacgtaccagaatgtctgggatacagctaaagcagtgtttagagggaaatttaaagtactaaatgcccacatcagaaagtgcaaaagacctaaaatcgataccctaacatcataattaaaagaactagagaagtaagggcaaaagaattcaaaagctaggagaagacaagaaataactaagatcagagcagaactgaaggagatagagacacaaaaaaaccttcgaaaaatcaaggaattcaggagctggttttttgaaaaaattagcaaaacagatagactgctagccagactaataaagaagaaaagagagatgaatcaaatagacacaataagaaatgataaaaggggtatcaccactgatcccacagaaatacacactaccatcagagaatactataaatacctctatgtaaatataccagaaaatctagaagaaatggataaattcctggacacaaacaccctcccaagactaaaccaggaagaagttgaatccctgaatagaccaataacaagtttggaaattgaagcagtaattaatagcctaccaaccaaaaaaagcccaggaccagaccgatttacagtcgaattctaccagaggtacaaagaggagctggtatcattccttctgaaactattccaaacaatagaaaaaagggggactccttcctaactcattttatgaggccagcatcatcctgataccaaaacctggcagaaacacaacaaaaaaagaaaatttcaggccaatatccctgatgaacgttgatgcgaaaatcctcagtaaaatactggcaaaccaaacccagcagcacatcaaaatgcttatccaccacgatcaagttagcttcatcgctggaatgcaaggctggttcaacatacgcaaatcaataaacataatccatcacataaacaaaaccaatgacaaaaaccacatgattatctcaatagatgcagaaaaggcctttgacaaaattcaacagcgcttcatgctaaaaacactcaagaaactaggtattgagggaacatatctcaaaataataagacctatttttgacaaacccatacccatatcatactgaattggcaaaagctggtagcattccctttgaaaaccagcacaagacaaggatgccctctctctccactcctattcaacatagtattggaagttctggccagggcaatcaggcaagagaaataaataaagggcattcaaataggaagagaggaagtcaaattgtctccgtttgcagaggacatgattttatatttagaaaaccccattttctcagccccaaaattccttaagctgataagcaacttcagcaaagtctcaggatacaaaatcaatgggcaaaaatcacaagcattcctatacaccaataatagacaaacagggagccaaatcatgagtgaactcccattcacatgtgctacaaagaaaataaaatacctaggaatacaacttataagggacatgaagaacctcttcaaggagaactacacccactgctcaaggaaataagagaggacacaaacaaatggataaacattccatcctcatggacatgaagaatcaatatcatgaaaatggcaatactgcccaaagtaatttatagattcaatgctattcccatcaagctaccattgactttcttcacagaattagaaaaactactttaaatttcatatggaaccaaaaaagagcctgcatagccaaacaatcctaagcagaaagaacaaagctggaggcatgactctacctgacttcgaactatactacaaggctacagtaaccaaaacagcatggtactggtaccaaaacagatatacagaccaatggaacagaacagaggctgcaggaataacaccacacatctacaaccatctgatctttaacaaatctgacaaaaacaagaaatggagaaaggatttcctatttaataaatggtgctgggaaaactggctaccatatgcagaaaactaaaactgaaccccttccttacaccttatataaaaattaactcaagatggattaaagacttaaacataaatcctaaaatcaaaaaaccctgggagaaaacacagccaatacctttcaggacttaggcatgggtaaagacttcatgactaaaacaccaaaagcaatggcaacaaaagccaaaatagacaaataggatctaattaaactaaagagcttctgcacagtaaaagaagttatcatcagagtgaacaggcaacctacagaatgggagaaaatttttgcaatctatccatctgacaaagagctaatgtccagaatctacaaggaacttaaacatatttacaagaaaaaaacaaacaaccccaccaaaaaactgggcaaaggatatgaacagacacctctcaaaagaaggcatttatgtggtcaacaatcatgtgaaaaaaagctcaccatcactggtcattagagaatgcaaagcaaaaccacagtgagataccatctcacgccagttagaatggtgatcattaaaaggtcaggaaataacagatgctggcaacaatgtggagaaataggaacattttacactgttggtgggagtgtaaattagttcaacctttgtggaagacagtgtggcaattcctcaaggatctagaaccagaaataacatttgacccagcaaccccattactgggtgtatacccaaagaattataaatcattctactataaagacacatgcacatgtatgtttattgcagcactattcacaatagcaaagactgggaaccaacccaaatgcccatcaatgatagactggataaagaaaatgtggcacatatacaccatggaatactatccagtcatttaaaaaaatgagttcttgtcctttgcagggacatggatgaagctggaaaccatcattctcagcaaactaacacaggaacagaaaaccaaacaccatatgttctcactcataagtaggagctgaacaatgagaacacatggacacagagaggagaacatcacacactggggcctgttgcagggtgaggggcaagcagagggagagcattaggacaaatacctaatgcatgcggggcttaaaacctagatgatgggttgatgggtgcagcaaaccaccatggtgcatgtatacctatgtaacaaacctgcatgttctgcacatgtatcacagatcttaaagtttaattaaaaataaaaataaaaacaaaataaccattattcataaggagctcaaacaactctataggaaaagatctaataatcttatttttaaatcggcaaaagaaacaggcatttctcagaaggagacacacaaacggcaaacaggtatacaaaaaggtgctcaagatcaatgagcatcagagaaatgcaaatcaaaactacaatgagacatcacctcaccccagttaaaatagcttttatccaaaagacaggcaataagtaacaaatgttggcaagggtgtggaaaaaagagaactctcccacactgttgatgggaatgtaaattagtgtaagcactattttgagaacagtatggaggatcctcaaaaaactaaaaacagagctaccacatgatccagcaatcccactgctaggtatatacccaaaacaaaggaagtcagcatattaaaaatatatctgcacccccacatttattgcagcactatccacaatagccaagatttggaaacaatctaagtgtccattgacagaagaataaataaagaaaatgtggtgtttatacacaatggagtactattcagccaaaaaaaagatgaggtcctgtgatttgcaaaaacatgaatagaacttgaggccattatgttaagtgaaataagccaggcacagaaagaaaaacaatacatgtaggagctaaaaattaagacagtcaaattcacagagagtacaaggattgattaccaaaggctgagaaggatagttggaagggtgaggaggagatggaatggttactaggtgcaaaaaaaaaaaaaaaaatagctggaaagaataaataaaaccaagtatttgacagcactaccatagtcaatatgaatttaattgtacattttaaaataactaaaagagtataattgaattgtttgtaacaaagaataaatgcttgaggtgatagatactcccatttaccctgatgtgattattatatattgcatgcctgaataaaaatatttcacgaaatatgtatatttcatgttttaaaaattaaaaaacagctgaagaataaatttaacaaaggtgaaaatcctgtacacagaaaactataagacactgatgaaagaaattgaagacaaaataatgaaaaaataaatgaaaagatattccatcctcatgaatcagaagaattaatattcttaaattatccatactacccaaagcaaaatataggtttgacataatccatatcaaaatcctaatggcattcctcacaggaaaaaaaaaaaatcctaaaatttgtatggaaacataaagaccctaaaacaattccaagaatgaaaaacaaagttggaggaattatacttcctgatttaaaattatataacaaagctatagtaatcaaaacagtgtggtactggcataaaaacagacacatacaccaatagaacagaacagaaaacctagaaacaaacccaaacagatatggtcaactaatttttgacaggggcaccaataggatacaatgaggaaagaagagtctcttcaataaatggtgctaagaaaactggaatttcacacacaaaagaatctgaaccttataccatacataaagataagttcaaaatggataaaagacctaaatgtaagaccaggaactataaaattcctataagagaacatagtggaaaatctcctggacactgacgttggcaatgatttttgcgtatcaaaccaaaagctcaggccacaaaagcaaaaataaataaatggcactacttcaaactaaaaaggctctatacagcaaaagatataatcaacaaaatgaaatagcagcctacaaattgagaaaaatattggcaaacaatatatctgatgaggttaatacccaaaatttacaaagaactcatacaactcaatagtagaaaaacaaataatccaatttttttaaacaggcaaagaatctaaatagacatttctccatagaagacaaaaatcaccaacagctatatcaaaaggtatttaacataattaatcatcagggaaatgcaaatcaaaaccactatgagataccacatcacagctgcaaaggtggctattattttaaaaagtcaaaaaataacaaatgttgacaagagtatacagaaagagtaattaaaaatagaactaccatatgacccagtgatccctctgctgagcatatacccaaaggaaataaaatcatcaccttgtaaagattctgcattcctatgttcattgcatcattactcacaatagccaagatatggaaacaacctaagtgtctgttgatagacaaatgaataaagaaactgtggtacatatatacaatgaaatattactcagccttaaaaaagaatgagatcttttcatttaccacaacatggctaggtctggaggacattatgctaagtgaaataagccagacacagaaagaaaaatattgcatgatctcactaattaaatatggaatctacaaaaagaaatcaaatatacagagagagagaacaaaacagtggttaccagggacagagagggtagaggggatgaaatgggaagatgcaggtcagaggatacaaagtagctgatatgtaggatgaacaagtctagagatctaaagtataacatgagaactacagataataaaactgtactatatatgggattcatgctaagtaagtacattttagctgttcttgccacaaaccaaaacaaaaaaaaaaaatgggtaactgtgaaatgacagatatgttaatttacttcaatgtaataatctttatactatctacatatatcccataacatcatgttgcatagcttaaatgcacaaaataaaatttacaaaacaaaaaaagtatagttacatttaaacttgagttttaggggcaaggaaagggcaaatcagggcagggtgggtaagaaattttgggggtgatggatgtgtccttatcttggagttactctatccctatcacaactaaatataaagcaacagtaatcaagacagtggaatactggcatttggatagacaaataaactaggggattaaagagtccagaaacagatgtttgtgtatatgaacatttgatttatgacaaagatacgactgtaaagtagtggggaaagagtagtccttttaataaatggaagttaatcaattaaacattcacatgaaatgtattcctcctaattcataccacaaataccaatttcaagtaaatatcacatctaaatgtgaaaggtagaaccataagcttctaaatgattacataagagaacatcttcgtgatctaagtatagggaatgacttcttaggtcaaaaaagtactaatcacaaaagaaaagatggaaaattaaactggattaaaattcaatagacggtcccattaagaacattataaaaatgaaaagaaacaagaaaaaaagaagacagaacttcagcagtttcctttgtcaagtaacaggttccactctagaatttatgagaagagacagcatattacttagtaagttaaagaggaccttagagcaacattcttaaatgtgtacttcagctcctgtttagtatgtaaatcaggcaatagcacagatttcgtactgtgtgaactactgcaattaactaagaaaagcaccaatctgttaatctcagaaaagtcctttttttgaagtatgtgatgttttagatattttagactggtacaatgtaaattgaaggtgcccttggtacatccgaaaaaatctagaactttatgcaaaaaaaaaatatatcttgatattccacattagataccacattgccacacattaattggaaagacgttgtctacttcagcagaagacaggcattgtatcttcacctttccaaggctcttcacaaaaaacttaataccaaaaacacaaaagaaaagtatttttatgtagccaagtgtttattcatatttttaaaataagcaaatttcactacaagagaaattttcaaataccctattttcaaaaagatcaacttagttgatctttttatctcctagcacattcagccaataaattcaaactccaaaatgaactcaacatatctatgtaaggaactgtaaacaaattaacaactggagaaaaattatctacttttactaggaaactttcaatttgaataaaatatattaagagaaaatcttgctaactttccttgaaaaaaaggtattatgagaaataaataaatgaataaatacactcctgaagttgacaaatttgcaacagtttagtgaccattaacggtttcctcctaaaaagaaaaacaataaaaagaaatgaacactatatagactgtatttttttaccttaattccaccaaggatagtgatttaataaaaataaatcactgaacagtgagtgtcaacaatatgactttgagataataaagattgggaattaggagtattttcaagtggaaccatatcagacaaaaacagacagcaaagaggtctttgtagcaattgtaattacacacatgtgagatgacctgaaaatggggagtgctacaaaaccactgtgaaagaattctttacttctcaaatatcatttcataaaaactacagaaaaatcagagccagtaaaacttaaattatctttcaaatagtcatcataaactctaacctagttaaaacaaatgttgactgtaatatgctaatactgtaatataaatccctaaatataaataccaaataaatatacctaaatataaatataccaaatataagtacccaaaattcatgaacattttataagagctacaagaacacacttttagacaaaatgggacataccacccaaaaggttaaactctactaaacttcactgtgattatgaccagcctacccatcctctacatgtgaaataaaactttttattaaaaaagagatctcaccacttcttgtttctgggcttcattaagtttttcagtcaattcttccaaagccctttttgtttcggcatctgacctaggaagaaaaaaaaaaaaaagatttaaatttggatatttagaaaatacacagaacgagtgaaatgtataacatgataattatgttattacaaaatattctactttagtgattctcaaatgttataaacatctgaaacacgtggaaggcttgttaaaacacagactgctggatcccgccccccagatttcaaatcagcaaatctgagatgaggcccaagaatgtgcctttctaaaattcctaagtgatgcagaaacagaggtctgcaggtctggagaccaaactttgagaaccgctgctacgctggaacatcactctcaataaacacacaggttgcaatatctcccattttaaattaagaaaaaagagagaaagggacaaaagaaaacaaaaactcttgatcttacaccctctttctagcaatttataaagaaaagtgtgctgtacaaactctatcctcactaaccgacctcccattaccttgtttctcctcaaattaataacatacatgataaacaaacaaatcgtacagaaagatttacaatgaaaagaaaaagcccttctgtctagcactgtcttacttctggctgcacttccctctgtgaatcatgcacaaccatttccattattaattattttgctggttgccttcatcatgttcaactcgagacattttcgatggactgttttgaaatatttagctcattctctaatttcagattatgttattaccatttttagttctattggttacctgtagagttttatgtaatatatttatacatcttatgaattttatgaattattccatcctatgaaattgatggaattgatgctttgtgctcacattctgttaggctcacattttagccagcttcacacttggatcataactttcccgtgttcttgttttttccaagctttctcattatcttttggctttatatgggccttacttatcacatcattgatattttcctcccacttcttactgaatggtcaacaaaccatctatttcactctttttgaagaccttcttctcaaaggacacttactttcctgctctaatttagagtgaatacttcctgggcctgctccatgattgtcattccagggttactttcactgaatccccaggttaattttactgtttcttaatatctttatctttctatttcttggttacaatcttatttaacttatatatccttaggtaatttcctcaaaaagaagttaccttaaaaagataaattttcaaagactttaaacctctgaaaatgtctctctgtatgtatgtatagaatgttaaaatacattgctgtatatccacacagtggaataacaaagaataataaaaatgagcaaactgcaagaacctgacacaacacccataaatattagagcccctttcttggcttttgtggttctatgctatctagaatttcccccatctcactagctattccatctcagctcagctccttctatcataagattcctaaatattataactccttgcaactcagttctgtccttgatatcctccctatagtttctctcttggtattacccattcccatggttccaaatgacacttctccatgctgaccactcttaaattttacctcaacagagacttttcctttgagctccatagtaaatatccagctgaatattttactttccatttgaacgtctcacaggcatcttaaacatatccaaggccaaactctctacacctcacctacccaaaccagtcttccatatctcaggaagtggaattaccatctacctagttattcaaattgaaaatcttagagtcatccttattctccctcacccaccattaccaaatcctgtctctttgatttccaaaaacagtatcttcaaacaaacccctgtccatctctctcctgctataatcctgggtcaggccatcatcaactctcatatactagtgcaacagacttctatctcgccctcctcaaatcaatttttttttcctttgtgacaggtttcactctgatacccaggcaggagtgcagtggctcatctcagctcaatgcagcttcaacctcctgggctcaagcaatcctcccaccttagcctcccaagtagctgggaccacaggcatgtgccaccactccaggttaattgttttgtatttttagtagagatggggtttcaccatgttgccctgactggtctcaaactcctgagctcaaatgattcacctgcctcggcctcccaaaatgttgggattatgggcctgagccactgtgcccggtccaaatcaattcttcatatggcatccaaagtaggtgatttctgaattaaactttacttaatcctttctaaaagtttgcttcccagtgtacttttattattcaatgtatgttttgtaataaatgtcaaaagtgaaaaatcagtaattaaatgagaataccaacctttcaacatcaaatagaaagttaaactttttaacttcctgtccattatttttataaacatgaagtaagaatctgtagtacaagtaaagcagaacggcatccagaaattttacacattcacaaaggtaagccacctcatttcccaagaaacctaactcctattttgggtaaaacaaagttttctgcctcaaacatgcctctaggtcacaaagactattaccagatcttacaagcctagagatcacaaaaactattaccagatactaacagcccagtccaatattggttactcaaatcaccatttaaactaatcaactaaatcatccctgcaacttcccctgaatcttcttacaagacaactattccctataactcatgttcccagtgcttaatgtatacccttccttgaaatggataatggtcatgtaataaagccattcctacaatacattaaagtgttaatgtcattttgttaattttatcagcttgtaaaaaaaaataataacctaaatattaaattaactaagtcttaccagtttaaaaggttagcaatatagctcaataatatatctcacaatccaggaattcaaatgctttattcatatcagccacatgtgaaaatgattttgaaccaccatataccgtaagtgataaagaacagaggctttggggccttactgcctagattttaattctgactccactacaaccctcctgtttgatttctagagagctgagttatttcatctctctgtgcccatttcctcatccataaaatagagaaaaaaataatgattacctcaaagggtagttactagaattaaagttaaatcacgaaataagggctcaataatattagctaatagaactagtaataatggtagaatttttcattctcattacagcctatacttgatattcatagatttaacatttatagttttgactatctttgttgcagcaacacagaactggtgtgtgggatgatttagacagctggagttagcaagcaaatatggtaaacaaatttcaattcagctttattgttcctaatatttgctgtatatggattgtaattcttaagaaggcataaaaatctttgtttttcagcaaaacatggcctccaaaagaaagccacctgccactggtgatgacaaaaatgaaaagacagcaaagaagttttaaattaaataacagctattggggactatccagaattgacaaaattgtgaagatggggcagatgttaaccactgaccctcaaagatttcaactaaaagctaaagtattggattctacaatggcttatgtccactgacaaactccatgttacacttcttttttggtgtgtgcaatgccaaaagtcagtcaggtagcgagtcggtctttgtgtctctctctccaatgtatttgcaaatctacctctttgcaaaagtctcacagtgtacccctccataatatcagcattccattgtattaagttaaagcgtttttagaaaaaggaaattaatttgtctaacactgagtcatgatatattctaaattcaaagggctgtaaactgttctgttaataaattttaaggtactgtatacaaacacaacattttttaaaaatctagataaatatgtcaattacagaagctaatttattctcctcataatttatccctcccataaaaaccataggctgcttttaccggctccttctggaaagctccctgttgaaatcatctccaaggcgaatttgttcactgctgaggtctcgaagagactgatgaaaaccatgaagctagcaaaggcaaaacacagttatccatttagaattctgttgaattcttccatgaagattcaccaaaggtaagaataagatcttgttccttgcaataataaccagattccgtaatattattatgaaagaaaacacctactctgaaagaaaaaaattttccaagaaaaacaaatttttaaaagctgtatataacatttatcaacacattttctacagtacaattctactcctccagaattctacccctctagaaggggtctgcttcttccttaatcagagcaaaagaaaaagaaaaaagagagagcgagaaagaaggagaaaaccggtctgccaatttttctgtaaagggcccaatagcgactattccaggattacaagctatatggtctctgtcacagttaatcttgccactgtagtgcaaaagtaactgtaaacaaataagcatggctgaattacaataaaattttattctatcagcctataatgccttagtttgccaactcctgctgtacagaaactcttcctcatgtacacttggaaccatgtacaagaaagtatggtacagcattattcacaatgagaacatgagaaaccaaatgtacaccaagataaataaatggtggtatattcctccaccggagtatgatatagcagtgaaaacaaaacaatcatagatacctacgcattagtaaagctgaatgtcaaaaacataacatcaagtaaaataagcaagttacaaaagattacagtagtatcccataaataagatgtaggtagtaaaaattaaaaaagtaaaaaaattgttttttaaagcagaaacagtgtcaggatatgtatgaagtcaggacagtggataccccttgggaaaagatggagtataaaagaggcttggggtggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaataaataaaagaggcttgggggtatgataatgctttatttagtggcctgggtgagggttacatggtgttcattctcattattgtaactttaactgtaaatatatatgctgaatataaatagtatgatttataataaaactacgttaaacagacttgcagaaacaacaaattgattcatttcaacaaaatgcacattaagcaatttattagtgccagctactgagaagtggctcaaaatctgatatgagagccagatatgtaaacaaaccacaaattttttacgggggcattaagaaagtacacagtcaagtggagctaagggtaaccttgagaatgaacttaatgaggaagaaccataaaaagaaaggagtgaagtagtatagtgaatgaaaaacttaagttttgccatcatgattttccaatttagcaaaccagaatccggggatgcatccttgacacctccttttcactcattcctaccttccccacatggctatctaattttcaagacctttccattttatccactaaaatgcttttaattctacctccttctctccagctccacctatcctaatccaagtgaccatcaattcacatccagaacacagtaacatccttctaattggttcacccacattgaatccattttccacactacagccagagtgatcttttcaaaataattttgtcagccctgttacacggctctacataatctcagcccttcatacttctttagcctcgtgggccttctttaaattgctcataggggctatcttccctcctgccaagccatttgttctacctagaatgactcttactcaactttcagatctcagctcagtcagcctttcttcaggaagccctccttaactggggcatgtcctctaccatacaattctgtagccctatgcatctttccactatcgcatgcatctcagttcataaataaggttgtatttatgtatttatttaatatctagctcctcctctagaatataaacttattaaaagacaaggtttctgctcatcactgtttccaagtgtaagcattatcccaatgacagagacattaaataaacagaaggaaagagtaaatgaataatgttaagatattgttctctgttctgggcttcatcacatagtccatgctagcaaggtgcaactatcaaaaaaataacatagtcaaggaaaagtttccacagggtgtttcctaatgcatttgattgtgttgtctcgttatgcagtaacaagtgacagctacagatgagtatcttaagatacactttgagtacctaatcctaaaactaccaaaacaaagaggtcaaagtgcagaactcccccagcccttttctatttaatttagctacttaagacaacaaaaggaaaaattacagctctgcagagaactttaaagaagcagaaaaagatttccacacaactaatacttcagaaatctttagtgaataaagtatggaatttcttacttagtagaaaatggctctatcaatgattcaacaatcagaaaaaaacactaatggtagaaaaatcagtagatcaatcacacaaagattaacttgttcatactaaaccaaacttagtaaaatagaaagtagcagacttagcagggcttacaaaaaatgtgctgaacaagaaaggaaacaaaacacgtccaattaaactcacttttaaatgttctgcaatatataatcctccataacaaaactcaaaacaaagatactttgtacattgaaaataaactagtttatctgaaaaatcccatattaacaatcttacattcatatagaatgacaaaagaccccatatagccaaaacaatcctgagctaaaaagaacaaagctggaggcagcatactccctaatttcaaaacattataaagcaattgtaatcaaaacagcatggtactagaaaaaaacagatgcatcaatctacgaacagaggagaaaacccggaaataaacacacacatttgcggtcaactgattttttatgaagatgccaagaacacacaatggggaaaggatagtgtcctcaataaattgtgttgacaaaactgcatatacatgctaaataatgaaattaggcccttataacacacaaaaaagtcaactcaaaatggagaaacacttaaatataagacctgaaactgtaaaaccactagaagaaaacataggcaaaaagctccatgactttggtttaggcaatggtttcttggatatgaccccaaaagcacaagcaacaaaagcaaaaaacaggcaaatgagatcacatcaaaatataaagcttctgcatagcaaaagaaacaattaataaagtgaagagacaatccacaggatgggagaaatatctgcaaaccatatgtctgacaaggcgttaatatccaaaatatataaagaactcaaacaactcaatagcgaaaaaaaaaaaaatttaaaatgggcagaggacctgaacagacatttctcaaaagaagacatacaatggtcaataggtacatttttaaaaatattcagcaaaagtaaactttaggaaaatccaagttaaaaccacagtgagatatcacctcacacctgttaaaatggcttttatcaaaaagatgaaagataagtgttggacatgacatgaaggaaagggaccccttgtaccctactgggaacgtaaactagtacagccattatggaaaactgtatggagggtcttcaaaaactaaaaataagactactatatgacccattaatcccatttctggatatatacccaaagctactgaaatcagtatgtcaaagggatatctgcactctcatgttcattgcagcattattcacaacagccaagatcggcaaacaacctaagtgtctatcagtgaatgaatggatacagaaaatgtagtatatatacacaatgcaatactattcagcctttaaaaagggagaaatcctgtcatttgcaaaaacatggatgaatctgaagacattatgttaagtaaaaaaggccaggcacagaaagacaaacactatatgatcccacttgtgtatgaactctaataaagtttaactcatagaaagatagagtagaataatggttaccagagggtggcggggagagggggtgaagagggagagaaaggggagttgttgatcaaacagtccaaagtttcagacagacaggaggaataggttttgagatgtattgcacatcaggatgaccaatgtcaataataatgtattatatatttcaaaataactgagagaataaatttcaaatgtctcaccataaaaaatgataagcaaggtgatagatgttaattaacttgatttgatcatgccacattgcatacatatattaaaacatcatattataccccataaatgtatacaactatgatttttcagcaagaaaacaataataaaaagtaaaagtcgtttacttggttccaaaaaaagggatcagtataaagttactaatgatcaaattcttggttaaaatatagccttaaagttcaagcattagtcatttatatacaatagaagcataaggaaatactgcacacaaattacagaatggtacaaagtacctgagtcatatcatcagtctcttgaacaaaccggacaccagttcttgatctcattcgtttaataccctgtggatccccatagtccttgagaggtgaggtaggtggaaaatgatggagctcttcacaagtgaaagaaaagggaaggtattaaaatactgcatgagaagagacaatctaaaattttactcagtacaaacatggcagacatggatatacatatattcatgtccctaacccagactatttcccaagtatcttgctatggccataaagttccaccaaattagcattaatcatgctcttaaagcagataaaatgaacaacagaaataacctggaaatagaacactcaaaagtttcaatttgttatactctccaagaagcaacatattttctcatacaaaaataataaatttctaaataaaaaactcatatgaccccttaatataacttaatactaaaaaaaacaacttttcaaactacatagtctacaatctgaacagcatataaaaataaaaactaactacatgaaaaaatagtgcccaatttttaatcattgttaccataatcaacagtaatattaacgatgtaaggtaccaatgttcaattatctaaatcaccttccttcactgcaggcttttcgattcaaacatgaatctcagtgctatacaaaagtgtaagtaagattaattaagacaaactgtcataagctttaagctagccattcatatctacctgcatgccaagactaaaattcacctggtcttaacaagcatcacagggtatttcataaaacatgtgaaaatctattacgctaggacaggatacctaacctaaagtgtatcacatagcgaatttatgtatttgttttgattctttggcagcagacaattaaatctaagtttttgtcaggtaaagctctaatgtggtctacagagtttgagaaaaaaaaaaaaacaatataacaacaaagacccttcaatatatttcaaagcatgtactataaaatccttgacaactacatgtactatcatccaatctgcatgaagttatgtgtgggtcatatttctccaaaaattaaatgtattcaatatctacttcaaaaatatttttaatgtttttcagaacatttgaagtgtttacctgacccagtgccaccatcaaggtcacttgcactcaaacttgtaacagaaatacttctccctcctgagtttctcaataaacgttgactccggagttggtcgattgattgttccaagctttcttttaactaatttaaagaatataatgaatgaagcgttattcttcttaaacaacttccaaatacaaatagaccacagattttcaaagctatttctgaaatatctgggttccccccaaaaaaaggtatcagaaaattttaaactaagttatgtttaaaatataaaaatagtaaatacaaatattttaagaaccaatgctaaaatctggttttaaaaggcatctgtcactacctattccattttttattgccagatgtggaagagatgtctactgtgtaagggcttacaaaaccaaattgaaatgtctaattggtgcaccactcatgcgaagaaacataacaaggtcaacacaactgaaagaagacagaaagctttcctcccttctaaatattccttcagaaactccaggtctacaacaaataggaaactaaacagctgtcacagtgacagctgctactgaaacaatgtacactgtccaactttatcagagtacctctttcagtcattcaaagacttcaaatcccagaaaatgattgggtcagatatcagactgccagtacacactaagaactacagttgtccaaatgctttattcagtttattaaggagtcagccaacagggaacatataaaaacatacctttagacttaaagagctacattaaataaaaacatgctaaatactgagaataatgtccagagctgtacacaactataggcctgagaagaggattcgactaagacccaagggaaaaaaaattaaagctgaagaaaatccatacaccctgaattgctgggaaacttcgggtctagatatcttattcaaggatgaatagaaagtaataattttaaacataatgcatggatccatggaacaagtcatctataactctttaagtagaatgtcaaaacaaaatgattagttgagaagacaaggtttcctaaattcagccagcgttaaaaggtagaacaccatttacggggagaacaagttgctttacttggtgaaatgagcagaaagaaaggagcctcaaccgaaggaaaagaacagatgaaacagaatgtgagtcacaaatgaagcaaaccctttttcagtctggctatttggatttggctgctctaattgaaacaatctgtattaaaagaagtagagttagaatttcaggaagctgcttcttttgtccctctcatttccgaaagaaaaaaaaaagaggggtttccacacccctctgtctcctccttacctaaactgggatatgtacaataccatcctgccttgagtattcgccagccagctataagatgcagcatcggcggttgctcgcgcctgtaatccctgcagtttgggaggctgaggcggctggatcactaggtcaggagttcaagaatggcctggcaaacatggtgaaacctcgtctctcctaaaatacaaaaaattagccgggcatgatggctggtgcctgtaatcccaactactcgggaggctgaggcaggagaactgcttgaacctgggaggcagaggttgcagtcagctgagatcgtaccactgcactccagcctgggcggcagagcgagactctgtttcaaaaaaaaaaaaaaaaaaaaaacctcagcatcaatccacaaaacatactatgaggcccaggaaaaccaaggtttaccttgagagtaatttacacataagtaaaataacatataagtagaccagaggtcttatgtagtgatcacaaagtagtatatcagtaatctatgacaaaattatcagaataaaactaaacaatattaaagctaaaaagctcaaattcaaactgtaacatgagaaacagactagaaaagtcactacagtgattttgatcataaaaattagcgtcagaaataaaacgtaaaatcagctctcttaacttttgctgtgtttattatttccatctttcaagctaaactcaatttcagtatccttttgaaagcagagtcagctatcatttcttactactgcttctttttgaaggtaatctgccttttcagctctggctatttttaagattttctctttacttttgtcagtgattttattatgtatcattatgtacagttttatttgtatttatcccatttccgacccacagagatcacaaaatccatagcttaataaatttcatatgttgtaaattctcaggcatcatcttttcaaacattgtttttgcctcattctctctcccctctccttctggaaatgcaactgcattttagttatacctttttaccaaatgctgttatgtcttcttttctcttctatattttttcaatctttcattcttccattctttttggatatcttatgctggtttatctttcaattcatgaattctctttcaactatacacaagctgttgttcactctattcattcaaggtcagttggttatttatttatcttatttttcagtttctgaaattttcatttggtgccttttagttttcaattattttccaaaactcttaatctactcttttaatttcttgaacatgttattcatggttaccttatagtcccatatatgtttctattgtctgcttcttcccttggttttcagacaccttttatattctcttatgcctgtgtattctttatcatgtgatagacattttacatgagaagttgtagaaataatttaaagttctagaggatgacatctttcttcagaaaaatctggttctgcttctaatagaaagtcaggttagggtcactagcaatctcaaatcaccttaacccagttaggaactgaagtggttcaaggactggcttctgtcaccgtgaaggctggtctattttcagtttatcacttctcatttccaattcaccactttgcctatactatcaccctttggggtctccattaaagctaaagggttcctgaactccagctttggtcttcctagcctcttaagttaattgataactctgatcctagcctctctgcttttaatccacctctttaggaatcagctatcatcttgaaggaggaagaaagtcccaaatataagacttacccttctggacttaagttttttgccagattctgactacataattcctcactgccttagtagttctttgatggattcataatattattttttacttttttttcatgtttctagttgttctcagtagaagagttgatctgaaataatcttacctaccaatgccaaaagcagatcttgccagcatcctttttatgtaggcttatttgctaacaaatcctaagctgtaactaaaagctcagaaataaagtgaattttcacacacacacacacacacacacacacacacacgcaaactccctgccaccaaaagaaaaaaagttaccatgggacataacagaagaacattaaagaacaagagaagtgaaacacttccccaaaatctaatctatcaaccccattttaaaactctaaaaagatatatccgaagccattgaagatgaataggatgatttttaaggtccaaaaaataaaattacgttatgtaaagggagatgaatgaaataaaggcgattttaaattactcttccaagcattatggcaaaaacaatttttgcacctaaaacataaaactaaaaatgtaatagaattaaaatctacactttaagtagtcacaacacaacacaacagacactgcacaaaatttagtgatgtatggagccaatttgataactcctaaaacacaaaaaccaagaaataaagagacaaagtacgaagtcataaaaattgttttaaactcttttggattataacatcttactaggtgtaacgccaaaccaaacaaaattaaataaaaacaaaataatattaataaaactcaatctaacattttctatgatggatgatgttattttcctaaaactaatcaatcttaccaaagactgtggtactaactacaatgttataaattcttttgagtctactaggactacctcaccagataccaaatgatgatcctattttcccccactttcccctatatgaaatattgtaaaatggacatcatagaacataatataatgtatattaatatctcacttgatataaatgcatgatttaaagattaggtctattcttttacctctgttcttttgatattagactgaaacaatggaaactactgtgcaccagtataaatgcaaataaaatttgggcactggaattgaatggctatgatctggatctgggtcctcaccgaattctcatgttcaattataattcccagtgttggaagtggagcctggtgagaggtcactggatcatgggggcagagttcttatgaatggtctagcaccatccccgcttggtactgtatagtgagtgagttatcatgagatctggttgtttaaaagtgtgtagcacctccccactccttcccgtgctcctactccggccatgtgatgtgtgtgcttcccctttgccttccaccatgattgtacgtttcctgagtcctcctagaagctgagcagataccaacatcatgcttcctatacagcctgtggaacggtgagccaattaaacctcttttctttataaattacccagtctcaggtagttctttatagcaatgcaagaatggactaacacaggtagtttatccaaatcatcaagacatgctttttctgacttaagcatgtagtaggctccctctagccaaagataaaacaatttgagcataaataaaaatattaactgcaatggactaaaacactttaaatatgcatataattgtaagttaataatgatactcaaggggtaaaaaaagtcattggtcaccacaagaagatgtaggaaaccaattattttggaaactgatatataaatgaactgaaaaataactgtagatgcttttagattaccatgaaaataaaataactaaattttaaaattctcacagagatctctgaaagccttttgatatctctatttggaaaaactctgattagaaacaaaatgtaactcaaggttaatgaactcaaaaagaatgcatataaaacgcaaaaggattgactacactccaacctaaatctatgaaaggagatcatctgggcaacaatgggtaatgcaaataacagaagtgatcatttaaaacattataattcaggccgggtatggtagctcacgcctataatcccagcactttgggaggccaaggcggaaggatcacttgggccccggagttcaagaccagcctggccaacatggtaagatcccatccctactaaaaaagtaaaaaataaaaagtagccaggtgtagtggtacacaactgtagtctcagctactcaggaggctgaggtaggagaattgctttagcccagtagttcaaggctacagtgagctgtgattgtaccactgcactccagcctggataacacagtaagactctgtctcaaaataagtaaacaaataaaattttaaaaatagaaatatgtgattcagaaggaccaaagaaaagcttcatttgctttcttcagctgtactacttttacttctgcccccgctcttttctgcatctttcacaccccatcagataactttctaactttcttacatgttttattttgtggatgaaataagatgatctatgtaaaataattagaacaatgcctgaggtagatttggtcgttcagtaaatgatactttttatcattatgattaaaggcaatgacaataaaagtaaaaaataaatagaatgatgaaatagaatgctttaatctggagaagctattttaaagagtttgtcattccctaaacatgtatttacaactcagatggaaatacctgttgaatttatttacttcccacttataaaaccactcccgggcagggcacggtggctcgtgcctgtaatcccagcactttgggaggccaaggcaggcggatcacaaggtcaggagatcgagaccatcccgaccaacatggtgaaaccccatctctactaaaaatagaaaaattaactgggcgtagtggcatgcgcctgttgtcccagctattcgggaggctgaggcaggagaatcgcttaaacctgggaggcggaggttgcagtgagctgagatcgcgccactgcattccaatctggtgacagagcgagactccacctcaaaaaaaaaaaaaactactccctcagaaagtttagcattattcaactctaggcttaccacagagacttgatgacaatggatccctcgttgaaaattgctttcttaacattacaatatttagtgctatggaatatatcatacctcaaattgggtatacataatttaatttcccaactgcccaattcaaaggaaatctgctaccctaagtagggatctaatattcaactttacaaagtaggactatactctactaatggttaataataatgttttcaatttttcactaataaattaaaaagcaaagactcaattcccattattaataaggtaatgaatctgaaacatttcatgaactgcccaaatataacaaagtctatagagctccattggtcaagtacatcataaatcataaaaatcctgtaaatacaaggatgtccaaactcattttctaaataaaaatagtagaaacccttatgagagaagatatgtttccctgtgcccattagcttgcaattacaagtgattaatgacaactatacctttacttgtaaaaaaaaataataataataacaagccgtcaattacaacttgggagttacgtgacaattcaatacaacacagatatgtataaaacagtcattattccttcatgtttccaatgataggtacatatacaatgtgattttagtgttttcatcacactgtatatatacccctcattagaaacatgaaggaataagtttaattggttttccaagagtttacaggacaggagtaagcaattccaaaggaaagaaaagtagaagatagaattagtaagacattaattaaaaatacattattaactttattccagaactctggagtacatttttttcttacatccccatgtaaagtaagtataaactggaacatccttgaaagggcaattttgaaatatccagcaaatttttaagtgcatatatcctttaaccctgcaattctacttccagcaatcctacaggattacaaaaacatatgtatgtgtgtgtacaataatggtcactgctataatgtttataataaaaagaaaaactagatacattcatactatggaatacggtataactgttcaaaacaatgaagtagtgctacacaaagttatatggaaagtgatatacattattaaattttaaaacgttgtataacattatatttaatatgattccatttttaaagcaaatcgcacatatgcttgtaaatacatagaaaatgtttggaaacaagctctcaaaattgttacctcttttgagtggggctcaaagggaggttggatagaattggaggccattatcctaagtgaagtaactaaggaatgaaaaaccaaataccacttcttctcgcttataaaggagagctaagctatgtgtacataaaggtgtacagagtggtataatggacattggagactcagaagggacgcaaaggtatacagagtggtataatggacattggagactcagaagggacgcaaaggtatacagagtggtataatggacagtggagactcagaagggaggaggttgggagcagggtaaaagatgaaaacctatctattgggtacattgtacactatttggatgacaggtgcactaaaatcccagacttcatcactatacaattcatccatgaaaccaaaaaaccacttgttccactacagcaatagaaattttaaaaaattaaaaaggggctttgagagaggattttttcattttttgttttaacaataaacacatattactttaaaataaaccatccttaaaattcttaactctacatgaggggtctctccatggcccaagtttaccaagtctccattaaattcatgtcttgaattctactctctctgatgtaaagccttcaaattcaatagaatctaatttatataagctagttagcaatccatctgacaagctaacctaaacttaaactataaaataataaatcagtttaaaatctaaagcacttcacaatggttttttcctttagctcacagccccattccccaaaacacttcattcccaaaaaggtgggtaggagaaaatgcaaacaaatgtagtttctcacatgttctatcgcacccgcctgtccattactgtattctcggtatcgtccaagcatctggtccacttgtcgcaggttccgactggtatccttgagaaagaaaatggactgaattaattattccaaatacttttttttcctaatcaatcttagtagtatgtcaatcaactaagtcaacagtttgtaaaatgtacaacttttatcatggctgagttgaatatcaatgtacttcacacatattaagtaaatcttaacaccactgagagaaactcaaatccaactgcaatttacttgtgtaaaatctgaagcacataatgtaaatccgtattcaagattccctagtaagtcagcaacaaaaccataaattctcagaatcataattttcaatttgtgcccctcaaccaattcacaccctctttatagaaaaggaattctgaaagagcaaatctagtagactgtgtacaagagaagaaaatcattaagatcaatgtgattttgactattcttttacctcagaacttgaggagaagaaaaacaacaaatttaattttaatcacaaaagaaatggttcttatctaaatattctagatttcacctgggagattaatcaaggtatttctttcaaaaatatatacttattaatgtgtctcattgttgggaaagcacaagaattcatactacaaaattccattgttatcttactttacttacttacattttacttactttacttacttacttacttattgatgagaaagggtcttgctctgccacccaggctggagcgaagtggcatgatcatggctcactgcagcctcagcttcctgggctcaaggaattctacaccactatgcccagctaaattttttttttttcctaatttgtgtatagacacagtctaagtatgttgcctgggctggtctcaaactcctggctcaagtgatcctcccacctcagcctcccaaagtgctaggattacaggcatgagccaccatgcccagcccattatgttactttaaatgagtttaaaaaggataggtcctctggttttcaaatcaatgcatggcttcgccaccagaaattaccctcttcttatctaagcatattaatccaaagcaattaaaagccaaaatccattcttagccaggctaaggcaaaggtaagggattaatgcgtaggaaataccttatatttctgagttttctttttttcccctatagctgtgttacacttaccccacctcttttctaaagccctttctaagaaaaggaagcaaaatgcctcaactcaaacctccaaatactagcaaaaattagcctctaaattaaaatggcacctctttattttcacccacaaataatctacctcaccaaaacatgagtaatttctctaaaggcacatgcccatgagaagctaaactacaatcatttctactggtttcactctcacgatattttatttggaaatactgctttaccctaaaacactctccaccacctatcacatatttcaaatatctttaccaactgtcataggcagaataatggccctcaaagatatccaagtcctaatccctgcaacctgtgtatgtataccttacacggcaaaagggattttgcaaatgtgattacattgaagacttttagatggagagattctcctggattattgggtggacccaatgaaatcataaacatccgtaaaagaggaaaagggaggcaggagaagtaaagtcataggatgtgagaagggcttgacccttccctgctggctttgaagatgagggaaggcagccacaagataagaaatgtgggcagcctctagaaaccagagaaggcaaggcaatagatttttcccttagagcctccagagaggaacacatccctaccaacactttgagacccagtgagaccagtgttgacttctgatgtacaagaccttaagataataaatttgtgttgttttaagacattagctttgcagtaatttgttacagcagcaagaaaactaatccactgactgaaactattaagcagctcaaactatttaaattctattaaatgcaaccattgttaaactaacctgtaaagtacttgttatagtgttgaccttctcggtaacttctactgtaggaagacttcgagttcccctgtgcgttgatctggcagcccatggactcaatcggtcacgacagcggaagtgatctgattcgctggatgattctgccattgatgtacacaaatccttttaaataaatataggtcaaagttaatgaaacagtaaaaagcatggaaataaaagactaatacaacagtttacttttgatctcttttctatgtttaatacattagtaattttgcacactgtaatttctacatacatagcttaaaaacacaagaagtcacttccccatgtaattctccctcctccattgtctctgctttaagggagcgattcctcagatatgattttggtcatgtttacaactccagtgataataatcccttagattcatgcaatgcttccaaattttaaaagtattgtcacatttagtacctcacttaatcctaccaacaacaccataaggtagatgagaaaaacacagatattctctaaagttaggaccagcaagtatcttaatattcatccaatgtccattatactataagaacacaggtaaaggccacacagcatgacctacaataaggcggtctcactcagtgtacattgacaactctcatgtaccttgatttcaaatagagtagaattaaacaaatgctgtaatacagatacaaattctacaataacagatacatgagaaggtggcatcttcaacatctccaccaaaatagaaagccagacatcctaagtatatgcatcagtagataattctctaaacatgcttttcttccatccttacctcagttttctatttaatacattaaaaaaaattatttcatgcaaaggaatctcaaaagtttcaggaaaccttttaatagaagttgaagaaactaagtaagttcagaacaaagaagcatcagagaaactcaactgataaaaagtgaaagtatattgagtatcccaataatttcattttctacttactggtgggttaacattattttaagattaattgctagaatcttcctaaaatctatatggccattttgctggctgattaaatatagtgtgataaaaacatttcttttttgttttgttttcttttgttttttgagacagaatctcactctgtcacccaggctggagtgcagtggcacgatctcagcttggctcactgcaacctccgcctcccaggttcaagcaattgtcctgcctcagcctcccgagaaaacatttcttgaatgacagagtatcttagacttccaagatctttattctgaatgcatctggaagtacattgatcatacatttaaggagacaataaagagaatgtgctaaatgtatacatgtcctaaagcatttaatgaaagcaactgtgtttttaaaatattggatgaaacataactaaacaaataaacaagaactcttgccataaggttaggttttttttaaatgaaatacagtctgttactgctgtatcaaaaaaagaatcaatgaaatagccaacttcttcacagtagctaagacagggttagagaacatcctgttgaacacccatgcttctcctctgcccagggctcttaacttccttctgcacctatcttctctggttcttgcctgtcttatcccatgtataattacaaaggtatagtacccatgatgtcactccctcccaccataaggaaacatgaacaagaaattaagactgaagcaattgtttggctttgtttttcctggctcacaattgcttaagtccaaaggaaaaaagtattttctttagaagacaagacatcttacatataacatcttacatataatgttcaccttttaaacttcagaaatcacttgtatgcatctcataaatctatgccacataacataacatcttttactctaagttacagtacttcccatcaagcattttccattagtgaaagcaggaaaaatcaacattttctaagactctgctattctgccaagtactatgcagatgcttacataagacaacccaatttaattctcataacaacttattaaagtgaacactattaacccctaattcatagaggatgctactgctaaaagatattaaataatatccaactccatacagtaattataagtagaatgcaaacccaagattcagctggctttctctgtcctcaacactatgttcttcccactgtgttctgctgtccgattatcctgagaattaacaatcttaacaattaacaaaaagtgctaaagagagcaggtgcaggccagagcctacatgtgtgtataatcttctcaactccctctcatttcatgtcagcataaaaatatcaagaaaaaagggaaatatcaaataataatataaaatcttaactaggcaccaggaaaaaaactaagtgacatatctatactaatgcatttaataaaaagccctgaaacaaatcaatccactggtcccagattaaggggtttttgtttccttattccttttatctcttatataagagaaaataataattatgcctggcatctgtctctttcatatcaaaattctatagcttaaagcataataattttcattttaacaagtcataattctggaaacttgattgaagttaagaaatcactgaagttaagaaatcaggcagaataaaaagttaatattgaaaaagacaatgtgcttactataatagttgttaatgagaacaaggaacaaaataactgtctttgagataacttgatatttctaagagtatcaaaattttaataataatcagttatctgaagacaacttcaccagatataaatggcatgtcagacacttctaatacgtagacaatttgagtttcaacatgactaaaaataattataactgaaatttggggatgatatttaagatacaaaatagtacagactaataaacatgcatgtatctatcaccaagaactaataaacattatcattctgacatatgtacctttgagagtttttagtaaaatatttagaacactgtaaataaagtcttagtaccttccaaccacccctccttcacccagtactactcctgccccattttcccagggataatcactagcatgatttcatgtataactctccaggctatgtttttatactgttcccataggcatgggtacctcaaagtctttttttataaaacacactgcactgaattgataaatattaataagtaaagatacgggggcatctgaatttaactctaaagcagaaaatcttactggtattaaaaaaaattaagaacaacataaactaaattatctctaatcgtcatacaatacaagaaaaaagaatgatctctcaccaccactaggattacatacttttactaagacagaatcacaagttccggcatgagtttcactagtacacacacacaaagacttcagctataaagttaagttactgtgagcaataaaagatgttcaaactcctgcatctgatggaactccttcagagacatcaagatttaaggtgagatatatctgagaaatttgcatggctttttttaagcatatgaaacattcagcaactatctaaggactttaattacctaagtttcataaatgttaaactaagtaaaatttttaaatctcattataataaaaaataaaagttagattatttacattgttgataaaaatctggcattttcttccactcttactgacaacacaaggtcttacatgattcccatagctaactaacagagcacctaactaaccctttgtgccacaacacagaaggcagctatagtggcagaaatccatccttaccaagaatctccgatctatcatcagccaacaccactacaacccagacacaggactgatggagagagaaacagatgagaatggagtggccgctgaagttggcaagaggctcacaccacataatcagaacctacagtagaatgcatggagggccatgaaaattctgagagcctcttaatataactgactcaaaaagaaaagtacaaagcaatatgcgtcaattatatactcttcttttgtcattaacaatgtattattttatactataattaaaaattaattttataaaagaatggtaaatagtaatatcactggcattaatgaaaactgaccaggcctctgaaaatattttcctcaattaaggtttacctattatttcattccatgttaataacaacatattgagagtcgtcacataaggaaacaaatattcagggccatgagaaaacatttaacctaataatctaagaaatataatttaaacaataagacgcttttctagactatgtaattgttttcttttaaatggtaatgtctatggttagcgaggttgtaggggaaggagcactcctacactttcctaatgggaacatgtaaatttgaataacttgtctggatgtcagcaggtaataagtatcaagaagagcttatacctttgccctggtaattacatttccaaaaatttctcctaataaaatcatttagaatacatacaaaaatttatatacaagaatatttactgtaatagaggcaaaataaaaacaactcaaatttcaaaatacaagaatggttaaactatggtacatctatacaatgaacacagacattaaaaaatttgtttctgaagaacatttaatgacaaagcacgggataaaagcatgaattccaatttcataataaatgttatctgtatgtgtatataaattaccagttctatggtttgaatgtcccctccaaaattcacgttgaaatttaatccccagtgaggcagtattgagaggtgggacctttaaaaggtgattgggtcatgaaggctcctcccttatgaatggattaatctattcatggagtaatggattagtgggcactggtggttttacaagaagaagagagacgaaataagtatgcttggccccctcaccaggtgataccctggactctgaagacagtcctcaccagtaagaaggttctcactagatacagcccctcaaccttggacttctcagcctccgtaactgaaagaaataaaatccttttctttataaattacccagtttcaggtattctcttataaacaacagaaaatgagctaagacaaccaatatataaatttagaggtgtggggaaaggcagaggtaaagagggagtggggagaaacagaacaaaaatagctttactatccagaggttatagctgatttgttttttcaataacagtccggccgggcgcagtggctcatgcctgttatcttagcactttgggaggccaaggcaggcggactgcctcagctcaggagtttgagaccagcctggacaacacggtgaaaccccatctctactaaaatacaaaaattagctgggcatggcggcgtgcgcctgtaatcccagccactcaggaggctgagacaggacaatcacttgaacccgggaggcggaggctgcagtgagccaagatcacgccactgcactccagctggggcgacaaccgagactccatcccaaaaaaaaaaaaaattcctacatttcatgaattttctacaatgatttgcattaatatacattaatgcaaatggagtataatcagaaagaaaactataatgtgtacttaaaagaaacaaaaacaaatttaaagacctcttcagagatagccggttaacaggctgacagcagattaacaagctgtcgacctggaaaatttgattaaataaaagctctatattcagaacttccattttcttggtaactgtgtccttttcctccatggcaacttcctgaccttatttcctagtcccctggcatctacctaggtagggccatgccactagttctcaccaactgatgagctgaagaaacgggatcacagtgccaatctttactatttcatactgaagagcattcactgaccaaaggaaacacttatcatgccttatgaactgaaagaaaatttattttaattgtatattattttcgctgtgtagttttactgaagtgcagttactagattcaaagatgactcacttaaagaaacattctaaactactagaatgaacataaaaattggaggatataaaaatatattaatgtgtaccaacatcacttatgcatcaaaatctactttggagaacgaattaaaaatggttcacaagttatgtttaatcactattataatttgaagcgcaaagacgaattattaagagtagaagaagaaaaacatttatgtatgctcaaggaaaatcttcattattgtctttaaagatttaaaagaaaaaagttcaattagataagaaatttaccctcattatcataagaaatttcagcatgacacattgctgaaagaaaaggaagaactgctaaatttgaagaatgaccaaactcttgaataacaatttaaagaaacagaaatatctaaattctggttaaagctgagaaaggtatttctttcaattggagaaaaagcagtgaacactcttctgcagcttactaccacctgctggtgcaacaaaatttcttattaacaagaaagcaacaatatttgtgccgtctgcttttcagacgtgagctttttccaaatctctagagaagactaagatgggtgaccttgagagaaagtctctggaatcttagagcaagctctgggtctgatatcacaattcttagaatagcttatttagctgctcccaacaaatcagtatttaaaggcataaatattgttgcttctgtcttaatgaaccttataaagaagaaatacagccaccagagcaaataacaaatcctcatcaattcactcccactgaggatctatccatctgaaacaaatgcccatatgcaaacttgaatactccaactagagagagtaaaactgaattcaacctttgtaataagaggattggcaatgagcctttacaaactcaagtccacctcttttgttatttgacctaaagagccatcagattgtcttcattataatgatgcacatttgtatgtatgagagctgtaatttattgattctcaaacctcttttcctctgagccagtttaaaacaattaggatttgcaagctgttccataaaagataagcacccagcatcaggggtgatatttcacaaagactgactagtgcatgttaagtaggtgattgcttctgtggcctccaagtgcctcagctgtccctgcccaaggtaatcatcctcaaagaagatgctcaaggtaattgtgttgatacttaggggggtaagggaaaattgggagtgtactttacacttaatcattaacaaaattcaaattttatgtatttctcactgtttctgatatggttaggctttgcgtccccacacaaatctcatcttaaattgtaatccccataatccccatgcatttagtgagagacctgatgggaggtgacaggatcatggaggcagtttcctccatgctgttctcatgatagtgagttctcacaagatctgatggttttataaggggctcttccctcttcgctcctcactcttctctctcctgccaccatatgagaaggtccaagcttgcttccccttcaccttccaccatgattgtaagtttcctgaggtctccccagtcatgcggaactgtgagtcaattaaacctctttgtttataaattacccaatctcatgtcatatctttatagcagtatgaaaatgaactaagagtttcaatagctgtaggacttgagagctttgccttatccttctagtgaaaaagttaataagccaggagacattaccatgcagaaacaattaacaattgtacctgtcttctttacatcagtgctcttctgtaacttcatctcctcaaagtcttttggtaaatttataaaagatcaaaatcaactgtccagtccaccagtcagttctgttatgttagtgaacataatacattaggaaacagaatcagatacttaaattgatttttcatcatttaatgagttgtcactacattagaaatgaaagatgaaagtaaataaataagtcatagtcttgatgggagagaaggacatttaagtgtattataaacggtgagctaagtaatacaacaaaatccttggggagtcaggttaggatttttccactcatcttgaaggatgcacataagtttgacaggtggatgagacaaggaaataggatccacttaaaacctgtctagagaaaagtagacaggatccaaataagctgagctcttgcatccttctaccagggaagttctgccctcgtctgattttcattctatggtttcatgggggttttttttaatgattctactattttcaaaagaaaataaaaacatttgaaagccactactataactaaagaaaaaaaactgaaggatcctgagtggggagtgacatggtaataagcacatcaacagtagaacagctgggaggctgttgcaatcattaggtaatgaatggtgagcacctaagacaatggcagtggagatgaagtatagcagggatgaattaactctgatggcaaggtaaaagagtaaaagatgaatcacaagtttctggttttggtagctggatggatcctgaactattaaactgagcaaagaaatcaatgaaaagaaagagcttttaggagaacatatgttctaaattgaacttgtctaagcttcaattagaaagagaggatcaatttgtgtttcatgggaggaaatatcaaactaaagatgtctaatatgcaaccggatatgtgagtctaaggaaatatttgatagtcatcagtataggggtggataagaccaccaagaaaaaaaatgcacagtgagaaaagaagtagaaccaaagaaaaccccgcaagaactccaacatacaaaaggcagacagaggaggtggccaatgagattgagaagaaacatgagaagtaggtgaaaaactaggggaaattgtacaacagaagttatgaaaagaagggtttcaaaaaagtgagaaaaaaactgttagaatttcccagtaatcaatgaattgcctttcaactccaaatccatccttcattgtctgctctttgcaaacagagctgaggcctttaaatatttctcctttgtagctagtgtgatgttaaactttgtcatagaaagtgttggaagggttttttgtttttttggttttttttttctccaagatagtggaatggaggcattattggcatgcctctcccactgggataaacaaaatagtgtgtagaaagtcatgctatgaactttcttccaagaagcaacacaggaacttaaaaaacactgaaagaaaccacaaaccctttgaaagaagcagtgggcagtagtctacatgataaaccaggaggaaaactgggagttgccagagcatgagtggggaggagagactgcctccatgatacactctcccactggggagccgagcaatccaggccacaggggaacaccttaaccctacctagcgctggtgctacttagtgagcagtgaggttttatgaaaaggagcagcatcgaaccgtgtttactcccagaaccaagcagggacagagggaagccattcctgatcctacctcacaggggacctcacctgaagtctgctggttaactgaggcagtggtcacaggttgagagaagctcccaactgagacctgtgatataatctttagtggggacaaatgcccttggtcagaaccgaggggtgggcagaaagtgtgctatagccacaggcacaggacctgggtgcctctacttcatgggctgaccaggaggggcacgacctaaaagctggtttctgtgtcagttgggaacacttatggcttgggacagttttgagggctgcctggaacccagctagctactgctagcacaacactgtgggtatgagacctgccttgccaagttcatgggagctgagtggggcttactgccacccgctaccacacccttccccttgtggattcttctgtgcagcagacgtagctgtgctcctccctggaacattacccctgcgaccagggaactgccctctaatccccattggagccactatttgcactcaaacgtggggagccagagtgtggacttgcctgacccagccccaactagctttgcccatccacctactctggtagcctaacacaacagacagagacttttgcatgctccatggccccacccattgcctgagacactagaatacctcccctgggtaacataaggcaagcacaaatcccaccactgatactgcaactgttgctcttttgcaagcaccacctccaggctggaagcaaaccagcacagcccattacaatatctgcaggcacatcacagtgctcaggaaggagaaaactttttgcatgacctcagctaccaccattgcctgcatcaccctggttaaccaggaggccttgagtctgtccacagccccagtacattactactacagctggcatttgagaaagccaacacactaaggctatttataaccaaggaaatctcacagagtctatgtcactctcctctcacccccatcagagccatgctagtactcactgttgggaaactggaggacagtttacagcagtggatcccttttagacattctccagctccagcccagagtgcggcagccccactaggtggctagacccagagcagcagcaagattcacagtggtctggccgtcagaaactgctactcctagggtaagggggcgtgtaccacattaagagggcagacaccccgtcggacaaaagaaaccggactgcaggctctgagtccctgaaccttccacttgtgggaagtttctttcagcagaggcacaggtgcagtgctgggctcagtaggaaaagtatgtggctctaccccaattgtcaggcagccctggtgctcatgaaggatcttggaaaagggaactatttctccccctcactcagcactgcagacacagctggggctcctcccacaggagcatggcatgggtgcatctgtagacagcctttccataacacttcagggtgactgcacccccacaagaggaatgtcctccaggttcaggcttgcaagacagctagagtcacagtccgcctctacatgcatgaaaagaggtgcctgtctgatctgaatagccagagcacttcgtgcagagtgtgactgggaggtggattgctttcccagtggcccagaagggaggctgtggtggctccctcccttgcccaccaaaaagacctcagtgcatttcactgagagctttcccagccatctctgttgaggctgtgacctctgcccaccactgggatactgcatttacccaactgctttagttgtagctgtttttcaccatgggcacctcctactggcctgaagcctgaactgttcaacccagtaaataaaacaacaggaaaataaaattttaagtgcatacctctgaggaatgagataagcttcataagatttctaccattccagccccacaggagagagtaaacctgctcacacacccagcacatcgctactacaaccagcatcagagaaagccatcacacaaagattttctataaccaggaaactcacacagagtctttgccattgaaagtacccaaagccaaaactaggtgacaatcaactataaacattaaagttacatcctcaaggtggggcagcggggagaagaaagtttttaaaaatccctgtccaatcaaaaacaaattcaaaaataattagaagaaacagtctacccaaataagaaggaaactagaaaaataattctggcaatatgaaagaacagagttctataacactcccaaaagatcacactaactctccagcaatggatccaaaccaagatgaaatttttgaaataccagataaaaaattcaaaaggttgattattaaattattcaaggagataaaaaggaaaggtgaaaaccaacataaagaaattaatgaaacaattcaggacatgaatgaaaaatgttctaaagagacagacattgtaaagaaaaacaaaccagaacttttggaagtgaaagacacatttagggaactacaaaatgcagcgaaaaatcttaacagtagactagaccaagaagaaaaaagaatttcagagctcgaaaacaaggctttctaagtaacccaatcagacaaaaataaagaaagaagaatgaatagatatgaagaaaatctccaagaaatatggaattatgtaaaatggccaaacctaagaatcacaggcgttcctgagaaagaaggtagatccctgtcactctccatatacataattaactcgagatggattaaagatttaaatctaagacctaaacctataaaaaatttaagaagaaaacctaggaaaaactcttctggacattggcctaggcaacaaatttatgactaagaccacaaatgcaaatgcaacaaaaacaaaaataaatgggacctaattaaactaaaaagtttctgcacagcaaaagaaataatcatcagagcaaacaacctacaggatgggagaaaatacttgcaaattatatatccaacaaagggctaatatccagaatctacaaggaactcaaacatatcagaaaaaaaaaagtaatcctattaaaaagtgggcaaatgacataaacagacagttctcaaaagaagatatacaaatggccaacaaacatgaaaaaaaatgatcaacatcactaatcagagaaatccaaatgaaagccacaataagataccatcttatcccagcagaatggccattattaaaatgtcaaacaacaatagatattggtgtggatgtaatgaaatgagaatgcttatacactactgatggaaatgtaaatcagtacaacctctatggaaaatagtatggagatttctcaaagaactaaaagtagatctatcatttgaatcaggaatcccactacagggtatctacccaaaggaaaataagtcactatgtcaaaaagacatctgcacatctatgtttgtcacagcacaattcacaattgcaacgatatggaatcaacctaagtgcccatcaactgatgagtgcataaggaaaatgtggtatatatgtataccatggaatactactcagccataaagaagaacaaaataatgtattttgcagcaacttggttagaactggaggctattattctaagtaactcagaaatcaaaagccaactatttcatgttctcacttacaagtgggagctaagctatgagtacacaaagacatacagagtggtagagtggacactggagacttggaagggggcagtgtgagagggggttgagggatgaaaaactacctattgggtacaatgtacactactcaggtgacaggtgcctaaaatcccagacttcaccactatacgattcatccatgtaaccaaaaaccacttacatcctaaagcaggggtctccagccatgagccaaggaccactaccagtccgtggcctgttaggaaccgggatgcagagcagcaggtgaacagcgggtgggtgagcaaagtttcatctgtatttacagctgcccccttcacttgcattaccacctgagctccactttctgtcagatcagcggtggcattagattgtcctaggagcacaagctctactgtgaactgtacatgcaagggatctaggttgtgtgttccttatgagaatctaatgtctgatgacctgaggtggagctgaggtggtgattctagtgctgggagcagctacaaatacaaattaacattagcagagaggtttgactgcccagagaccgtagtaaatctactgcttgcagactcatatcaaaaccctatcagtgagtggcaagtgacaagctgcatctggcggcaggctttaagtcaggatctgatacttcagtccgcacatggcccgcccattattttatttaccacttctgtccatacctctttcctgcactatgcacttgtctcagtcactgttttggtaagcccgcaagctacccctagccaaaatgagtaaaaaacaaatgtcactggagagcttctttgaaaagggggaaagatccaatgatgggacagcagaagatgctaaaagtgccaacaagaagaaaactccatttaaaaaaattaccaagagtcctccttaaattaagagttcattgcaacaggtgattcgccttctccaagcctgctttgtgtatgtgatgaccagctatgcaataaagccacgaaaccttcaaaactgcttcaccacatggagaccatgcacactgcattaaaagacaagcctctggagtttttcaaaagaaaaaaacatgaacacaaagaacagaagcaattattgaaggccaccacttcatcaaatgcatctgtactgcgagcatcattctcagtggctaaccacattgctaaagctaagaagtcctttactattggtgaagagttgacctgcttgctgctaaggacatttgtcatgaacttttaggagaggttgcagttcaaaaggtggcacgtgttcctcttttggctagcactataactagatgaatgatgaaataacagaggatagtgaggtacaactgttaaagaggattaatgagtcatcgtggtatgcaatccaggttgatgagcctgtcaatgttgacgataaggcaagaatgcttgtttttatgtgatatatttttcaggaggatgtgcatgaggatacgatatgcgtacttttgttgccaaccaacaccacagctgcagaactattaaagtctttgaatgattacctaacaggaaaaccacattggtcattttgtgttggtatgtgcacagacgaagcagctgccatgactgaacggcttgctggtttcactactcaagtcaaagagggtgcttctgaatatgagtctatgcactgtgtcatccatggagaaatgctgggtagctgaacaatgtcacctgaacctaacaacgttttgcaggatgtgattaaaattatcagccacattaaagtacatgcccttaactcatgtctgttcttgcagctctgtgaggagatgcagagcacacacatcatctcttatacacagaagtgagatggctttctaaaggtagatcactggccagagattttgagttacaacagctgctccagagagttcttttagaaatacagtcactactggcagcacatttcagtgacacagaatgggttgtaaaacttgtttacttgtgtgactgacatattcaaattcaacctgctccacaaactcaacctgtcacttcacgggaaaacgacaactgtgttcaagtcagcagataaagtggatgcattcagagaaaactagaattatgggggcaaccagtgaacattgggatttttgacatgtttcaaatattagcagagattttgaaagagactgagccagggccttctttctcccagctggtgtatgatcatctatctcagctttcaaaggagtttgagtattacttcctaatatagtctggctgtgtctccacccaaatctcatcttgaattgtagttctcgtaatccccatgtgtcgtgggagagactggtgggaggtaattgactcataggggcagttacccccatgctgttctcatgatagtagtgagttctcacaagatctgatggttttataaggggcttttcctccttcacctggcacttctctctcctgatgccatgtgaagaaggatgtgtttgcatcccttccaccacgattgtaggtttcctgaggcctccgcagccatgcggaactatgggtcaattaaacctctttcctttataaattacccagtctcgggtatttcttcatagcagcatgagaatggaccaacatacttctcaaccataaaagatccccaaattgggaagaaatggttccgcaacccacttgtaaataaaccaggtgaatcaactttgtccatgctagaagaggatcaacttcctgagattgcaaatgactctggccttaaaagtatgtctgagacaacttcaaacctctatatgttctggatttaagtcaaggcaaaatatcctgagattgccttgtgcaccaaaaagcctgcttccatttccaacatcttatctttgtgaagcaggtttttctgcagtgacagcaacaaaaatgagactacagagtagaatggacgtaagcaacacactttgggtgtcactgtctcccatgaccccaagacgggactgtctagttgcaggaaaaaaaagctcagggctcccactgactctatggtgagttgcataattatttctttatatattacagtgtaataataacagaaataaagtacacaataaatgcaatgcacttgaatcatcccaaaaccatccttctctctgcctcccagtctgtgaaaaaattgtcctccatgaaaagtgcctctggtgccaaaaaggttggggacccctgccctaaagctattgaaaccaaataataataataataataatgattttttaaaaggacactgcagaaggaaggcgcttctctttctggttccatgttttccatttgttgcattttcatttcagcatcctgtgtgaggatatccagtggtactcaactccatcaagtttcagcagtacccacattgggcagcttcccatcaagtttcagtagccccaccccctactcagattcttactgaatctgacagacaacctcacagtcaatcccccagcttcaccctaccagcatcctggagaggtgtttcctgcccatcattcgtggtgtggttccctgccttccagcgtcactccgcctttaattaggaacagtgtcctctccttccccagcaactgtggatcagctatggccccagtaactcagtaagtctctccaccattcagggagctatagccacacctccaacaaggtaggaatcccagccttgcagagagccccctctaagtttatatctcctttgggcactgtctgtcagcccaggggattctttagagtcatctctgtccttttacagataatccccttatagttaattatatcaggagtcagcaaattttttttctctgcccaactgtgagcctctgccagctgtagcacaaaagcacagacaattataaatgaatggggtagcttgatttgacctgtggtaagctaaatttagcccatgggatatggcttatcaacctctgctgtatgttaagctttccctgttaaaattactatgggacatctgtctcatctgtttaggggcaaatgctgagtgaactctgagggacaaatccaacaaatacgtcaagtaggaaaaggaatagaaagtatcctttggaagtgctagtgactgtatcaaaagcagtctcagtaaaatgcttaggtgaggacgatgccaggttgtggagtaaataggaggtgaaaaagcagaagcactgtgtataaatcattcttttaggaagtctgcatatgtgaagaaagagattagtagctagaaaggaatatttatgtgtgggaaataagccttagattgcaaaatatttgagactctgatgccagggaggtccgatatacaagaaataagatggcagacttcagacaagcccgacctaccattaggatccatgcaagcaagtcacttactgtggagagtcctatgcaaccaccagctgaggatgtgctacacatctttcctgcaaacactgtgacacacttcccccaccctctgcagttaattcccagctttcaagcctcctgtcttaataagttacacaaataatggccttcatcctaaaactgctttacagtaccagatggttcagcaaactatggcacagccaattttaagggtcaggaagaagataatgatttcttgtctaagaactcaaagaccatcctttggcaaaagtttattgagcagaccttaaaattaaaggtcaacaggaaatgttttttaaaacatcgataaagtagaaacatactggatttaacgattggagcacatagctggaaatcagaacatcagaggtacaaacgcgagaaccaccatttactgagcacctaggtatgacagatactttgcatacagtaaagtatctctgcaaagcttggcttaacctcaggccaatcttacaaggcaggatttctaacctccctgagggcatatactagctcttgttcatctattcccaggccccagcatagtgtctgagtgtccggcacattcaatatttacttcttaaatgaacaaagtagtcccttttttgcaaatgaagaactactaacgctcccagtagttaagtagctagaaaagcctggattcaaaccataatcttaaagcaaccttctaaataaataggagaccccataactggaaacatatataaaccaagacaaaaaagaatatttgttttaattttttttctgtaaaattatgagactataactggtatattacttgcttacatttatacaaaggcataataatgttcaactttattgaaataataatagctattgatttacagtttcctatggactaatttctgtactaagtgctttatgtatgctctctcatttgatcctcataacattattattatcatccccattttacagaaaacagaactaaggcttaaaggagcaaagtaacttaagtggcagagccaggattcaaatccaggcaagaagactatttccgaaacccaactttttaatcagtacacttgttacatgtaaatggcagtggtgagaaagcaaaaaacaaaaacaaacaaacaaatgaaaaacaggtataccaatgagtaaaggtactcttccctaaaagcaaaataagctgataagaataaagtgcttggctgggcacagtggctcatgcctataatcccagcacttttggaggccaaggtgggtggatcacttgaggtcaggagttcaagaccagcctggccagcatggtgaaaccctgcctctactaaaactacaataattagctgggtgtggtgctgagcacctgtaatccctgctatttgagaggctgaggcaggagaattgtttgaacccagaaggcagaggttgcagtgagccgagattgcaccactgcactccagccttctggagtaagacagagtaagagtctgtctcaataaataaataaataaataaataaataaataaataaataaataaaaataaagtacttattgttgtattcaagctatgagtccccccaccaaaaaaaaaaaaaaaaaaaaaacagaacacacatgagctagcttaagtgaaacagaaattaatcgtttttaaagaatacaataatgatggtagtggtggtggtggtcatcatggtagaagccaaaataagcaataatactaataattcaacaattaaatggcccttttctgtgccaggctctgttctaagcactttacttgtattaactaatgtaaccccaacagtagccctagagtaaacatagctgtaatcaatatgacaggtaaggaaacaacttccaaaagttaacttgcccaaactcaaaaaagtagaaagctttcttacacacagacatctctattccataaccaaaacctagcaggctcagttccaggctgtatttttgctctaatttcatcaggagtccaccctgctccagcacttcagagcaggagacagaatcaaatggaccagtgcctgggaagtacagaattaaagctcatccattcattcatgagcacattcgttcacaagcacttattcatccattcatgagcacctgtttcacagcaaaccctgtatgcagagtagattctaaatgtttatcaggccaggcacagtggctcaggcctgcaatcacagcactttgacaggccaaagtgggaggatcacttgaacctgggaggtcgaggctgcagtgatccaagatgacaccactgcactccagcatgagttacagaacaagacttcatctcaaaagaaagagagaaagagaggaaggaaggaagacagggaaggagggaaggagggatgggaaaatgtttatcagaatgaattaaatggattcatgtaaccacaaatactcccatctcccaaataccccaagcactagcattatagaaatttcagagaggtgtgcatatccgataaaggcctgacaagtctctgagtcattcataattagtgataacaagataccagaaacaagctttaaaaactaaaagaaaaactcacaaaaatatttgcattatatgggaaccaaagggttaatcagctctttcaaaaacacaagaaaaagaacagtccagttgtaaaagactcaaaagatacataagcagacaattcacagaaatcaaatgaccctaacaaatgttatttgttatttcactaaataattacaaattaaaataataaaatgatattcttatctatctgttttatacagatgaaaaaacctctcactcgcagggttagcaaggttataccttgttgtaagagtattaactataaaaactacattagcatgtatatctactatgtacccacaaaaattaaaaatttaaaaaaaaaaaaccacattagcttttctggagaacaacctggcaatacaagtaaaaataaataatacgggccaggcgcagtggcccatgcctgtaatcacagtattttgggaggccaaggtaggaggattgcttgagcccaagcgttcgagatgagcctgggcaacacagtgagaccttgtctctacaaaaaaataaaacaaaattagccaggtgtggtagtgcacacctgtagtcctaactactcgggaggctgatgtgagaggatttctcaaacctgggaggtagaggctacagtgagccaagatagcaccactgcacttcagcctgggtgacagagtgagaccctgtctcaatcaatctgtaatatacatagacgttgacccagaaaatctatttctatgactattaacctaggaagataaaatatttatatatattttatgtatagacatatgcataagaatttcactgtagaaattcttcagaaattttaattcactcatccattcatccatgagcacattcattcactccagcctgggcaacagagtgaatgaatttttttacagttgtaaaagaataagaaaaaaatataaatccactggataagcatacaataaatgtatctaatcactgggatactatgtatctgctaaaagagacaaggttgaatggtaagtgctgacctgtaacaatacattttacgaaaaaagaaaaacatactatacaatagtatgaatgtattgtaactactttatatcagaatcaacccagagacattacatggatagtgtattctataatatacatgctaatatagtttttaataacctggtaaatctagattatttttatattatttccaaaatttctggaccagattatcccaataggtcccccatccagctctaaaattctttaatcctaagaattttttttttttttgagacagcatcttactctgtcacccaggctggcatgtagtagtgtgatcacagctcactgcagcctcgaccttctgggctcaagtgatcattccacctcagcctcccgagtagcagggaccaaaggcacatgccaccatgcctggctaattttttgatttttttgtagagacggggtcttgctatgttgcccaaggtgttctaaaactcctgggctcaagcgatcctcctgccttggcctcccaaagtgtgggattacaggcatgagtcaatgcacctggcctaatcctataaattttgtacaccactgatcttaatacacagtgttagtatttttttttttttttttttgagacagagtcttgctctgtcgcccaggctggagtgcagtggcgcgatctctgctcattgcaagctctgcctcctgggttcatgccattctcctgcctcagcctcccaagtagctgggactacaggcgcctgccaccacgcctggtaatttttttgtattttttagtagagacaaggtttcaccatgttagccaggatggtctcgatctcccgacctcgtgatctgcctgcctcggcctcctaaagtactgggattacaggcgtgagccaccgcgcccggccacacagtattagtactgcaagtccgcagtgtgtctcccctctatgtttcagagccttttatctatcgagcacaatatgaaatccaaaaaaaggtccagaatttttacatctatgttgtaaatttaaactttaaacattacacccttaattatcaatgataattcatgttgaatttatttatggaaatcacaaattataatgatctcttacctcaataataatataaggaccactatattttttttaaaaaactaagaaagataatagaactttttgaacattgaaagagatgaataactgcacactgtgccatatatggtccacttaatccaaaaatgttaagtgtgaatcaaattctattagagggcacttataaacagcaatgaagccccttggcagtgggtgggactgaaatttggagtcagaagacctgggaacaatgatcactcttttggctccagaatcccaagcaaattaaataacctgagactcaactgtctcctttgtaaaagataagcatggtaaaggaattatataatgcctgtaaaaggtgtctgacagaatgcctgagacaaagcaggttctcaattccttgcttaatagaaacaggtacatcactgttgcttttgttaaggttataaaggatatctcaacttatctactttgttcatctgaatttttgcaacactgcatacacaatcattcgatattttatttttaaaccatatattagaaggggcttcttgctcccaaaactctatttcttggcatagtcttttctaccataaatatgcaaaaaatgtgttatctcagaaactcagggagaaagcatacttacaaagcacacccccaaaactccgagttgctcttctctgagctcaacgctctttttaggcacatatgtctgcctcctatcatttcttcatgaggttcagggcaaagggcctagtcaagccgatgatctttggttgcccctacactttccccaaaccac

SEQ ID NO: 1672 - DNA, 1914 bp, Homo sapiens
tggaggcctggggagtttcttcagacccccaataaaactcgtttaatactaaatggctcctgttaagaatgccttcgttatttcgtcatgctttaaggcccaggaaaaacctaggcaaaactcttggtgggcttttgttacattccagcctttgtataagggcactggcttcttttttttttttttcctcttaatatttaattgaaccactcagtcggtactgaaacagttgttagggaggcctgtgttagtgagacctggcctgccacgtatggatgctcatgatagtttcttcataatagcccaaacgtggaatgatagaaatgtccaataataagtgaaagtacaaacatacatggtatagccacacgaaggaatactactcagtatttacaagacattacagatggattttaaaattacattgatgcatgaaagaaggcagacacaaaagaacacaggtatcatttcatttatagaaaatggttaaaaatgcaaacggacctgaagtgacagtggctccttggggctgagggttgaaaggctgatgaactgcaaaggggtacaagaaactttggggcatagggaatttcctctatcttggttgtggcagtagttccgttagtgtatccatttgtaaacgtgcattgaattacacattttaaagtggtgcagtctgttgtaccgaaattatgcctttataaagttgatttcatcatcttaatttctccatactagcaattagcagctagaaaatgaaattcaataaaacataatagagattaacagccagaatcattacatgcttaacaatacatgcaatgaagcaggtacaaggcccctaaaagcaattggtgagaaaaattaaagaaggctaaataaatatatatcatgttcattgcttggaagactcaattttgttagcatattacatcaacacaattctgcttaatatttctagtaggagattttagagaaatttgaaagctagtttcaaaatgtatttgaaaatcaaagaacctagaataagcaagtcggtattgaagaagcaataagttggaggacttactctgctagatttcaaacctgattttaaagctacagtaattttaaaacagtagtaatggtgtcagtattcataaatacatcaaagtgaaagaatacagactcaaacaatatgcccacatatgtacagttattgattttttttagtagaaacttttttattcataaaaaatccatcaaaacaaaaaagttttccagccacacacaggaggggtatgggtgggggaaggtgtctgtccatctatccctggcccccagcccatgtggttttggcagcaataaggtgtgtggagtaatgactcctgaaattaaaatggtgtgtgtatgtgaaggaaaggcgggcaaagctgtggggagcggtggagtggaaggaacaaaggaggtcagtactgggaacgctgaaggtgggaggccatttcataacattacttgtcgatgaaattgccatggataccttctttgcccatcagcaggcctagcgtcttggcagtcatggtgacaatgacgttgaaggtgggggctccaccgatgctcttcatacgaagatccgtggtcaattccccatcctgcagcagtgagtccaggaccacagtatatttctggccccccagtgtcagcccattcatgacaaagcttgaccagtctttgccaaccaggacaccaacctcagctggcgtgatgttgaggaaggttttccctgggacggcggcccagatggaaggcgggtccttgttacccacaatggcagtgtcctaacaggtcccgtccgccacgaggctgtagatggaggtgtccacctggccgttgcgttgctgcaggggctcctctggtcgctgctgctggggccgc

SEQ ID NO: 1673 - DNA, 191087 bp, Homo sapiens
atctttttataaaaaatttatttctctgtaaatacaaattccaacatcaacaaacaatagtccagtggaaaaatactagccattaacattgaaaacttttttcttaatttaataaatagaactttggcattcaaaattctagctgtaaaccctattaaaaaacagaacaacaagaagaaaacccctttacaaaaaaagaggcaagaatgatagatcagaaggcataagccaaccagtggcttcacattctttttttttttttttaaacaataactgtatttcaattaagtcatgaacactgtatttacacatgaggtattctgggtggttcaaaaactgaacccagcttacaaaaccaccagtcatagtgactgattatacactgtgctgtgctttttaatgtaaccacctagcaccttactacttcttgtcatcacaacaatgcgatgttaagttttatgtttatgtatttaactatttatacatatatgtacatatacatacacaccaatgaatacaatctaaaggagtttccagctcactacacagggaaggctgggctccaaagacatctatctgataattcccctcatgtttactaaggtatccacctagtaacaaaaaacggctccttgctttaaaaaaaaaaattccttaatcaagtttatatacagaagaacaaggtgcaataatcatcaacattcttagaactcatgtaaaatagaaataaatgcttactgcaggcaaaaaggcacaaaaggttctctctgtgtacagctgcaatagtgttattagacttgctgatttaaaactatattcttatatttagcacttttttaaataagaaaaaaaatccaaaatctttcccatacatgattaaatatatgatataatcatatggcaatatgccacccatggcattttggggcaaagttggaaattttgctctttataccaaataggaaattgttcctgttgttttgtgaacatgaattgtcaaaaatggaaacatggcagtttcaaatgatatagtctgagtgagcatggttatgaaaattgcttattaccataattacatatctacaatgatataattcctacgtaagagaatgccaataatccaaactaaaggtgtgcctaagctgaactatgctgtgaaaatatagtccatgttcttagctactatgttacttaatgaactattactgatatttaaagaacattttcccaattaagtagctcctttaaaaacatcctctaagaaattaataattcttgcactatgaaagaattactttataagctccttagtatatcagaaatgtatgacattcattttagcaacactttccagcccttgagattgtctctacaacaagctattgaaagaagtctaattaggtttaataaactgtcaccaccaaaataaatttcactaaaatataatactgttagcattaaatattgaatcctaggtgccacacttcttttaaaatgacctcaggaatatcttacctagccagtatttgtggttttttgtttttgtttaattagaggccactgaaaattaatagttcaaattaagccattttacttttctgagctcaagtgaaaagatagctattgtgcctttgattcagtgaattttatctgtacaggcaatttgggtctttcattgagtcaactgttactttatgcttgctgtaatgtgattgaggctgaataagctcaactttaaaacccaaaagaacaaaatattaatactggataagatactttctaagcaaacaagtgttggattcacaaaaagcacaattaaaacgaggtttcattatctaagtaaattttcaaatagattcactttaaaatttaggttaattttcatttcaggaatatattggtgtcataacttccacgaacatcctagttcaaactgggtgagatgctctagtgttgctatttgcccatcttatttggtctaacagtaaaatctgtttttaatgtgatacagaagaggatattctaatacaagagggtgtcctgggaaaggaaaattttctgaaaaataaaaatcaaaaagtaaatactgacaaactagatagaatactattagtttcaattcccccacaaaatccctccaagtctatctactgtttatgtaggcccctttacaaactccagattttaagaggatcaatctataattcagctaactacttaaactagcacatcttaactcccttttttatggggggagggtacagattttggaaactgaaatgcatcagcagtagttttgttaacttcctactaagtcagaaattttttaactttggaattttatttttaagatacgtgaattaaattactttctctaagttttagaaagctaacttacaaataaattattttatccccaactaagccaaaaaacaaaaacgtatctatagtagattaaaacaaactgtaacgtctgcttaaaaaaaaaaaaataaataaacccataaaatcccaaaacatacactaaaaatctaggagagatatttaagtaagaacctactggtccaattagtgattgtttgccaatttgttctattattttaggaagcctttatttctaaaatcatgggggagggtggttgggattctattcaaagagagtgtaaaaatatttgctgcacttgtggctgatctattttagacgttattatctgttttaccataaaggaccaaggcagaattcttcgcatcacatttttggtggaaatttactataccctgattatcgtcaagctactaatgttaaaaaccaagtgaatataattagaaagccaagttcttaccagtgactaagaccctccttaggttaaggactctgggatgcaggagcactacaatgtacttactgatttcttagtgcccagattctcagaagtaagaagagcaggaaggactcagacaccaaacagaaggaaaatctgatttctttacagtgtattataactgattattcaactataactataaaataatctattgagagctgtatagccaacattttaaactgtgtatcttcctgggtagtctccttgaaggccttgtctcacattttcacttttaaatatttaagaaaaatctttcctaggagagcctttattctagtatataagaaaacaggcatgtgctatgccctttatctggcaagaaaacaggcatgtgatatgctctttatcaaatcaatattatcctgcttgagtcacaccctctacccctccatctcttatttagtcttgacctaaatgagacttggttgcatcacaagatcaaaccaacttacaaaggacaaggctttcgccaaaactaagtatattcaaaagaacataatcaatgctgaaggcaataaaatgtataatccttccaaaataccaacagaaacatggacaacactcatttggaagtttaaatgactgtacgtctactgcaaaatcaactgcatttcatagtaataccctgtaattcagattaagaactaatttcgccaagttcatatcctgtgaaaaactgttgttaatgtactttaacaaaagggattaaaatacaatctcaattaaaaaatgtttatgctactgttgattcagatataaatagtattggctttctcttacagtagtttcaactttgaaacatacaaaactgttaaaatgtaaatgttgagatttggataagtaagctattgttccagggtaactttgttaatcttccttttataataatgatccaatgcctttattaattatatatggctttgtttacatttatatatgtatatatataaaacatataaataaaaaattgtaaatagtaaggaacatgttaaaattagttcaagttatgttaacctttcttgtaacacatacattacaatgctaaggaaaaagagcatcacgtcaaaatttcacacctcttgggaaatccacaatcactctggaaaaacagctgacctatctacagtactaaaatcagctcaaccacaaacatcctatcagtgcagtaagtgttcaaaatataaatggttttgcctcctgtactaccatgacaacacttgcctgctgtttgaactcttgttcagccagccactgaaaatcccaaagtacaacacaagcttctatatgaaagaaatataagaataaacagcgtgtgcctttctcagaagctctgctctgaccctagaaacccttataaatttgtgaataaagcacgtgcacacacacacaacaacacacatacatgcacacacaaacacacaaagctataggattaaaaggaatcctactccttcatgtgaagggtactcttcacagcttggtcctacaatcagtagtttgagaatatagacatttttttccttgtagattttatcatattttccaaaggtaatttgattttttttctttttgcctgattagataagccccttcaaaatctcttcacttcccttctccccttcaacaaaacaaatccacagaaaaaaaatccctaagtgcaagtcatgtcacttgcaaccttccattatggctccataacacagcagcatttaaacaacaggtcattattgctgtgggactaacacttgatcactgagtaatgcagttgtctcccatgtcctgagcatagcggtctgatattgtagtccttaattcatcaatgtctcttcgtaactggcacacatctgacagctttttagtgagtgtttctgtgctgtggtcattctcagtctcttcagctgaacagttcattgctgtgtaaataaaacatagagagaatatctcacatttttttgaacaaagacattttagaatttttcaccttaatcatcatggaaatacagtgctacacactgaataccagtgaggctcaggttcaagttatgtttaaatcatgcatcattcaatattaaacagatcttatccacttggtcctttataaatttcacaaattaaactgaattaaatgcacacagtgatacacacaaattcagcatgtttaatgggtaacaatattccaaaagtgaaaaaaagcatactctaatgtctctcttcaagctcaactagagcactcagtttttcccatttggcaaaatctgaagaccatttgtgtagtaagaggtggtatcttacatatttacgactgcaaagtgggtttactgccatgaaaatattaattttcaaatacatagtaagtgtcacacacacacacagagggagagcggggagggaaaatgagagagacagagagggagaggaagagggagaggaagagtgaaagctgggaccctacaatcccaaacaatttaatcaggctgatagctggttgcctaatggctgaataactgagggccttgagtcagccagcttttagttatttacttcagttcttctctttgtaagcatatctcaacataaaatcaggcagagccagtgattacaaaagaaacctctccttataccttcatagtagtttattgtaggcataagagtcagtgagtgactgttattttaacaaatgttaactgaacatctgccatgatataggaactatgttagatgttgaagtcagaaaaggaacagacacagtggcttgttctcgatgctttacatacaatttcataaacaaatgaacacagtgaggtactgtgggtaacctaccactatatacaagttgcagtggcataaaaaaacaaacaactagtcctaactggagaggtaacagttgcttgttcactgggttggccaaactgcaaaatgaacaaaagtggagtcagaaagcaaaacagtatgatagaatttgagaaacctcaagaaaatcagtatctagctctaaaatggtagagtacaaactgtgacaaaggagagtaccaagaaataaggctatagaggtaggtagtagctacctatcttgaccacagagcagtgtaggcattaggaaaccaggttcatagtttagacagatctgtctggcaacaatgtaaaatggattagggggaggggatgagaaagatggttgtcagagagaccagtataggtgacgggttatgaaaacttaaattaaggcaatagtgcaatggagatagaagggcaggaatgttagatgtagtaagcagatgacagaactgatagcactcaatcatcatcaacttgagtgatgggcagggattgggcacaggcgccagatgaaggaaaaagcagagtggagaataaattctgggttcaagtgacaggtgaatggtggtgttactcactgagaagaggaaccggttcagggagggaaggaaagtgtgttctggttttgaatgtgtagagtctgtgatgcatttgaaatagccagttctaatatacatgggaatataatctggagcccagaggagataaatgtctgggtaaaggagataaatgtctaggtgaaaggtatggcagtaacagaaaaaacaggagtggataagatcactcagataaagtactgaataaaaagaaacaaacacaaaaccagtaacaaaaggcttctggggataccaataattaagtggcagagaagtccacagaagacagagactgagcagtcataaaggcagaagcagaacctagagaatgatgtcatggaaaccaaggtagtgcacagttttcagaaggacagggtgagtaaatggagccatgaagtgactggtttttcacaaatcaactggctggtaaaactttcacaatgccaaatataaggtaaggattctggggtcaaactttaaagactagaaggagtattgggaggtgggcgtggtaagattcacattaggatagctctactactctattactgaaaaacttaacaaatgctaccttatgacagtgaaaatgtaggagactctaaagtaattaaaagggtgaccaactctaaaatcatgaagaaagtgagttccctttgtgtgtgagctttgcttcttgctcccaagagatattaaagcactccatgttcaccaggcaaacttctcctcttcctcgtctgagagcgacactgaacaccaactactctgtggagtctccacagcccttcccacgtagatttagttgtttttttcctcttgtgctcccactgtcctttgtccacatctcaactatagcacctatcagaatgctctaataatttggttaatgtgtggacaaggactgtgttcaggttatctgcattaccagcacttacttagtgtctggaccatagaaggcatctgataaatgtttactccgtgagtgaatatacttaaacattatgtgttttttcgatatccacatttgtgtatgtgtacaaatgtctatgaaatgaaagggacatagttgagcacagataatgtttcatttaacaagtgatatactttggtcaagagcattatttgatttgccaaaataactattatgatgcaaaatggtggaatctttttgatgaaactagaaacaaaatcagtttgtttgaaacaaaaccagtattattaaccataatattaggcagctactaaatacacgttggcccataaaccttattatatggtcttactgcattcctatttccttccaagttcatttcttctctattataaagagactaacatcctgatttggaaccacgtacagagatgagcgtttctgcaaaagtagcacagaaagaaagggacactaggattattactgtggcagctcccacaattatgtgtggaggaagacagaattgaggccaagagtgaatgggtgtcacattaagccagcaggtacgcatgacaaaggcaacagatttgtaggctgtgaaaactggctcatgtgaaatcactggcactcacgtgaagcagctgccatagaacatatactgcactggaaagcaaaaatatttctcaaatattttaccagtggacaatatggttgggtcacttaatctatacaactaacacatgaaagcaaatagaaggaatcattatttttggaagagaaaatgggaagtcacacctaactaccactctattcacatatttacagattcaacataggaaacatcaccaggcattctaccaagtggcagttaatgtcagctataaccctactcacttcttgcaatgaagtaataacaggtatacataaacccacagactgattctaagtaggaaaagagattacaaaaataaacagagaaaaggcagtcggaagttcctgattcatgaagataggtttctaattgccacaaaataaggacaagtcatcagacacttacatcttattcccagtaataatgaaagattaggctccttgccctgagcacgctgattaagaatactacacaatgctttcaagtcaaacaaacaacaggacatttccttgaacagctgatcaatcacagtcaaatcaaatagtggccgtttggaaagaactgtctgctgcctagattggtcaggttcctggccctgatccaataaagagcatgtctcatctgtttgtctttggttctgcaaggataaagaaaacaaacatcagattgttagaacagaggaaaggtactcaaagccatacaggttaacattctcccccaagtctataaacaaaacgatggagtcatattatatgcacattaaccaaattcaactacatatatgcagtgggaaaaaaaacacatagaaaaataacaatttaaatagtggaaattgtttctctgtgccatctgatgctttagcgtatatccaagggaggaaacataaatccagtctcagtttctaggagtctctcacgtaataagcatgttggttgtgtatgtatttttcttttttgggcctcaatctgtcacccaggctggagtacagtggcgcaatcatgactcactactgcagccttgacctcctcgggctctggtgatcctcccacctcagcctcctgaatatctgggaccacaggtaaacaccatgatgcctggctaatttttgcattttttgtagagagagggttttgtcacattgcctaagctggtctcaaactcctggggtgaagtgatctgcccacctcaggttcccaaaacaaagtattaggattacaggtgtgagccaccatacccagcctgtatttttctataatgagatttattccaaggataaaaagaactaaaaagtaactttgaacctcactctgtggtttttattgttagtagcaatagtggtttaattactttgaaactactttttgcatattggtggggggaagcatctatgttaatgttgataggaaccacaaacttcggtgcgagagacaaagaaataacaagtataaaatcaaagaagaagaaaaaaagaaaaaaccaacaactctgaattgctgatccccaaaactgctaccttcttatcttgaaaactgctaattaaaggtaactttaattagctttccaattggaactgtatttcagaataactcaatagcctggggtgattggaaaaaaacttttttatagatgaatgccagctaataaatataataaatatatactgtactataattatgtgaaactgtattctaaaacacaaaataaataaaggtttgtctttttataataattttggtaagaaacaatggaattaattaacaggcatatcaaaatcatgtctttaatctgaaaatgctctattaatatctataaaataagcattttatagtgaatcatcctttcaaagcaaaattgaatttcttctactcacttcaagcaatgcttttgttaatctctgtacatttctttctttcttttccagctcttccatcatcttttgagtggtcagtttctctttagaaagctttccttgcatagactagaatttttaaaaaaattggaaagcaaaacaggttaacatgtaaagaaaaatctcaaacagaaagaagtaggaatgttggctctgaatactttaaatcttctttcctccccatccccttggaagatgaagccttcacttttaaactaatccctatcagttagagagtggctgaatccaaataaaaaagaaaaagaaatgctggtttcccagaatacatttggatttttttaaattacagtttttaccaaggaagtttttaatttgtataaaacatgtcaaatctgaagttcctacttaatatggtattacaaacagttcttatttcattaactttttatatgtagagagtgtattagcaacaaatctatatttttgttttacattttgcttacagttaatgagatgcaagataataagatcatgatatcatccctattttctatcatttgaaacatagctcccgtctttcattgtatagtaatccaagcagtgaatatactgtgaactctgggtcaaaggtctattatgggaatttgataagctaatctccttcttactccttataaaattgcaaattacctagacatgacactattgtgagtacgccaaagcagcataaaggacattttgagtctttggttagtcttttcaccaatatattaaaagaaaaaattgccatacaccctgtagttattagtgaattctaagtgtttctatcaactattttccttttattagaccacaaaatcaataaacatatgaccagaagagaggttatcattttatttcaggtctgtatttagtctcaattctgacaatacttcagtttgctgaccacctaaatagcacacaatctactataaagatattttcctcacattatctttggatggagtaaaaaaagatagctatcaccatgggttgaaataagactccataaatataaagcagttttatcagtaacagatactcaaacttgttgcttttaaatttcatttgtctgctaaactctgaaaaaaatattacatttagtaactcagaagttggacagaaatgaatcaaactctataacaagtgtttctccttctagggaaaagttgttttatattccacaaaaatgaaaaaaaaaaaagcaccaagtcaacaaggggctctctgaatacgtgtattattgaaaactgaaatttcctttgtaacttcattagattgactcaaatcttatttgattaaatgaacatggagagttatttacctagctgaagatctatcctttctggcctaacaagattatttggctggaatccagaattcaacctaaattttctcaagatttgtgacggtttattagaattacagaagaagggcatcatagacacactactcaaactcacattctaacaaaaaaaaaactaaactcgaggggtgttttcacaatataattattatatataacagaataattataataatgatacattgtaacagaatacagtcctttaaaagataagagttttatatttttaccaattcagagtcatgttgaatgtgactaataattagctaataaatccaactaatatgtccctatgtaagactgattttaatcagtgcagaaacaggcaatcttctccatcagaaaaactgaaaatgtctggcagtattgccatttatcacaaaaaggaaaatcagatttctcatatgttgcttgagttgaagggcagttatcaagaagcactttaataggtaaaagacattgcagataggcttatcctgaaaggaccaagtgctgtacaaattggtctaggataatactaggtatgagtgctatagttgtctgacagtaacatttcacctaaaacattaattacttctctatcctaaattgtattaagatatgtttaaaagataacaagaaaaattctatcaagaatactgtgcgttattttataaatactttttgcagagcatttttttgaaatctcttaagctcttaaaatatacttgctcaaactggtagtactttacaatgcataaatgaaatatctcatattttctgaaacgagtgtttggccttgtgaattttacaataactatttatcattcactagacatgtaggggattaataaaattaaaaattaatttgcaaacacctacaacagctctcaaattctcagtttaatcatgacatttaaaaattctgccaaggtactaacctacaaggtctttataatgatcatgtttgaagttgaacagtggaaataagcacatttgttgttttaacgtaagtatccagaaatgccccatttacaaatagcttgaatgagggaaaaccaggtgtgccttagtccagattctatataatccccaaacccaatttaaaaggaactattttgaaagaaaatttatgttaacatttttactgcatatatacacacataaacatgcataccatataagaaattcacagggacattccttcatgcaaaaatcattgccaaacactgttctgttcattgagtgatacatcagtgaacaaacagtcaaaactcttggcctttgtggaactttactaggagaaaaaagaccaaaagaaataaaataaatatgcaagttacacagtatcatgtattagaatttgactagtgctgtggagaacagagcacagtaagggtcaggagactgaaatctcaggtaagcaagggcctgaaggaagtgagagattgtgtcccagagatatccagagttcctatcagtacaaaggttctgggacagatggtgtcttctgtgtttgagaaaaagcaagagagccaggatggctgagaatagtaggagaaagagtcagagaaggaagacagcatgcagaacagattgtatagggcctcagaaatcagtataagaactttgatttttattctggaaaaaaaaaatgaggatccactgaagagttctgagcagagacatgatgtaatctgatttttgttcaaaaggatcacttaacctaatgagagtatactgtgcacaggcaagggtagaagcatgaagaaataacccagatgagaaagggagacagcttggaacagggtggcaatggaggaggcaaggagaagaggtcagattctagacatactttcaaggtagtagaatttgctgtcaaatgtgaggtaagtgaggagtcaaggataaatctaggatacctggactgaacaaatggaagggcagagatgccattaataggaaatctgaaatgtatagcagggtgtttattttggtggtggggagataagaaataaaaaaaagagccttttttaatgtttctaagaatctaagacaatgtacagctcgaattcctttcttaaattagttatcatcttgtaacttgataaaactttaaaaacaatctgcctggagttttgcttctagcatgacagtgtgaggagctccacagacctaccactcaatgaaattggtgaatattataattaaaaatttctggaaatggtcctaagagcatatagcaaatgaagaaacattactcaaggaaatctactaaaactcagtaagaagagtaagagactggtatttgaaataaaactctgcttcacgaaaggattctagagtagaaaaatgaaacaaaactcaactccatctctgacttctcacatctcattgggatggaaattctacttcagactgacagagccaataacacacggctccctctcctcccagaccctagttagacagttctctttccagaaaagatagggcatcaacatttatcatcctagcaaaggctgttttaggcaagtgcaaccaagagatggggggctcccttcttctacctcaatccccttatgggatggaagcttacattgagtgcagaaatcctgacccttgccccagcttgtggggcactggttctacgctgggagaggcaagtcaaaaagatgtagggctgctgccagaactccctccagtgagcgttcagctactagagtgggggtaccattcagaaatttgtcattgtccccacaccaattaacctggcttaagagattttgcctgaggaaaagtaggccatagaactagaagctccaaatgtctctctataggaattcacttcatttgcaacagtgtgatgacaaagccttagagcactcaaaaacattggagattgtcatgaaaggcagttgacaggatactattagacccattggccctataggctaaatccatagactactttcccagggaaaaacagtgagatagctgggaagaatactcctgaggtcagaacaaatctcaaacactaagctaatgaactgtcccttcaaaagagctagaatggatcagtttgtgaagcaatttatgccacagggcattgttgaaaacaactgaatgattggctacaattagtggagcctaacagctggatatggtcaagagtcacagaagaccatatatacatttgtatgaaatgtttaaaataggtatatttatagagatagcaggtagatcagtggttgcttatggctggggaagtggatgggggcttagggaagtgacaaaaatgaggcttctattcgagatgataaaaatgttctaaaattgactatggtcttggttccacttatctgtgaatatattaaaaagtattgaattgcacacttcaaaaaaggtgggtgaattgtaggtgacatttttttttttttttttttttttttgagacgagtctcgctctgtcccccaggctggaggacagtggcacaatcttggctcactgcaagctccacctcctgggttcatgccattctcctgcctcagcctcctgagtagctgggactataggcgcccgccaccacgcctggctaattttttgtatttttagtagagatggaagtttcactgtgttagccaggatggtctcgatctcctaacctcatgatccgcctgcctcggcctcccaaagtgctgggatgacaggtgtgagccaccacgcccggtgacttatatcttaataaaactgttaatgcttgagttctttggcttctaacttctggaaaaaatgtattttctggtttataagtatatctaccaaaatatgttaaatgtgtttgatgacacctaagtatctcagaaactaaacttgttttttaaatttaaacctcagtctttctctccagttcccactctttggtccactgagcgtgctgaggattgtaatgcttcctaaatgctctagttttactgccagactatatggcaaagttagggactgcctgaggaacttaataatacataattcgaaattcatcccagagatactgattcattaggttcacaatagggcccagaaatatatatcttaaaaagtattacaaataatgtgagtatccatatagatttggtgactattcgcagcgctaacaggcccaagaacattctttcatgattcaagtgagctgtcttcactcgtacaactcccccccgcgacataactgatttttcaagttaaatccaccttttacacattttttgacatatcttaattatgcaactataacatgcatacaacagatctacgtgaacagtaaagactgttctctttacaagtaccaagactacagtgtgtgcgtttttttttttttaaagctacttttcatagaaggcatttggctggtacatttttcaaaatttagtattaacttctgataagaatacttttagtttttcaccatcataagcaattttacagaagtaaatgttttcaaaattaaacttgagaaaaagaactttatttcaagacataacacaattcggataacaaaaaataggagataaacatcacacaataataatgggaaaacattaaagcaattgatatttaaaggagttatgttctacctataagatattccattgacttatgatccattttcccactatttctactgaggaaaactgctagatgaaggatttatgagatttgctaaaaattggaatagaattttcttaggctgtgggaacatctcgatgtgttataaatagaacagactgtgtcacagttttgagactggtggttccaaccacggccaagtaaacagtcttaatgtcctctaacgtattattctatcttttgtgatattatgatcatctattgatggctgtcaattcagaaaggccatttaaatgcctaagttcttgcaattagtaaacattttaatgtcagagaaaacaagcacacattacaaaactctatgtcctctgccaaaagactacaatgataacagctcactgaaaaaggcttacggatttgaaatgcacttttgagaaataagaaggaaagtaatgcccaatgaagaactcaatcacattctgactgcagccatatgttcatggaattgacaagcaacattctaccgcaaaatgtctttatatactgtataatgacagaagaaaaaacctataggagaagcagccaggctagctatactagttttatggatataaataagggcgacatttctaaaaggtcaatgagtaaacaaggtattcatgccagttaacaatatgaccttgacagctgaaaaaaacagtagataaatctgtatttttacagcactcaactcaatttccaaattagcatatacttttacatgaagtattactttttctatattcaacaacaaatatagtataactagtagaggaatgatttctctccaacttcgaaagctgtgaataaataaacatgccagtgacctataacagataagtatttatttgacttttgtggcaaaaaaataaactatagctgtattttgaacacagcatctaagtatgaaacaatgccctattttttatctcctataaattggacataaaatgtacatagcctgggatttttttttcccttttgggagtaaatttaaactgtatgaataacttgcttgttcccaaggaaatgcagtgcaccaaatcaagacaagtgaacttcaaacaaatttggtgttctcaacagtttgcaaggacataaagaggcagtaacacatgaaattctaatagtaccaagttatctttgtctactgaatactctagaatggaaaaaccaagcactgtggaggaagaaagaatatcccaactatagcgtcagtgagattttacataaaattaatactatagtgatagtcaaaatgcataatttatattaaaaataattgggaggttctctggtatccttaattatatagtgttttgtgttattttggataggcaaaggtatttgaagaaattcaaaaacagagctatagcatatggaaaggacatcataatctacataggtataagctgaccattctttacgtaagttgatgaggaaaaatcaggcagctttaaggaagtagaaagtgaagggaattgctgtattaggtatatcagcttgataatacacccattaattatgtccattaaccacaatagaaagccacaagaatattttttcaacccaaagtgttcttttcagtgtgtccaatgctagggaaataatcagtgctcctcttttaataacaagcaatattttcagatttttatagatatgccttttagaaaaaggtcaccaaaaatgaccaaatacaaacaaaatttgtctttttaaatgatgaggggccaaaaaataacatgagtttaaaactagtaaataattttctcattatgtgagtcatattcatctccagctttgctattcaaataccatcttcacaaatatagctattttagccagttatcaacatttattgtctgtctctgtgacctgtatctatagatctctgtgtctctagatctgaaaaccttgatggtcagaatgggcaaatgagatgctaagaacaaaaaagaaaagaaaaccaaaaaagatagccattgtttcaaaagacaacagaattaataattatagtgtctaggcccaaatatttggaaataaatgcatctcattaattttacttcaattctctacatagtttgaataaaagatttgtgtttgctgaaacaatttagtaacaaagaacagtatggcccataattgcatattcttctacatattcatttatgtatggtcatgacatatttacatgtgactacagacttggttaacatataagagtaaattgcagtaagatgcctccacaaatgggggaaaatgcacatttcaatgaatgctaatatatactgaacacctataatgtgacagtatgtgataaatgaaatcttacaagtcattaaagtttcaatgccaaagttcaagtgtcgattattcttaatttagattgagataacttgtattagatttacttcttggaaaacgtgcccaagtgaaatggaaattccttgaattatggtccagcataagtcacataacaatagctgaggaaatctaacaatctagaggttctaatggcttatggaacagctgaagttatgtttgtaggaatataaaataaagtttataacctctgtcaatcaatccatcaggctcatacatttattgataaataatacaaccaaaagacaaagaaagaagactgtatataatggcaaatcatttaccacttttactttgattttaagaagtaacagtaaaattaggggtataaagctaaacatttttcagcaaaagatgaccaatgacttcccatcacactacctcacatttcctgcactccaggctaacagactttgtgctgttcttagagcatgccaggtacataaagggcacttgttgctccctttgcttggaatgctcttcccctggatgtcttcgttcagatccctgttcaaatatcacctcttcaggaaaaacatcatgaccactctattaaatgtagcactctctagcctacttaattttttaaaataacatgtttaacagcaatttttttcatagcacctggtattcattatattggttttgtattctctccaactcaccccactagagtggccagggatgtgacttgttcactgatgaatctttacaattttttaggattaatttatcaaacagcaaaaactggaagattaatattaaagaatttgcaactttacctcagtgctataaatattatctttccatacgatatatgcatgctttaatattttcagattaaataagcattaagagtatatcagaatatagctaaattaaaataagcacaaaatattccttacctgaatttctaaaatcattctgtcaatctcatcttgttggctgtctattatctaaaacaaaataaatacatctgattcaaataatttttacatcgcttcttaaaagtaccaacatttcaagaaaacagcacagaaatttataaatttattttttaaaagggtctttttaaaaaactgaaagtatccttatgatttgggtcacacacgtataaaactacaaaagtcttcctctagttctcaataaaagttttctcaaatttataaaatttttaagagtaactttgagacagactgaataattaaggaaggaaaaagatatccttttgttttggcttttatttcaattatttaattttgtttcaattgctatggtcctttcaaataaaaacattcaaactagaaactatgtaagtgattaaatattaacaaaatataaatcacataaaatagctataaattatgtatctatacacacatatccacatagcatagatttcacgtttatgatctaaggtatctactgaccttactagcagtctcattttgttgtctgagattatcattttcattctgaagctgttttgcatctaacatgggaaggcggattccatcttcaaggcatctttctactttttgttgcaaactatttcaaaagacaattatatgaagaaaataagctctatttgctgattttggtaatgatttcaacataaatgattattgctttattaaaaaatattatagaccctaaaaatgacatcaagacccacagacagtatatgaaaaactgttatctatagttcataacaagtaagaagggtccatagttagctagaggctgatcatcttttcagaaatggcaaatttgagaccagagtccagagttgctcagtatgtgacatccttaggctccgatgaagtccttcattacccaaatctgagctctgaagtctaactcatgttctttccttttcctctaaaagcagggttccttgattaagatgatcattgcagggaacctaagaatatggatccacatcttttgttctttattctaagctcagcaaaagtttgcttgtaagaatagctgttgcctaaatcagtagagttgcatttctctttcatttcttttctttttttttttaacttttattttaggtttgggggtacacgtacttacaactgtattaattgagacccacgaggcaagagaagtaagtaaatctggaagatacatggcaaaactgctgtaccttttacttgcagtaaagttagaaataggagccaatcacttcaatttgatatattccattaaggagtgcagtttgagtattttactggcccctttttcgttatttagaatttttacttttttttttttataaagccattaggtaaagggtttgtattaatattttcagtcttcatttgtatgagtttttatttttactattttcaacagaaacttttggcaagatatcaatatattgcttcaaaatgttaaattataactgagataacctgtttcaatgaaattatgcttctagttcttaatacaggttgaacatccctaatccaaaaacctgaaatctgaaatgtgtcaaaatccaaaactttttgagcatggacatgatgctcaaaggagatgcccatggcagcatttcagattttggattgtcagaattagaaatgctcagtgggtaaatacttggcaaatattccaaaagctgaaaaaaatcttaaatctaaaacatccctggtcacaggcagtttggataagggatgagcatcctgtagtacatctttaaattaaggagaataaaataaaaattataaattaatttaagtaaaatgttttatgaaaaatacgaataaaataatgtagaaggattcagaaaattttcttacctctgaacggtagttactaactccttttctttctttttctggcatattaactgtgtctctttatcttgacactgctttttgatctcttcaagttttttttctgtatctatcaaagcctcttgtaaattcttatttttttcttccagaatctgcagctaaggagaaatgttttacagttcattacacatgaaatattaaatacgcttctattagaaactgttactgtgttggcaaggattaacagacttgtagctaaaaaaaaaaaaaaaaaagaatcacactgtattttatctagagtatttaattctccatctcttcctctgtgtgaaaggcacctagaagaacagaattacaaggaagagaatggggttagaaatttgtagaagaccgagaaaggttaatattctcattttaaatttattttacttttattgtaataaatatataactctatactgtcttaacaatttccaagtgtatgacaggttgaggttaagtacattcacattgttgtgcaactaatctccagaactcttcatcttgcataattgaaactctatatcaattaaacaactccccatctatctctccctccatttcctggtaaccaactttctactttctatctctgtgattgaattcttaaggtatctcattaagtggaatcatacagtatttgcctttttgtgactagcttatttcacttcacaaaatgtcctccaggttaatccatacgatagcatgtgtcagaatttctctccttgttaaggcgaacaggattccactgtatgtatataccacctttagtttatccatttatctggtcatggacacttgggctacttccaccttttggctattgtgaataatcacattataaacatgggtgtacaaacatctgttcaagacccttaactgccaccccagtggatgttaggtattttctgacatattttctaatacccattgccctctgttcctgctcatgcaacctcctgcagtccttaatttcctgcctgactttaatctctcttagtttttacaacttataaattaatgtaaaataaacagagaatgcaacataggtcttaaagtatgcagagtgacacttcatagattagattcttgagtgggggtaactttacccccagaagacatttggaaatatctgtttacattttgggtttgggataaacgagaaggagcactgctattggcacttagtgagtagagggcagatatgtggatgcagaagtacacccttcaaagatcaaggcacacccctgtaacaaaaaattatctgcctccaaatgtcaatagtgccgaggtcaagaatccctggcttagaacaactttgggaagagactgaagagtagatctagtggatttataaataaggtttcaagagagtggccctcacctcagttaggagaaagactctgaggtattgttaaggaaaaaaaaataaataaaagaaaaagtcagaggagttaattgaagtcataggtcaaggtataagaaaaatatatatatataaaggttaagaagaatgaagaaaatatctagaaagatagtcaacaaaaggtcttgtcgagccttggtgaatcctagagactgtgttggaaagcaccagaactgggggtgtgtgcatgcatgtgtatggggtagaggttggcagactggtttagaaactaacttctacagtagttaagagagttacaatacaggatcaataggaaggtaatcacttattaactgacaagaaagatctacttatgcatgcttagataaacaaagtttcttattagaattaagtccccaaaacagcaattaaacacatagatttaacttatagttagccaaatttctagagtcaagttaacatgttttcatgtcatttaaagataagcattttatttcatgttacctgtagactctgactctgtacatcatctagagttggaagatcagccagatacttttccaaggtctcaattcttctctgcttttctttgttttgttcagattccttctggcatttctttttcagactactgatgtatcgatctctagttttaagctaaaagcaaacaattatgaaccttcagtagttttcagtcattaaaagatataacaaaaccaacactttaatattagacaccattgaattcaccaacagtttcaggttatagcgaaggccactagcaactcaattaagatttaccttatttcattctaagatttacacttgccgggtgtggtggctcatgcctgtaatcccagcactttgggagactgagatgggctgatcatctgaggtcaggagcttgagaccagcctggccaatatggcaaaaccctgtctctactaaaaaaatacccaaaaaaattagctgggcgtggtggcacgtgcctgtagtcccagctacttgaaaggctgaggtatgagaatcgcttgaactggggtggctgaggttgcagtgagccgagattgtgccactgcactcctgcctgggtgatagagcgagactttgtctcaatttaaacaaacaaacaaaaaaagatttacacttaaaaaaatttatgtcactgaaatcaacagtttagggaatatttgcttttaccatggacggcatcctataaattgtcatcaaccagggggcagtaatgacatagtttttattgcctgcacatgtgcaaatttggtcaaggctgttcatatctttgtgatttcaatattgtcatatacatgtagaaactatgtgttgagtttaaatgatgtctaaaatgcctaaacaatgttaccttacaatttagtatggaacaatgttattgggtgcccagacaggcacagaaaaaaagcctttgaaatcagtgaagtattcatctctgaaggaatgactccgatttcttagtttttgcataactatacccaaatgctttatgggaactaagagaggaagatactacaagtaactaaaactattttgttacgttaacagacttgcagagaaattgcttatagtgtactaaacaatgcaactaaagctggaagaatacaccaaatacttaggggcagataatggactagtgaaaccaattcatacctcaagcaacactagtttaaggcactgtgtcataattgaatttgcagcttattttctttctaaaaaccacaaaataaaggtgtcttactattgatgtcattttaggattgataaagtatggtaaccgaacacttatgtcacacatggtgtgtacacacatgataatgattctagtaaatcccaatttatataggctgaaagtcagattttcatgtactttttaccccctactacatgaaatatatcatctataaatttcatatctcatagtcaaagctctttcatatttactcctatttaccttaaattaacaatcttccaaccatttaatcctcttcaaaacttacagggttctaaaatatttttacagtgttttcccatattcactgggaaaataactggcaataattagcagtaagatggattattctttcaaactttattaaagctaacacttgttcacagtctagtttctttcatgtattttctaatttttttcaggtctaatgtataacaatttttaaaacttcatgtggaaaaattattcatttcaccagtgacattaggatctacttatgacctctggtaaggagcaacactggtaagacaaacacatcctattatttattggggctttcttaggattaaaggtaaatgtgctggtgtgacagtttaccctgtgatctatcagaatagaaaaccttacatactgttggcactggtggtgaccatataatacaattccctttttacagatgaggcccaaagatctttagtgacttaacaagtcacaaaatcagaagtggaatttgaatctagatcatctgactgaaaatcaactttctttcagttctttgttatgactcattatcaggttcttattttagtaaccagctgtgcttggtccccatcaaccaagcctgctcttgccttagcaaatgaccctgtacattacagaggtaaacatgataaaccaacctatgtttacttaatgctctctaacttggactcaactgtctaaatgtcttcaatgtgacaaaatgatgcctcaaaaagcaatgactggaataggtctgtctgtgtgcaaagatgtcctacttttcttctttttcttttggttgtccaactctctttgctgtcatgtcaagcttgcttcccttgatcacaaattgctgccaacactctcctacgagacactgtctctgttatttgttggtcacatgttgatcatacatattcattgggtcttgggtttttttcagcctgctcacagatgacaagctctttgttttgttttttggtgtttcatttttttttaaaactgccaagttttgtgctgtcccatacaaacagaggttactgaagtctgaactgcattaattacctccagataaatgaggtgtcactaataaatcttctctattctattaatacaaggctaagtttttcttttcaaagaggtatgacgcaatactgatatcattcctagaaggtaataggaaggacatgttttataagaagttcacaaagttacttttctttattatctggcttttataagaaagaactcaaaggtaacattattattaccacattgttttttctgtcatagaatcagtctttgataaggattacagagtaaatgccaaaagaaacaatatgatccaatcttgtgtggacccaaagtgctgtttgttgatttgttatcaaggagcctgctcttcctaatctatgcactcccttgaagaactcaagtcatctccatgtgctctgacacaaactctgccctctacatctatcccctctcctcaaatttctctggtatgtacatttccattcttaattgcctcactcccacagaagctactcctcttcttttcggagagtaactctaccatatttgcatctgttaccaacccttcccgaacttgctccattatgcacccactctaacatctttgatctctctctctctcattgttttttccctagtctaccttactgctttctctcccatcctggcaaaaattacctgaaagaattcattcaacatgccaggcaccatgaatggtgctacatacgccacagagacacattcaaatacaatccccctgccttcaaggagcttagagagaaatataaaaaataatgattatacaaattgggttgagccctggaaaaaaagaataaaatgctataagcatatgaaaggaggagtagaagggaaaaatattaagctagatttgagcaaataaataggtgacttgaaagtgggagaaaaaaatagccaagtatttaccatgcaaaaaggccactctgtgtaaagatcctgataccagaaacaaagcctgagctgtctgagcaactgtaacacccagtgtatcaatacacagtttatcagaggaagattggcagaacctatggatatataattaggcaatgtgtctcaggccatgggaagaatttgatttatattttaaagacctggagagtagtgtcagcaagatggcagaaaagcaagtcttgaactctccttccccaaaccaacatgtgggttcaattaaaaaaatagtaaaacccccaacatggacaaattccctttttaagaaatccaaaaattagtcaagaagctattgtactctgggtgaatgcaaaatcagccacatggaagcaattaaggaaatgtaggacacctgtaatcctacccccaatacagcatatgatcagaaggaacctgttgggaaagaaaatagttggatcacacatccaacaccccaacttttctgggtgctgttcagaagactggcttctgccttgcctgtcttggaacactaataggaccatgacactcttgctgcctgggaccagtgagatcagaccggtgagatcagagatgatggtttaggctagcagtttccacagtccacagctccagctcagcactccagcaatgagtgaagaaactccagattcaagtttctccctgtgcagagaaagcaatggacagaacacccaacaatctgacttttcagaagtctggccaagggactggctgaaattctgcttgtctgagtactgataggacctagaatactcctgaagcctgaaggatgctaagaacaaaaaaaaaaattagttaaactagtacaaagatatgaaaagcccccctctctcgccagactgattagtgagggtcttctcctgtataaggctagtctctgaggagtggaagtgatagctattttatataatatacaagtatcaacttaaagagggaggaaaaattaacacacagggaaatatgtccaaaacaaacaaaataaatctcctgaaaccaaatctaataaaaccaagatacatgatttgcctgaaagagaattcaacatacccaacataaagatgctcaatgaggtcaggtaaacaatgcatgaacaaagtaaaatttcaacagagataggaaatactttaccaaacaaatcttggaactaaaaaatataataactgaaataaaaattcactagagagggtcaaaagcactctagatcaagcagaagaagaaataaacaaactcaaacacaggtatttggaaattatcaagtcagagtaacaaaaagaacaaggaataaaaaagtaaagaaagcttgagaaacttaaaaaacaccattaagcggacaaatatacacattgtaggagtcccaaaaaaggaagggggagaaagggaaagaaagcttattcaaagaaataatgactaaaaacttcccaaatatgtgtgtgtgggagggagaggcaggaggcatggggaatggacatccagatccaggggacccaatggaacccaaataagatgaccccaaagaaatatgtacaaagacacagttaaatcaaattgtcaaagtcaaaaagagaattctgaaagcatcacaagaaaaatgacctgtcacatgcaagagaactccaataagactatgagcagatttctcagaagaaattttgcagagaaagtgggatgataaacttgcactgcttgggcaatggggaatgggggtaattgtcaacccagaataatgtaagaagaagtgttcttcaaaaatgaatgggagtggctgggtgtagtggctcactcctgtaatcccagcactttggggggccaaggtgggtggatcacctcaggtcaggagtttgagaccagcctggccaacatggtgaaacctcgtctctactaaaaatacaaaattagctgggcatggtggcacgtgcctgtaatcccagctactcgggaggctgaagcaagagaatcacttgaacccaggaggcaaaagttgcagtgagccaagatcacaccattgcactccagcctgagtttgcaaaaagtgcaaagctctgtctcaaaaaaaaaaaaaaaaaatgagagataaagattttcccacacaaacaaaagctgtgatattatagttgattacctacccttgtactataaaaaatgtcaagaggaattcttcaagttgaaataaagggatgctaaacagtaatacaaaagcataagaaagtacagttgtcccttggtatatgaaagggattggctccaggacacctcatgtataaccaaatccacacatgctcaattcctgcatagaagacatacaaatagtgaacaggtatatgaaaagatgctcaacatcactaatcatcaggaaaatgcaaatcaaaaccatctcgtgcctgttaggctggccatcttttttcttgaaaaaagaaaataacaaatgatggcaaggatgtggagaaaggggaacccttgaacacttggtggaaatgtagaatgatacagctgctatgggaatctgtatggaggttcctcaaataactaaaaataaaacatgatcaagcaatcctacttctggatatttatccaaaagaattgaaatcaggatctctgagcaacatttgtactcccatgttcctagcagtattcacaataacccaagatgtggaaacaatctaaatatccagcaacaggtgaatgagcaacataaatgttatatacacacacacacacatatatacacatgcacacacacacatacgtgtgtgtatatatatacacacacacacgcacacacacacacaaaatggaatattattcaaactttgaaaagagaaatcccatcatttgtgacaagatggatggctctgggggatataatgctaagtgaaacaagccagtcacaaaaaggcaaatactacataattccacttatatgagataaatgaaacagagagtagactggtggttgtcagggactggggagcagggaagtgggagttactcttcgatgcatacaaagtttcaattacataaatgaataagtgctagagatctgctgtacaatatgcctatagttctgaattatacactcaaaaatttgttaaaagggtacatcttgtattaaatgttctttctacaacgaaaagagaaaatataatgggatggcataaattagttttaaccaaagaagtaaaatgactggatcctttgttgttaaaagttaagtcctttgcgctatcaagaatggatttgggaggatgtggagaaactggaattcccaacactagtagtgggagtattaaatggtacaatcacttgggtagtttcttgtaagttaaatatcgactgtacaaaccctatgatccagcaattcaactaccaggtatttatccaagataaatgaagacacacatagacaaaaaatcttgtacaagaacgttcacagcagccttattcataatttctccaaaatgctaaaaatccaaatatctatcaacaggagaatagatacactgtagtatatctttataatgaaaaacactactcagcaatagatagaaactgatacatgtagctataaaaataaatctcaaagacattgaataaaagaatatataccatgtaatttcattaatatgaagtccatgaaaagtcaaaattatactgataataatcaaaaagcacacacacaccacattttctttatcgattctttgcttaatgggcattcaggctggttccatatttttgcaattgcaaattgtgctgctataaacaagcatgtgcaagtgttttttatgtaatgacgtctattcctctggacagacacctagtagtgggactgctggatcaaatggtagctctacttttagttgtttaaggagtctccacgctgttctccacgctgttttccatagttgttgtactcgtttacattctcaccaatagtgtaaaatcattcccttctatttcataccaacatctatacacacacacacacacacacacacacacacacacacacacacatatgcatgcatatctagtgttcctgtctgtgtatttggtttttagcttcttattctgaatcaggggcttcagtttaataacttaagttgcatcattattaaagataggccagcttcatttaccaaccctttatgcccaacatgacaaaaaaaatgaaatcatagactcaataaggaaaaggagaacagttatttggtgtaggcaattaattttttaaagattttactatttgttagaaagatatacaagagcatttctatcctcaaagaaaatccttggatttctgcagacagcagagggcttctcaaaagttactacaaaattaatcacctccacataaatgtatacataacctggcatgacacctgacagggtaaatgacagacaaataattatatgctgaggaaatgttgttgacctaattcaactttattagaaaaacctactttttcctctagtttcttcttctcttcactaaataggcttagtctttgtttgagaaactcattaagctgtaaaacttctttctcagtagatgcaagcttttgctcaaattccccttgttgggaatgggaaactgattcctctgaaaatggtgtctggagtgaagtgttctcatattgtggctgttaggaaagaaaaaaaggaggtaagactttaaaagtttgtcttgaacaaatgtgaagaaattggaaatgaagtataatataaggagtacatataggctacatgaacagacacaccttgatttaaattccagctatcttgcttcctagttatgtaccataattaaagtaaattacttaccttctcaaaaccctggttttctcatctctaaaacagaaacaataaagcctactttgcagtgttttttgaagaaagataaagtatgtaaggtttccagcatataggagaaacttcatgaaagacagctattatttgattttaaaagtatacttcaacatgtaaatagtacagtatatacattaatcatataaaagtgaaagttctaagtaaataaataaaaactaaagaaaaatttcttcacagttaatcatttccagctaatactaaattcaatatgtattaatagaatgtttctctaactagaaagtaagatccatgaatcggggattcttgtccatctcaaagtgtccatcttatattccctattgcatagaaaaaaatggcacaaaataagtactcacaaaataattgttgaatgaataaatgtattattgcttctatgagcaaggctttgaaggaaattcttttcaaggggaagatattccctctcccccatgtaggattaaaatctggaagaggaaggcaggaaatacaaatattccttcaaacaaatcagcatgtggttaagtgctgtaaaaagatatcaacaaagtactgtaaaagcaaagaaagaggttatttttccatttatttaaaagatatttacaaagcacatacgttaggcattgtgctaggtgctggggattctacagttaataaaatcagatcccaccagtttaatgtgtcatacacaaaaagaccaaaaaaagacaatgaaactaagtgctaagatagttacatgtgcagtagctaagggagggtgttacagaagtaaatttgaactaggccttgaagaactgatactttcccaaaaggtaagcatgcaactcaaccattacagaaatagcatttatcatgtccaggctatttcaaagatggcagactcaccctttacaaactcaaattttaatcagagacatgagaagcctttagatgattgtaatatagaacagaatgaatatggtagccaaataaaggccatgttaagtacaaagtattgggagaaagtaggatacatgaagacattgagcgaatgaggaaaaaggcttttctggagaggtggcttttgagacagattttgaaaaacagattctggcaagaatggaaaaaggaacaggcattctagaaagaacatttttaaaaaggttaaaaagtagatacagagagttatcatgtcatgtttataggttacaagtgggcagaataaaagggaaaacttacaaatctaggttgcagccttcctgtagaattccaagaattgtgaacttggctttgtaaatctctatattccccagcattcaatctagtgtctagactctgagcaagtctgatgaaagggaagagatgagaggaaaaagacaagagagtgctagaagaaataggacaaagctagattcagtgaacaagatgcactgagaatgaatatggatgttatcatttaaagaaattattctaactaatttagctgaaaagaaacaaggagctgatatagagcatggagaacagaatgaagaaactggaagcagggtgaaaggatttagagaaaatgattatttaaagatgtaaatggaaaataaatgttaaagataaccaaggtttaagattttgtctaactaatacggaagattatcttctgggcagaagtaaatataaagaagaacagtaggttatatagaaaaataggttatacttaagcagatatacttaatataattagagcctatgattattatttcatttgaatatacaagtacagatggacaccaggcagaaagatagatatggaactcaggaagatggctaggctatgaaactataaaaagctaatacagacttccagtttctagcccagcgtgtaaagatatcagaagtcgccactcagtcctaaaaaaaataaaataaaaagctgaaaaaactgaaatatcaacaagtcttctaaagtctgtgagagaaatgaggttacagggcaaactgctgcctccaaaactggaaaaaaaggataggtagaaacagaggttcataacctaataaagcaaaaacccattagtagaagagccagggtgggaaaatctgtaactaatgaattgctagagacttggagtagataaatctgagagttaaaaattccacggggacccaatcatacaggaggtttccatatgtctgtgagttttacctccaggagtgttctacaagatcttcagtgagtatcagagaaaaatcccctcctgtttctggcagggggaggggaaaaggaaccatttaaaatatgccagagcattctgttcttaaaaatgcctgccgtcaggagaaactattttaccagagcctaaactgctggggttttatcagagcttaacgtagttggggtaaagggaataacccaactccagccaactccagccttccacatagaggagggttaatacacaaatcaagctcctttggccttccctgtggaaataccaactccatcgccctcctgccatcctgtcccgcctaagggtggggaaagaaaaaatcttagaaaactgaagttcacaatccagaggaacaaattcaccaaaagactgagacctaaacacaggactatagaatacttccccttccctgcacactttaccactgcattactaaagctctatttaccacacttattaaaccttggacatcatgtctactttcaacaaaaattacaagacacgcaaaaaggcaaaaaacgcagtttgaagagaccacaaagcatcagacacagagtcagatatggcaagaatgtcagaattatcagaccagggatttttgacaactaggattagtaagattatgatagaaaatgtagacagtatacaagaacatacagataacgtaagtgtagagataaaaattctagaaaagaataaaaaagaaatgctaaagattgagaacactaacagaaataaagaatgtccttgagggactcattagcagagtagacctggctgaggaaacaattcctgaacttgggatatgatgacagaaacttccaatactgaaaaagagaaaaaaaaaaaaccttaaaaaaacaacatgccttgtttcacatgaggcttctgacttggactttcgggttaatgctggaatgagttaaggctttaggggactgttgggaaggcatgattgtgttttaaaatgtgagaacatgaaatttgggaggtgctggggtggaatgacacggtttggttgtgtccccacccaaatctcaacttgaattgtagttccaataatccctatatgttgagggactcagtgggaggtaattgaatcatgggggcgattacccccatgctaccgttctcgtgatagcgggtgagttctcttgagatctgatggtcttacaaagggcttttccctctttgctcagcacttcttccttctatcatatgaagaaggatgtgtttgcttccccttccaccatgaatttaaatttcctgaggcctccccagtcacgcggaactgtaagtcaattaaacctctttcctttataaattatccagtctcaggcagttctttatagcagcatcagaacagactaatacaaagccctttactgttggtgaagaggtgatcctgcctgctgccaagcacatttgtcatgaactcttaggagacgctgcagttcaaaaggtgacatgtgttcatctttcatctttcagccatcacaacaaaatgaactgatgaaacagcagaggatattgaggcacagttgttaaagaggatgaatgagtcactgtggtatgcaatccaggttgaaaagtctatcaatgttaacaaggcaacaaggcttgcttttgtgtgatatattttcagaaggatgtgcaagaggatatgtcatacgcacttttattgccaaccaacaccacagctgcagaattattcaagtctttgaatgattacatatcagaaaaatggaattggtcattttgtgtcagtatacgcacagacagagaggcttccataactggatgtccttctggcttcacaacttgggtcagatggtcacttctgcatgtgactccacacattgtgtcacccatagagaaatgctggctagctgaaaaatgtcacctgaatttagcaacattttgcaggatatccttaaaattatcaaccacattaagtacatgcccttaacccacatctgatggtgcagctctgtgaggagatggacgcagggcacacacgtcatctcttatacacagaagtgattgctttgtgttattttattttatattttttattttattttattttattttattttattttattttatgaggctggagtgcaatggcacgatctcggctcctgcaacctccacccccggggttcaagcaattctcctgtctcagcctcctgagtagctgggattacaggcatgcgccaccaagcccggctaatttttgtacttttagtggagattgggtttcaccatgttggtcaggctggtctcgaactcctgacctcgtgatccacccacctcggcctcccaaagtgctgggattacaggcgtgagccactgtgcccggccagaagtgattgctttctaaaggtagattactggccagagtttttgagttacaagagccactccagagatttcttttagaaaaacagtcaccactggcaacacatttcagtgacacagaatggctcacaaaacttgcttacttatgtaacatattcaacctgctcaatgaagtcaatctgttgtcacttcaagggagaatgacaacggtgttcaagtcaacagataaaagtggctgcattcaaagccaaactagtattatgagggcaatgcataaacattgggatttctgacatgtttcaaacattagcagaaatcttgaaacagactgagccagggccttctttctcccagctggtacatggatcacctatctcagctttttaaagaatctgagcattaattcccaaccataaaaaaacccgaactgggaagaaatggatagcgacccacttgtaaattgccaggtgaatcaactttgtccacactagaagagaatcaactgcttgagactgcaaatgacagtggtcttaaaagtatgtttgagacaacttcaagtctccatacattttggattagagtcaaggcagaatatcctgagattgccacaaaagcactgaaaagcctgcttccatttccaacatcatatctttgtgaagcagggttttctgcaatgatagcgaccaaaatgagattacagagtagactggacataatcaacaaactttgggtgtcactgactcccaacactcccagatgagaccgtctagttgtggaaaacaagctccgggctcccactgattctacattatggtgagttgtacaattatttcattatatattaaaatgtaattataatagaaatgaggtatactataaatgttatgtgcttgaatcatcccaaaccacaccccctccccaggtctgtggagaaattgtcttcctcaaaaccagaccctggtgccaaaaaggttagggacttctgctatacactctgaagttatccttcaagagcgaaagagaaagacttccacagacaaaaattgaaggatttttgtggccagtatatctgctttgcaagaaatgttaaaagccttcagagagaagggaaatgacacaggtcagaaactcacatctagacaaagaaagcaagagcatcggaaaaggaataagtgaaggtaaaaatttttaaagctttattattcttaattgatctaacaagtgacattttaattacagcaacaatgtaatcatttatgtatgtttctgtgtatgtgtgcatgtatgtatacatatgcttatgaataagtgaaatgactgataacaatgatacaaggatgagaaggaagatggaggaattagaagtattttgctattatatggtacttatcataaggtacacttcattaccttcaggtggtgtagggttacttgacagcagacttggattagttataaatgtaaatgaaaactatagggcaaccactaaagaatgtaaaaagagaagtgtaataaagtagaaagagaaaaattgattaatataaaatgctcaattaaaatgactgggaaatggttggctcatgcctgtaatcccagtactttgagaggctgaggcaggaggatcacttaaggtcaggggttcgagaccagcctaggcaacatagtgagacccccatatctacaaaaaataaaaataaataaatacaaatgataaaagacaaagtgtggaacactacaaaaaaatctacagctaagcatcaaaatacatcaaacaaaaactgacagaactacaaagagaaacagattaatctactatcgcagttggagattttaacaactgtatcagaaatggacaaatctagcagcttgggaggccaaggcaggtggatggcttgagcccaggagtttgagaccaccctaggaaacatagtgagacccaatctgttaaaaaaaaaaaaaaaaatagagagagagaaaggaaaggaaaaagggaggaaagggaggaaagggagggagggagggaaggagggaaacagaaaagaaaagaaatggacagtttcaacaggcagaaaatcagtaagggtgtaatttatctcaacagccccatcaatcaattaactgtaactgacatctgtagactactcatccaaaaatggcatcacacattcatctcaagctcacctggaacattcaccaaagcggacaacattttgggccataagatacaccttaaaaagataaaaaatcatccaatgtctgctgtcagaccatagtggaattaaactagaaatcaaaaacagaaagacagctgggaaatcccaaaatacctggagattaaacaacacacttctacataatacataggttaaaaaggaaatctcaagagaaatttaaaaatgtcaactaaatgaaaaggaaaatacaacctatcaaaatttgtggtatccagtgaaagcagtacttagaaatttatagcattgaatgcatatattagataagaaaaaaaggatctaaaataaatcatctaagcctccacctaggaaatcagaaaaagtagagaatatcaactagaaaaagtaaatctgaaataaacaaaagaaactaaaagttcaatgtttgaaaattaattaaggtactccatcaccaacaggctaaaaaagacaaatcatgattatgtcaaatccacgaaatgcacttgacaaaatctaacacccattcatgattaaaaactcttggccaggcacggtggctcatgcctgtaatcccagcactttgggaggctgaggcgggtggatcacaaggtcaggagtttgagaccagcctggccaatagggtgaaaccccgtctctactaaaaatacaaaaattagccaggcatggtggcagccacctgtagtcctagctactcgggaggctgaggcaggagaatcacttgagcccaggaaacggaggtttcagtgagcccagatcgcatcactgcactccagcctgggggacagagtgagactctgtctcaaaaaaaacaaaaaacaaaacaaacaaaaaaacaactctcagcaaactagtaatagaggaagcttcttcaatttaataaagaacatatacaaaatacaagtatagctaacattatatttatagtggtgagaaacttgaagcttcgccaccaagatcaaaaagcatgcacgaatgtcccctctcactactgcttttcaacatcatactggaagtgctaactaatgcaataagacaaaaagagtacataaaaggtatactgattggaaaggaaggaagaaataaaaccatcattgttcacagataacatgatcatcttttataaaatgtcaaaaagaatccatacaaaaaaactcctggctaggtgcagtggctcatgactgttatcccagcaccttggaaggccaaggcaggaggatcacttgagcccagaagttgaagaccagcctaggcaacatagtgagaccttgcctctactaaagtatttttttttttaattagccaggcatggtgacacacacctgtactcccagccactcaggaggctgaggcagaaggattgcttgagcccaggagttggaggctgtagtgagctactgctgggagccaaaaatgccaaagggaccgtgaccaactcagcattccactggtggctatatgatcaaacagcaaactatttatcatgaacgcaggacgtgggcaaactcacactgcacctgctgctaaaaggtttcctgaggaccatcactccctggcgctgggctccttgaagttatctactgggaaatctagcacctattgttcgaaggatgcagtctcacaagcctgctgtgaaccaaacaggctgactgataattactcaacaatcaccctctctttctcgttatctcttttacctaatacattcagagggctgaaaaagctcaaggaccctgtccactagaggcaaggtgcccccgaccccttcttccaattatactcttttgtctttgtcttttattcccacgttcaccccctttgttcagtctcccaaggtccatgcaggctacaagtactgccccaaacagcaacaaaatcgggtgctcaacaagctacaattgcacatatgattgtgcaactgcatgccagcctaagcaacagagcaataccctgtctcaaacaaacaaacatcttgaagggacatctgttctacttcttcttgtttggataaacagcttgtgagaggcttctcaggaggcaagtctaatctcataggggcatgacactggaagtctttttctgcctcattctccacatggtcttgatctcgcttatttttgtcctcttcaattctgctttctccccttttcttcccccagaactggcttctctcctttctttctctttttccactttctgtccttgtgtttgtcatgattgtttttgtctttgaagaggctggagcagtgctccaaactgcccgtggagagctcagtaactgctttccctcctactttgaggaccagcttcaagggcttttccacatactctttgtagaggtgcttctctgacttgtgctccttgcccatgtctgaccaggccctggtgcccacctcccatgccaggcccaggccttggggtgccacttctggtccaggccaggcgaggtggaggacaggagcagggcctaccaaaccccgcacgccaatgcagggggttagcatgtgtgccaggtggcacaaggcccctcttgagaagacagcccatgagacctagctggggcctgagaacatgaatcaactgatgagacagctgcagagaaaagatccaagtgctcttttcgttttctgtgattttattgctcctggctactccatcatcattaaacacccaatggatctcagcaacatgaaagaagagatcaagaacagtgaagaactaacggataacttcaaaccaatatgtactaatgccatgatttacaacaaaccagagaccacttattataaagctgcaaagaagctgttacactcagagatgaaaatttttagccaggaaaaaattcagagcctgaagcagaccacagacttcatggctaacttgaaaaaacttgaaagcagaaagacagaacagacatctcacagagtggggaggatggaggctgctggctgagagagagagagagagagagaggactctggagatgccgaagcacaagccttcaagagtcccagcaaagaaaataaaaagaaagacaaagatatgcttttaagtttaaaagcagtaatttagagagacagtaggagcagcttgactgcatcatgaaggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcagcaaggataattcagatttaatctatgcaatctatgggggaagactgatcttccaagcaatttcagcaaccatgagtttctggccccatgccaagattacccatatgttaagacagatagtttgctggatgttttaacaaaaggaggggattccagggccctataagagttggagatatcacctgacgatgaaggccatactaggacacttgacacagcaaaacaaatggagattacacaagtagagccagcaggacatttggactctaatactcaagataggctcatggcactgaaagcagtaacaaactttggcgctccggttgaagtttttgactcttgaagaagctgaagtattccagaagaaacctgatgagaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtatggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatgttggttctttccaatttgatctatagattcaacacaatcccaaccaaaatcctagcttattacttagtagattcaatgaactgattctaagtttatatgaagaggcaaaagacccagaatatccatcacaatactaaaggaaaagaacaaagttggagtactgacactacccaacttcaagacttataataaggctacagtaatcaaaacaatgtggtattagtgataaaatataaaattaatcaatacaacaaaatagagagtccagaaataggacacataaatatagtcaactgatctttaacaaaggagcaaatgcaatacaggggaaaaaacagccctttcaacaaatggtgctgaacaattggacatccacatgcaaagaaaaaaaaaagaaactagacacagaccttatattttttacaaaaattaattcaaaatggatcacagacctaaaacacaaaactataaaactccaaaaaaaaaaaaaaaggtagaaaatctagatgaacttggctatggcaatgactttttagatataacatcaatgctgaatccatgaaaggatgaactgataagctggacttcattaaaattaaaaactttttccctccaaaaaacaatggcaggagaatgagaaaacaagccacagaccaggagaaatatttgtaaaagatgcatctgatctaaaaacaaacaaacaaaaaaaacctgttatccaaaatgtacaaataataggccgggcgcggtagctcacacttctaatcacagcactttgggtggccgaggcaggcggatcacttgaggccagtagttcgagattggcctggccaacctaatgaaaccctgtctctcactaaaaatacaaaaattagctgggtgtggtggtttatgcctgtagtcccagctacttaggaggctgaggcaggaaaatcgcttgaacccagtatgcggaggttgcagtgagccgaaaccgcatcactgcactccagcctcggcaacagagggagactctgtctcaaaaaaagaaaaaaaaaaatcatacctacataatgaagcttacatttaaaaaaaaataataatactaggtctacagaacttctagacagctgaatatgtggaagttccctcctgaagggtggcacccctggagatggcatgggatctccacattccttatctcataccttcccctatgcatctcttcaatctggctgttcatctgtatcttttctaatatcctttataacaaatgggttaagtgtaagtaaaaagcttctgagtttcagcaagttaatcaaacccagggagggagttatgtgaactctgatttatagccagttggtaagaagcatttgggacttgaaattggcatctgaagtggagggcagtcttgtggtagtgagtcctcagtctgtgggttctgacgctatctctacacatacagtgtcaggattaaattagaagacagacacccagatggtgtctgctgaagaatatgcagaactgactgcctggtgtgtagggaaacaaataccatacatgtggtgcagaagtactgtgctgagtggagagtagagtgggaaaaatgcatctttggtttttcctatatcactacagcggctttactcataattgccaaaacttggaaattatcaagatgcccttcagtaggtgaaggctgtgcatgtgtggggatatggaggatatgggaaatcttggtacttcccatttaattttgtagtcagcctaaaactgctctaaaaaataaaattcataaattttcaaaaagttatcacaggtggggccaggcgcggtggctcacacctgtaatcccagcactttggcgggactaaggcaggcagatcatgaagtcaggagttcaagaccagcctggccaacatgttgaaaccccgtctctaataaaaatacaaaaattagctgtgtgtggtgacacgcgcctgtaatcccagctactcaggaggctgaggcaggagaattgcttgaacccaggaggcggaggttgcagtgagccaagatcacgtcactgtactcaaaaaaaaaaaaaaaaaaaaaaaaaaaaagttaacacagatgcttctactataatacaaatatatgcattcctggaaaaccactggaaaatcatgcactaaactgtgatatacccagaaagcggaacattattcagtaataaagaaaaatgaactatcaagccatgaaaagatatagaggaaacttaaatgcatactactaagtgaaagaagccagtttaaaaagaaatggtttgaatagtatgtactatatgattccaattacataacattctgggaaaggcaaaactatagagaccataacaagttcagtggttgctaggggtccaatgggttgaacaggcagagcacagaaaatttctagggcagtgaaactactctgcatgatacgataatggtggatacatgtcattactaatttgtcaaaacccttagattgcacaacaccaggagtgatcctaatataaactattggtttttgagtgttaatggtgtgtcaatataggttcactaattataaataatgtaccctaaggtacaaaacattgatagtgggggaggttgagcacgtgtgaagatatggaggatatgggagatcttggtacttcccattcaattttgtagtaaatgtaaaactgctctaaaaagtaaagttaataaatttttaaaaagttaacacaggtgcttctactataatgcaatatagacattcctggaaaatcatgcactaaaaataatagggcgtatggaacgaataggattaaaaacactcaattcaaactgatgcaattttaactagtgcactaacaaaaacagtgactcaggagataacttggacagtctgaacaggtggtcacagtgatattttaaaaccacatacacacacagtcaaaatgctggcggtactttaattagaggtctggtgagtgttcagatgatataggtggactctgtgatatagggcttgccgtgcaggtggagtaggagggagcataacctggcgtgaactgaaagtctataaagaaggaagtgcacttctcaaggaagagcacccaaagggcaggtactcttttacaattttcttatgtaagttggaaaaagcttctgctaatgtagtaggtaaccctaagccttttgctttgctggccaaatattttaattttattcaccatattctaactccccttgcctggggagttggtgggggaaagcacttatgaaccaatctagaaaactaagcagacatcattctcctatttaccaattgtgtatgagcaaatttgcaccatagaaatgtgttttgtagcaagacaagctgtagttgaaactctatgtgaacttaatcatatagaaaaacaaaaatctgaggtcagatgttttaatttctacatttagtaacatcttttcaacctttatctgccttctctgacttttatacaacggttccctttctatggaaaaacacttgcttgctttcctttctagaacaactccctcaggctccttcacaagttgtgctcttctgctaccttctaaaatgctgctgtttcctgtttctagttctggatcccattttcctctcattgcacaaatcctcccttggaatacctgatcatgcccaaggctttaataaccacccacctagactgacaacacctaaatctcttatctctggctcagacctgcacccacaaatattaccctcattcttcactcaaccccaaatttacaatgtgtaagtttaactcactatttttctcctctaaacagatccttaacatagtaatctctataaaccaatcaattgttgctgtatgaaattaggcaatcattctctcaccacattaaatatgtcattaaatctggcccattttaccatggcttggtcatacagatgtttaatcaacagtcttcttctcattctgaccactacagataaaattcaaatgttcacataacttttggactattgagacagcttcctgactggtttccctgcctccaataacatctaccttaaatccaatctctattatgccatcagagtaaccaaactaggatactttggaggtgaaagatggcactattaataaatttataagcacagcaggcataaactgggccagccctaagcaaacctttacacctcaggtcattgatatcactcggcccttgcttacctcttcaaccacatatctaccactacctttctctcacattacatttcatccacacagaataatttgtagttttccaaatgcattatatttctcatcattcctttaagcttctccatatgccatacactatgcctcaaaacactattccttcacccccttcacctggctcaattcatttagttcatcaggttctcaaactagattatcacttcctacaggaagcctggccaggcttttggaagattagcttctatgttcatagctggggttcccacagcacttcatacataaaccctgtgcgaatcaacacactgcaactatctcttgtctgtgttctccattagactacacattccttgagggcaaaaccagcttcattcacatttctattgctacagcataaatggaaccttatccatagttaagataaacaatttttaaggaaatggataaatatattttttggtatactctctctgtagggtttaagttccataaaggcagaaaccattctttgcttttgtgttcccagaatttaacacattagatgtttaatgttttgttgaggaggctcatttgcaaaggtgggattcattttattaaatgttcattagtacagacttggtggtggaaacaaaccaattgaagaaaaaatagaaaaaaatgatataaatggaaagaaaaagaataaaatggaaagaaaagaaatgatgcaacaatgaaacttaataatagtaactattatttggttgatctttccaaggtacacatatatacagaaagaagagacctctttcttctccaatttaagtaaagaaaaagggtccttcatatttggtttattccacaaagtcctgttaaccacagatggaaatttaggtataaatggaaatacaaactattccttggctctaccaatctaccattagaactatccagaaagtttggattttagaataaagacatggttctcattctctacctatgagactgagtgatatctacttctaaggtcatcttaattgtaaggttagtcaaatttttaataagaaaatagaagttacttattaagagtatgttttccatctataaattcatttaaaaatgttacttttattttactgacttatttactctagaatacacattaatttcaataattattattaaaagcataattttctttgtctagtgtctatagaattaggatgaatatgttatggatcagaaaaatgtacctatacaaaatgctatgcataaaaaattacatcattcaaagatccaaagttaaaaaaatccttcgctaaagaaatattttattactctatctgctgtttcttctaaccctcaccattttattggctctctgtatctatccattgatagaagtttatcttatatatttatcatacccatttagtattaagattttccttgtattctcttttacaaattgctctcatcttttaaaatcagatttctcaataatatttcaattcctcacatacttcaaaatcctactaatatttttaacaaccccttttacatatccttccaaatactaatatttttatttgtccttgcacgctggcttggagagccctctactggcctgatgctgtgtcaaaagaacatttgcttcatccttcagatacctattttttacatgctttcgataatatgataattatataattaaagcctttattccgaatgacagaatgttaaagagaaattgaacaattctactaaaatgctgttaccaaagcaagatacactacttccatagtatagaaataccattttcaaataactgtacattattctcagtactcattataaagccttgctatcatgtgacagaagtccaagatgagaccaaattataacatgatgtattcataactaaagtataaaaggcaagttggagtctctatgttaaatgcctctggcctcaagaaaatctgatagttattttctcatcaatatttcctgattttaatataccaatgtctctagtatttataaatatcacatttgaagatatgatgaaggaaacaattccacttaacttaaaatctaggaataaaggccgtaatgaagagaacaacaataacaacatccacaaatagaagtatataccaccacaaagttatcaggcctcactttagatcccaataagtacgccaacagtctttttctttgggaaataaaccaatataaagtttatataaaaataaacatgcaaacaagttttaaaggaagctctttttaaaactgagtaataattaaggaaagtagccattccagtcatataaattttgttaacgggcctcatagactctatatctgtgttccaattagactatactctccttatgggcaaaattaacctcatttacatttctattcatatggcgtagacactgtcttacctacagtgaatacaaataaatttagaaggaatagacaaacttgttttcctatatggtctctccctctgtaagttttgagatccatgaaagcaggaactatttttcacttttgtgacatcagaatttaacacagtggatgttatgtcactgtttggttaaataggctcatttgtaaaggtgagattcatttataaaatactcattagaatcagacctcattgtagaaaaaattacatagaggaaaaggaaataataatataaacaaaatattgagacaaaattggaaaatttattttcaaattaaattatagacaaaaagctaatttcctttatatatacagggctccaaaaaacaataagcaaaaacctacaacctaacataaaaaatgatcaaaggatatgaaaagaaatgtgaatgggcccttaaatttataaaaagaaatataacatcactcttaagagaaatacatattaaaaccatatgaccataaggagataaatctcccctttcttttatatagacctactagaagggcaaaaatccaagtttaataacacactctgttagcatggctgggagttggggagtgggacggtgagagttcttatacactgctctcctaaagagcaatttgacagtatcagtaaaaatcacaaactcaatacctagaaatttcacttctggaaatgtaacttacaagaatatctgcatatgagcaaaacagtatttataaaaggttattctttacagcatcatttacaataaccctaaactgaaaacaactcaaattttgatgagtagggggcaggtagaataaattatgctatctccataaaacagaagatcgtgtaactgcaaaagcaagggaaaggggtgttatctaggtaatgatagagaaataatcactgtgtgttatataattgtatataacatttaaaaaaaagcaaggtgccagataatgtacatattcttatatttttttaaatgcagaagaaggataaaacacacttatatctgcttgtgatatgcatcaactctggaagggatacaccagaaactgacaacagtagttcctgtatgtgtgtggagaggggtgtgcaatctggacagatggaaggctgtagttggacactctttgccacacatataaataaatataaatcatgtgaatacattattaagttgatttaaaatgtccttatattacaaggtaagtatattattaacacaagctttactactaaaacagctacaaaatcctctgtaatcttacctgcaaactagccacataagaatcctcacaatttacataatgtcctaacatggcatgttgagcccgtaattcattatcccttatcctctcatgcaggtgggtaatttgttgcttctgcctgcaaaacataaattaaggtcacattatgagttataattttctaatagttagaagaaccttaaggagcttattcctcttagattcctttaatattcctcttagattctaacagtcacaccttgctttcttcaacaactcatagcttgctttaagcaagttatttaatttctgtaaatatgtatgcttagaaattttaaaactgttttgtgccaggcatgatgctaagagctttgtatgcagtatctctcatcttcaaaaatttattaactctcatgatgaagttttgaaggagagagcttttaaagaataataaagatagtatgagtaaacaaatagcttgatgttttccaaaattacttacaaagtaacttttggaacaagtaagttgtatgtttcaggttgcatcaaaagaccttgttctactcaggatgatttctaaaatttgctaacctttaagaaaatccacatataaaacattaaataggagataagtcaggagagattcgtcatataacacttttcaaataatttaaagctttacaagaaagaaaaaaaaaaaaacccttccttttccagccaaggtgcagtagcaggcagggactagttttgccctcatgcctgaaacaattttttaaaaaagacaaaatataggaagtgaagactctcaaggcattgggccaccaggcaattaagaacagtaatctcttagagataggtaactaatgaggtgggccctatgactgactgcacttcctgctgagagagttttcaagccccagcacaggaatggtggtctccctgaattgaagacacaaagctgagaatctggagaaaccaaggcagctgtagttagttcacagtactcgataacccttgggcactcggttgaatactaattaatacaggcatgaggaagctaccgacggtgtgtgtagagtggaagggcaaccaaaaaaaatattacagggaacagtgcttcagggtgccttggaattactggctattcccaactgccagaataaaaagcttcatgattcccagggcatcagcaattctcaactggggacagttttgaaaccagttaacatttagcaacatccagagacattttcaattttcacaactggggcagaatgttactggcatctagtgagcagaagccagagatgctactaaatgtctacaatgaacaggatagccaccctcaatagtgaattatctgatccaaaaaaaatcaacagtgctgaggctgagaaacccagggtttgtaagatgagtcttgtctcagtggggaaaaaataacccttgataaaacagctctaatgccacctaacaaaacttaaaagcaagtacaaaaactgcttcctagaataaagttcaggaatacaaaaatgtaatatcaaaaacaagttaaaattcataatgcctggcatcaaaaaattattgggagtacaaaaaaagcagaaaaaatgtaactcataataataagaaaatccaatcaactgaaagtgagctagaactgacagagatgttaaaatagacaaggatagtaaatcagttattataactattcatatgcttaagttagaagaatgaacgaacatgttaagaggagacatacatgacaaacaacacactgaatggtgattaaaacattagacattacagcacaaaagtacagtaaatttaaaaacagcaatagaaactatctaaaaagaaacactagagaaaaaaggacaaagaaataaaacaaaaaagctcatagtatcagtgagccgcgagattataagaggccaaatacatgtacaattggaatctctaaagaggaggtaagaaggtggcagggggtgggagtaggggacagaaaaaaaatatttgtgtataacaggccaaaattttaccaaatctgatgagaactatacacccataggttcaggaagcccagtgaaccccaaataaaagtaacatgaagaaatctaagacaaggtacatctaaatcaaatagattacagtgataaaatcttaatagcaaccagagggaaaaaagataaatccattcaaggagacaaagatgaagaggatggcaaatttctcaactgaaataatgcaatcaataagacaatgaagtactttaagtactaaaatttaaaagctctcaacctaaaatttttgacatgagaaaaaatttgaaaacaacacaaaaagcatacaaaaaaaacctgttaacctataatacttcacccacagaaaatatttttttaaaggttaaataaagatcttttttggaaacttaaaagctgaaagaattgatcaccccagacttcaactacaaaaaaaatgataaaggaacaccttgaggtaaaagaacaatataccagatgaaaacctgaatttacacaaaagaaagaagaataccagaaatgataaacacatgggcaaataaatacataagatatttttcttattatttaaatctcattaaaagatcataaattgtttgaggcaaaaaaaaatttatatccacgttgtataacctttgtagatgtagaatgtatgacaaaacagctcaaaggctagaagagaaaaaaatggaactatgctttataagattcttacattatacataaaatagtatagtattacttgaagatagactgctatactttaaaatatattataaactctaaagcaatcattataacaatagaggtatagctaacatgccaataaagagataacaggaattgtaaaaaaatattcaactaattcaagagaaggcaaaggggaacaaagatcagatgggacaataagaaaacaaatagcaatgccaggcacagtggctcacatctgtaatcctagcactttgggaggctgaggcaggtggatcacttgaggtccggagttcaagaccagcctggccagcatggtgaaaccccatctccactaaaaatacaaaaattagctggtcatggtgatgcatgcctgtagtcccagctacctgggaggctgaggcaggagaatggcttgaacctgggaggcagaggttgcagtgagctgagatcgtgccattgcacttcagcctgggagacagagcaagacactgtctcaaaaaaaaaaaaaaaaaaagaaaacaaataccaatataggagatttaaacttgaccatatcaataatcacaacatgtaaatggtttagatactcccaaacaaaaggcagacattggcagaatggataaaaagtaggacctaactatatactatctacaagaaagaaaaccattctgaacataaggacacaaacaggttaaaagtaaaaagaggaaaacctgtgctaaaaataatcaaaagagagccagagtaactatattaatattagtagaagcagattttttttttttctattttagagacagggtgtcactctgtcactcaggctggaaggcagcggtgtgattagagctcactacagccttgaactcttgggctcaagccatcttcctgtctcagccttccaaatagctgggactatatataggatccactgtgcccggctaagtttttttttttttaattttgtgaaggtgaaatctcactatgttgcccaggctggtctcaaactcctggcttcaagtgatcttcccgcctcaacttcttggtgttggaattacagatgtgcgccaacttgccaggccaaaacagattgttagagcagagaatattgccagggacaaaaattataacttaataataataaaaagatcaattcattaagacgtcatgacatttgggcctaagagcacagtgtctaaatacatgaagcaaaaaaactgataaaacagaaaagaaacagatacatccacaattgtaattggatattttgacacctggatctcaataattgacattaatagaacaagtagacagaaaatcaagagaatataaaagacaaaaacactatcaactgatttgtactaaaaggaatttctagaatactccccacaaaagacaaaagcagcagaatacacaccctcttcaaggatacatgaaacacttattaaaacagatgatcttctgagccatgaaacaagcaccaacaaacttaaaagaattcaattcatatagaatatattcttggaccacagtgaaattaaatcagaaaacaattacagacagaattctagaaaatcctgaagtatttggaaacaatgtaacataattgtaaataactttagggtcaaagaagaaatcagaagataaactaagtattttgaggtgaacaaaaatgaaaaccaaacaaattaaaatttgtaagatattgataaagaagaacttagaaatttattttttattttattatactttaagctctggggtacatgtgcagaacgtgcaggtttgctacataggtatacacctgtcatggtggtttgctgcacccacatcatctacattaggtatttctccgaatgctatccctccccaagacccccacccccagataggccctggtgtgtgatattcctctccctgtgtcagtgtgttctcattgttcaactcccacttatgagtgagaacatgtggtgtctggttttctgttcctgtgttagtttgctgagaatgatggtttccagcttcatccatgtccctgcaaatgacatgaactcatccgtttttatggctgggcatagtattccatggtgtatatgtgccacattttcttcacccagttgtatcattgatgggtatttgggttggttccaaatctttgctattgtgaatagtgctgcgataaacatacatgtgcatctgtctttataggagaatgatttataatcctttgggtatatacccagtaatgggattgctgggtcaaatggtatgtctggttctagatccttgaggaattgccacactgtcttccacaatggttgaactaatttacactcccaccaacagtgtaaaagtgtttctatctctccacatcctctccagcatctgttgtttcctgactttttaaggatcaccattctaactggtgtgagatggtatctcattgtggttttgatttgcatttctctaatgatcagtgatgatgagctttttttcacgtttgttggccatataaatgtcttcatttgagaagtgcctgttcatatccttcacccactttttgatgtggttgtttttttcttataaatttgtttaagttattgtagattctggatatcagccctttgtcagatggatacattgcaaaaatgttctcccattctgtaggttgcctgttcactctgatgatagtttcttttgctgtgcagaagctctttagtttaattagatcccacttgtcaattttggcttctgttgccactgcttttggtgttttagacatgaagcctttgcccatgcctatgtcctgaatggtactgcctaggttttcttctagggtttttatggttttaggtcttacgcttaagtttttaatccatctttagttaatttttgtttaaggtgtaaggaaggggttcagtttcagttttctgcatatggctagccagttttcccaacaccattcattaaatagggaatcctttccccattgcttgttttcatcaggtttgtcaaagatcagatggttgcaggtgtatgatgttatttctgaggcctctgttctgttccattcgtctatctgtcttcgtacaagtaccattctgttttggttactgcagcgttttagtatagtttgaagtcaagtagcgtgatgcctccagctttgttctttttgcttaggattgtcttggctatctagactcttttttggttccatatgaaatttaaagtagttttttctaattctgtgaagaaagtcaatggcagcttgatggggatagtattgaatctataaattactttgggaagcataaccattttcacaatattgattatccctatccatgagcatggaatgtttttccatttatttgtgtcctttcttattgccttgagcagtggtttgtagtgctccttgaagaggtccttcatatcccttttaagttctattcctagatattttattctctttgtagcaattgtgaatgagttcactcatgatttgcctctctgtttgtctgttattggtgtataggattgtgatttttgcacattgattttgtatcctgagactttgctaaagttgcttatcggctcaaggagattttgggctgagacgacgcaggtttctaaatatacaatcatgtcatctgcaaacagagacaatttgacttcctctcttcctatctgaatacttttatttctttctcttgcctgatggccctggccagaacttccaatgctatgttgaagaggagtgtgagagagggcatccttgtcttgtgccagttttcaaagggaatgcctccagattttgcccattcattatgatattggcggtgggtttgtcataaatagctcttattactttgagatacactgcatcaatacctagtttattgagtttttagcatgaaggggtgtcgaattttatcgaaggccttttctgcatctattaagataatcgtgttgtttttgtcattggttttatgtgatggattacatttattgatatgcgtatgttgaaccagccttgcatcccagggatgacgccgacttgtttgtggtaggtaagctttttgatgtgctgctggattcggttttccagtattttattgaggatttttgcatcgatgttcatcagcaatattggcctgaaattttctttttttgttgtgtctctgccaggttttgtcatcaggatcatgctggcctcataaaatgagttagggaggattccctctttttctactgtttgaaatagtttcagaaggaatgataccagctcctctttgtacctctgttagaatttggctgtgaatctgtctggtcttggactttttttggctggtgggctattaattactgcctcaatttcagaacttgttattgatccattcagggatttgacttcttcctggtttagacctgggagagtgtacgtgtccaggaatttatccatttcttctagattttctagtttatttgcgtaaaggtgtttataatattctctgatagtagtttgtaattctgtgggatcagtggtgatatcccctttatcattttttatcacatctatttgattcttctctcttttcttctttattagtctggatagcagtctatctattttgttgatcttttcaaaaaaccacctcctggattcattaatattttgaagagttttccaggtctctatctccttcagttctgctctgatcttaataatttcttgtcttctgctagcttttgaatttgttcgctcttgcctctctagttcttttagttgcgatgttagagtgtcaattttagatctttcctgctttctcttgtgggcatttagtgccagaaatttccctctaaacactgctttaaatgtgtctcagagattccggtacattgtgtctttgttctcattggtttcaaagaacatctttatttctgccttaatttcattatttacccagtagtcattcaggagcaggttgttcagtttccatgcagtcgtgtggttttgagtgagtttcttaatcctgagttctaatttgattgcactgtggtccgagagactaaatgcctataccagaaaaaaagaaagctctcaaattatctcagcctccactttaagaagttagggggaaaaaaagggccaggtgtggtggctcatgcctgtaatcccagcactttgggaggccgaggcgggcagatcacgaggtcagaagttcgagaccagcctggtcaacatggtgaaaccctgtctctactaaaaatacagaaattagctgggtgtggtcgcgggctactggggaagctgaggcagaagaactgcatgaacccgggaggcggaggttgcagtgagccaagatcgcgccaccgcactccagtctgggtgacagagcaaaactctgtgtgtgtgtgtgtgtgtgtgtgtgtgtgtgtgtgtgtgtggcgggggggggttgtgaaactccgtgtgcgtgtgtgtggcgggggggttgtgaaactccgtgtacgtgtgtgtgtgtgtgtgtgtgtgtgtgtgtgtgtgtgtgtgtggcggggggggggtgtgaaactccgtctcaaaaaaacaagttagaaaaagaagaacaaatgaaacccaaagtaataaatagccctatgtatattacagaaattgggtttttcgttgacctttcaatacagaaagatcaggagggtcaggagtcttcactgaagaattctgctgaaagtttaggaaataaaaaatactagttgtacacaaggtaccccaaaaaccagtgaataattcccaactctatgaggccagcatgaccaatatctaaaccagataaatacattacaagaaaagaaaaatacagaccaatatctcttataaatataaatgtaaaaattcttaacaaatggaatccaaagatagataaaaaggaaaatacatcataaccaagcgggtatatcccaggaataacatggtaggttttacatctgaaaattcatcagctacctagaatagaagtagtttccacaatctaaaaaaggcaactacgaaaaacagctaacatcacacttaatggtgaaaggctgaagactttcacctaaaacaaactagggacaagagaaggaaaaggatgtttactctcactgcttctattcatcactgtattggaggctctatttacttcagtagaaggcaagaaaaggaaataaaaagactctatactgaaaaagtaaatccacctttaatcacagacaacatgatcgtttatgtaaacaatcctattgaatctacaaaaaaatacctacttaaactaataagtgagattagattgcaggatacaaaaccaattttatttctatatatttaagaacgttttgaaaatatgcattttttaatcgacataattgtcatatttgtggggtataatgtgatatttagatacatgtatataatgtatagtgattaaattagagcaattagcatatccatcatctcaacctttatcatttctttgtgctgttaacattcaaattactctcttctagctatttgaaaaaaatataattattgtttattatagttaccctatagtgcaacagaacactagaacttctatctagctgcaactttctattccttaaccaacctctctgtattcgctacttcccccagccttcccgcctccagtaaccactatcccaaactccacttttacgagctaaactttcaaaaaacttcatttttgcttaagtggtgagactccttcacccagtcagttaaggagatcgaaatgcaaaaggtcaagcactactcaatcacctaaatggttatagtggcaaatgtttttctgaattgttcctgaagttaatctatacactttttctcatgagatggggagcatttaggaacagtttctatagcagttatttttcccattttctctgctttaacctaataatccagtctcctcctatgaaagttatacgcagtgtgaaaaaaaacacattttttctcatgtaattttggataatatattttcagaagtaatatacaacatataatttttacttaagtgatttgaaaggtatcgctgaccacaccatatcccaaactaaaaagttcggcaggtttactttcaattccatccaattggacaccaaatcccatgaagtctggctctgaaatagcctctacatgtgccatcaacattttaaaggccattactctcatctgcttcttcaaaaacagaaatgttatatatttgattccaatttaagtactatatatgttatagaaatttgtatatacaaacatttttacttttaaatgacagttatgctgctttagaaacaaaagctgcttagtttctcttctgttttatacaatatcaaatgcactgattatcaaaaactttataataaactcataaagaaaccaaagattatttaagatactgggtaggttatttactaaaatgcctccattattacccttcctatattactaatgcctcctgtcaacgtgattttgctgtttccactggccagaagtgaagtccactactggtctagtgactaacagaatataatggaagtgatgttgagccagttctgagtctaagcttcaagagacttcgtatgcttcattctttcttagaatcccacccagccaccactcgaacaaacccaggctagcctcctgcaggatgacagaacatgtggagtaagacaagccatcctgccgtggcccatcctatgccacccagcccccacctgctaccacagacgcataaataagcctagctaaagaattagccaaatgagcaacttgagttattttgaattattccttagtctgattctacaatatataaaattgagaaatatatattttattatattatgtcaataattttctgcattttctattaacttatatccaatggaatggtattcaaaaaaaaataacatcaactgatttccattgtttgagggagggcaaatccatgtaagtaaaactgaactttagtccattttttaaaagtattaatttcaggccgggcatggtggctcacacctgtaatcccagcacttggggaggcagagactggtggatcacctgaggtcgggagttcgagaccagcctgaccaacatagagaaaccccgtctctactaaaaatacaaaattagccgggcgtgacggcgcatggctgtaatcccagctacttgggaggctgaggcaggagaatcacttgaacccagaaggtggaggttgtggtgagccgagatcatgccattgcactccagcctgggcaacaagagcgaatattaatttcaattatataaaattgcacctatattaaattataggtattaaaaatacacatccaactgggcctgtacttattcgtatataacattcacttgtaccagaaacaactaatatttttaagtagctttttcctaaaatcaattaaaactatcttccacaatccttcatttatcaagtatggaagtatcaagttttaaggcatatactaataccaggctcttttcaaaatgttgggaataggctgggcatggtgactcatgtttgtaatcctagcactttgagagaccgaggcaggtggatcacttgaggccaggagttcaagacaatactggccaacacggcaaaaccctgtccctactaaaaaatacaaactttagccaggtatggtggtgcacagctgtaatcccagctactcaggaggctgacgcacaagaatcacttgagcctgggaggtgaaggttacagtgagctgagatggcaccactgcactccagcctgggcgacagactgagactcccaaaaaaaaaaaaaaattgggggaatatagtggagaacaagaaaatgcagatatctgtggtctagtttatattccagtagatcttcattaacaatgctaaatttctaagcaaaatcttgtgaaatttcaactattaaatgcgtttaaaggttgaaattagaattttaaggctaaaacacctactgcgttatcctatgcaagcatatgaaaataagtaattacgagcactggttaagaaaaaaagcctcctggaattgcttcccaattatcatgatatacaacatatttaattatcccaaaagcatacataaatgatgtagaatatacgttaaagaaaatataatgatgtaacatgaaggtttactgctcacaatactcaggagactgtctattaagtataaataattttttttcagagcttaggtactcaaacccttaaacattttagaacgtcccccaaaactgccataattcttaactataagtcatttcattttacacattcgtcatttttgtagtttctgtggcttcagacctagcatacattaaaggaaatgactgctttaaattagctttccaactggatagttctcaagggttaaaacacgaagacattatcttgtagctctaatagctgattagcattgcagctaacccgctacacgtacagaaaagacagaatggagcttccaaataatgaaataattcactaaaatgaataggagggatgacagaaatcagacagataaaccatcagttctaacagtacttctttaaaggattgggattgaggaggggcagagatgtgacatcaatgaatctgtaaggttctagatcttaaattctatgtagtggacataaagttaattgtttcattaatctaaatttctgtaggcctgaaatatttaataatttaaaatagactcaccgatcgattacaatttctttctgccttagaagtccttcttttattttcaacattgattcccacttactgaaatcctgatagccaggtgaataactttgacgagatgatccagtcaaaacctgcagaaacatgtttacacaattagtatactaaaatatttaaagaaaatatttatatattatcatattttcccaaagatttatattaaaaaaaaagaactccctctttgattttttaatactttcggaaatcacactatgaatacaacataacttggacaatttcaaggaagttctaaaggaaatgtatacatctaatgaagaattaatgacaacagaacgtttatcctggcaaattataaaactatataagatcttggccaggcgcggtggctcacgcctgtaatcccagcactttgggaggccgaggtcaggagatcaccaccatcctggctaatacggtgaaaccccatctctactaaaaatacaaaaaattagccaggcgtggtggcaggcgcctgtagtcccagctactcgggaggctgaggcagaagaatggcgtgaacccgggaggcggagcttgcagtgagccgagatcacgccactgcactctagcctgggtgacagagcaagactctgtctaaacaaacaaacaaacaaacaaaaccatataagatcttattcccattaccttgtggaagtggaagtggaagttttctggaaatgagattaatcattaagggagtaatacaatgtaggaatgtgccatggcttaactagacaaacattagcaggagattttccacaagaaaataaaagcagtatctgtagtattcagacttcaagttgacatgcatcacatcatcatttagttacattagaatttcaaaatcacaaatattttcactcagtagtgagacaaccaaatgcctaggcagataaaaaggggtccttggagaatctctgacccactccacaagtgtgcagatgcttctgtgcagatgaggaaacctgcccagggctcatgtgggcatgcccatagctgactggagcccagcatgcgttctgggggaaatgggtggagccatggggaattcctgccttatgcgggggaggagcctgctctcttcagctcacctggtgacctggaaatcaatctgtgaggtggaggacctgttagcagggctctatcttgctttgatgattgtttgtttgtctgtttcttttttccttttcacccaataaattcctttccaatcacccttcaaggtgtctgcatgcctaatcctccctggtcgtgtgacaagaacccaatttttttctacaacagtagtaagtatatccatagaaaatggaaaatatataaccatctactaagtagataatttggatgaaatatatcacttagaaaaaattgcttagaatgtaagaaaggtttcagatatttaaataaaccaacggtagaaactaacatggcagatatccttatatttcttccgttgaaaaagcagcaaacatttaaaaatattggtgttataggtttgactgtattccttaaaaagataagttgaagtcctaacctcttgtaacttcagaaagtgatcttatttggaaatagggtctttgcagatgagtcaagctaagatgagctccttaaggtaaggcctaattcaatgtttggtgtccctaaagaaaggggaaattttggacctacgtacacaaggaagactatgtgaagagacacagagacaatgccatgtgaatatcaaagtagagattggaatgacacatctacaagacaaggaaagccaaagaccaaaagctaggagagaggcatgggacaaattctgcttcacagtcatccaaaggaaccaactctgccaacaccttgatttctaactttcaacttccagaactgtgagacaatttctggtgtttaagctagctcatttgtgatactctgttatatcatctctaggaacctagtataactggtaaatcaaataggaacacagttctttggcaagccaaaagatgtataaacaccacaaagcaacttcaagagaattcaaatgtgtagtgatatttttatcctttactttccaaaaatgctattaataagaccttcaaaataaaccagtaattgcataacatcaaccagtcacagattaactctttgagatgactgtcaagtaatattaggatgggatgtttcatgcaggagacaggataggatgaacagactaaggatagagatcagttgaaaagaaggcacatacttttgtcagatgggaagatatttcaaaagtgacacatagtgttacaggggcaggttagacatctgcctctgaatttcattctctcccttgcctaatatacaataagggctgatattcagccagtatgcatcagtacagataatgttagctgttagaatactgaagtagtttcactgtggttggtaactaactgctgtttacaccactgtgcggactgtctctttcactgtccaggccactctccagaatgccccatgatccaacaaataacacagttactccccagcacaagtgaccttcaggaccccgctccatccataaataggcatcctttctgattagctagttcttgtacaagtcagtcccgcaaaatcttcccagttaaacactacctacaatcttatttatacttaattggcagagctaacattcaaacccaggcagcccaacaaaggagcacctgatcttaaggaccacattattccactgcttctactattgagacaggtttgcagcagaactggtttcacaagatacaggtcacaaagacctggcttataaaataggatggggtaaaaaagctggccaaaacttgccaaaaccaagacagccatgaaagcgacctctggtcatctttacttctcattatatgctaatcataatacattagaatactaaagtaaactcccaccagtgccataacatagtttacaaaggccatggcaaaatccttaagtcaccctatatggtctgaaaggtgaaggagaattctgggaattccttgccactttcctggaaaattcatgaataatccacctcttgtttagcatatgatcaagaaacagccataaaaatagccaaccagcaaccctcagggctgctctgcctgtggcgcagccactgtttcattcctttactttttcttttttttttttttttttttttttttaattgagacgcagtctcactcttgttgcccaggctggagtgcgatggcgcgatagagctcaccgcaacctctgcctcctgggttcaagcgattctcctgcctcgccctcctgagtagctggctgtagaaccatgcccagctaattttgtatttttagtagagacggaggtttctccatgttggtcaggctggtcttaaactcccaacttcaggtgatctgcccgattcggcttcccaaagtgctgggattacaggcatgagccaccgcgtccggctctactttcttaacaaacgtgctttccctgtactgtcggctcgctgttttccttcccgcacaaagccaagaacccatgtggcctcccaggctgaaccctagttttggggttttccctgtggcactatggcctaattaggtgttccaaatttcatcataaggactagaaaactgttttgaaagtaactgttctcagactgtgagaaaaaatttaacactataaacaatattattaacagaaactctctacttaatgaaactccgcattacctactgattatcaatttaatgggtaagtcatttgataaaatctcttttgtcaaactgtggctcaaacaggaaatttattaaagctagtaaaagctaaacaaaagagcattatcactaattccaaaactcaaagtaggatttggaaatgcttaaaatgatgtggtgaattattaaatctgctataatttataatactaatatttcatttacttgggagattaaaaataaatatctatttttatttacctactgagttatacattatttaaatcctaataacagttgacatgtactttaagtattggtttttgtatattatattattttgtatattattagcatgcctaacaaaaatcttctaggctagattaaggatttatggtctcctcttccaaagatctaaaataggtagattctctatttccaatgaccacacaccagcagtcatccacaccatattatttgaagctatatttcaccttatacatcttgtgcctatttcagtaagacaagtacctaggcaacagatgatgatcttctcaagaagacattaacactattttactcttcacaagtcatctgctaaaaaaaatttcccatggctgacaattaccttaagaaagtggcttttcttttctttttctttttttttttttaacgtttcttggcatcaagaaaaagattaaacagaaggaacaactaggcataaagagaaacagcaactgacaacactatttgctttcatagcactttgaaccattggcaggatggactgctaaagtacttgccaaatacttccataaatatacacaaaacaaaatatgagaatgtattattctgtgttgtaactcccttgatctaaaccctttagaaataaacaaaaattgagagctctgaaactgggaaaacaggaataaagaaaaaggattcctttccctgtaattaagatacaatatatttaaaatttaccaaaccagcagcagtcttccttatgatagtcttccttactaaacttaaaccctgattcataaaatagttaatagagagaacaaaacctgacatcctaccaaacgctgtaggttgacttaaaagtaattttttaaatccatgtgtatctacctacctctaaacatgacagttacggagacattttaccttctaaggagaatggcttttataatgaagccagcatctatactacattaaatgaagttatagaatggaatttgaagtacctagcaaaattcaagaataaaaaaatcatattgtgaagtctcaaacagcaaggcaactatacctttatgattttgcattctctataaacaactgatacactactaaaggcatacagaaaaggaacaactaatgaaaatgtattttcattataattgacagtctaggttccagtcttgacagagctaaaagaaaatctgatagaaataacacagaatcattttgcactaaatgtggaaataaatcaggtatctaccccggaaccatttatcttttgaaagtcctaaacaaaggtggaatagtgataagggaattagatgtgttcaaattgattcttcctcacatttccacattacaatcttacagagaagttattcaaaaactgtcaatttaatgtgtctgcaaatgttaaaggttttctgcctttatttataagacaaaattatcttctcttacacatttgatgagtgtttttatatgtatcacataggctaacaacttataaaatcttactagtatcagccaggcatggtggcttgtgcctgtaatcccagcactttgggaggccaaggtgggtggatcacaaggtcaggagatcgagaccatcctggctaacactgtgaaaccccatctctactaaaaatacaaaaaaattagctgtgcatggtggtgggcatctgtagtcccagctactcgggaggctaaggcaggagaatggcgtgaacctgggaggcggaccttgcagtgagccgagatcgcaccactgcactacagcctgggcgacagagcgagactctgtctccaaaaaaaaaaaaaaaaaaaaaaaaaaaattcttactagtatcaattatctattaagtttcaagtattatgcccaaaagcagtgaggagaaaaagccctttccctctgactatgatgccatagcaactttgagtatacataaatatctacttttaaagttctagatggcactgtcttagctttagtacattaatatatgattgtggaaaaggaggaaagccaagcgcaattgccttaaaaccttcagactaaaagttattgaaaatgaagcacaatataaatgttaatgttttcttttgttttattatagaccaggagctactgtggcttgcaaactatgttcttgcacaatactggctaacatgaaaaaatagatgcagagtgacagtatcactcttggatgtaataaaatccaggccaaaaaaaatcattaaataaaaataaagttttataaaactttataaggtaaaagataaaagttaccacgaagataaaataatcacaaatgtttacacatttaatagcatatctcatatgagaaaaaactattaagaataaatggagacataaacccacaatcatattaccaactttagcacacctctaagaaagacaccatgtaaagtggggatccagttcactcttttttttcacagcctgcaaactaaaaccggaattaatattttcaaatggttgaaaaaaatcaaaagaaaaatattttgtgcaacgaactaggcattgaaggaacatacttaaaaataataagagccatgtatggaaaaaaaaaaaaaacacagccaagatcatactgaatgggcaaaagctggaagcattccccttgaaatccagagtaagacaaggatgctctctcacaccactcctattcaacatattactggaagtcctagccagagcaatcaggcaagagagagaaataaaaggcatacaaataggaagagagaagtcaaactatttctatttgcagactttatgattctatacctagaaaaccccatagtttctctccaaaagttatttgatctgataaacttcagcaaagtctcagaatacaaaatcaatgaacaaaaatcagtagcattcatatatgccaacaacttccaattaaagaacacagtcccattgacaatagccacaaaaaagaataaaatacctaagaatacaactaactagggaagtaaaagagctctacaacaagaattacaaaacactgctgaaagaaatgagatgattccaaaaaaaaaaaaggaaaaacaacccatgctctggataagaaaaatcaatattgttaaaatgttcatactgccaaaagcaatttacagattcaatgttattcctatcaaactaccaatgacattccttacagaagtagaaaaaacttgtaaaattcatatggatccaaaaaacagcctgaatagcctaggcaattctaagcaaaaagaataaagttggaggtataacgttacccaacttcagactatgcaacaaagctacaataaccaaagcagcatggtactggtacagaaacagacacacagaccaatgaaacaaaatagagagctcagaaataataccattcacccacaaccacctgattttcatcaacgtcaacaaaaacaatcaaaagagaaaggaaaggactccctgttcaataaacaatgctggaataactggctagccatacacagaaggctgaaattgcaccccttccttatactatatacaaaaaatcaactcaagatgaattaaagacttaattatgaaacctaaaactataaaaaccctggagaataacctaggaaataccattgtggacacaggccttggcaaagatttcatgatgaagactccaaaagcaatcacaacaaaaccaaaagttgacaaatgggacctaattaaacaaaagagcttctgcacagcaaaagaaactatcaacagaataaacaaacaccctacagaataggagaagatatttgcaaactatgcatccagtaaaggtctaatatccacaatctataaggaacttaaacaaatttacaagcaaaaaacaaccccattaaaaagaaggaaaaagacatgaacagacacatctcaaaagacaacatacatgcggccagcaagcatatgaaaaaacattcaatatcactaatcattagagaaatgcaaatcaaaaccatgagataccatctcataccagtcagaatggttattactaaaaagaaaaaaaaatcagaggttggcgaggttgcagagaaaagggaacacttatacagtgttggcaggataaattagttcagctactgtgaaaagcaatttgatgatttcccaaaaactcaaagcagaattaccatttgacatggcaatcccattattgggtatatacccaaaggaatataaatcattctaccggagacacatgcacaacatgttcatcgcagcactattcacaatagcaaagatatggaatcaacctaaatgcccatcaacagtagactggataaagaaaatgtggtactatgtatatacatagtgtatatactatgtaatactacatagccataaaagaataatatgtcctttgaagcaacatggatggagtaggccattatcctaagagaactaacataggaacagaaaacaaaataccacgttttcacttaaaagtgggagctaaacatcgaatacacatggatacaaagaaaggaacaacagataccagggcctacttgatgaggggggcgggtggaaggatggtgagggtaaaaaaacaactacctattaggtgctatgcttgctgcctggatgacaaatcatttgtacactaaaccccagtgacatgcaatttaaccatgtaacaaacctggttatgtacccctgaaccccaaataaaggttggaataaaaaagtttgagagcaaaaagtaaataaaactgtactgtgttttataccataacaataaatctaaagatttagatgaaatggatcactttctaagaaaatatcaattaccaaaattaactcttgagatagagtatctgaatcatcatagaaaggattgggggaaaagtaagtctactcctaaaatgaagtactgattttttggatggtttctacctaaatctaaagaaaatataaaacagtagaagaagaaaaattttgagaaaggtaatagggctaggcttgaaaaataatgaagcatgttataaattgacagtatttaaaacaataatacatcttaaagcaaatacagaattcaaattaatacaatactatcattttgggggatcactgagattaaacaacacacttctaaataatacacaggtttaactgactgaaaatgaaaatatcaaaattttaaggaagcaggtaaagcagtactgagaaggaaatttacagcactaagcagttatattagaaaaagggaaaaagctctcaacctaagcttccatctttagaaactagaatataagcccaaagcaagcagatggaagacaagaaggctgagaacaaaaatcaatagagtttaaaacagaaaaaaacagaaaaatctattcagaaagataagctagttcattgagacaatcaataaaatttataaaccattacctagactgagaaagaaaaaaagaagaggcaagttattagggagtaaaatagatatcactacagaccatcagacattaaaaagataaggtaattactaggaacaattctacacacaccaattcaataacttgaattagaccaacttcttaaaaaacacaaacttacccaaattcattcaatatgaaataatctgaatgtcctataaactattagagtaattgaatttataattttttaaaagctcccaaaaaaatctctaggtccaaattgttacactgtaggattctaccaaatgtttaaagaattaacaccaatcctccacgaactcagaggcggaaaaaaaatgaattatttcccaactcattttatgagttcaacaatgctctgataacaaaaccagacaagacagtaggaaaaaagaaaatgacaaaccaacatccatcatgaacatagatacaaaaaactttaacaaaatcaaaccaaatccaatccagacatagagctatacatagataatacgtttggcatacggttttcccaggaatgcaagttaagtttagcatttaaaaatcaatgcaagctgggcgcagtggctcacacctgtaatcctagcacttttggaggccgaggcaggtggatctcttgaggccagcagttcaagaccaacctggccaacatggtgaaaccccgtctctactaaaaattcaaaaattagccaggcgtggtggctcatgcctataatcccagctactcgggaggctgaggcaggagaatggcttgaacccaggaggcggaggttacagtgagctgagatctgagatcacacgattgcactcccgcctggagaacagagtgagactccgtctcaaaacaaaacaaaaaaatcaatgcaatttaccacattaatagaccaattaaaaacctactagaaccaataagtgactttaacaagattatacaattcagggtcaattttttttaaaaaaccaattatatttctatatattaacaacaaaagggcaattaaaaatgtattatcatttacatcaaaaacattaaaagcttagaaataaaaatgtaataaattatgtgtaagatctgtacactgaaaactataaaatatcactaaaaaaactggccaggtgcggtggctcacacctgtaatcccagcactttgggaggccgaagtgggcggatcatctgaggtaaggagttcgagaccagcctgtcaaacatggcaaaaccctgtctctactaaaaatacagaaattagctgggcgtggtggcacatgcctgtaatcccagctactcaggaggctgaggcaggagaatcgcttgaacccaggtggcagaggttgtattattgacataaggatagacagaccaatgaaacagaataaagatccacaaatctaatgatgcatagagtaaactgattttttaacaaaggggaaaggtaattaaatgggaaattgaatttggtatttataaataccaaataaaggccaggtgcagtcagtcatgcctgtaatcccagcattttgagaggcctaggcaagtggatcccttgaggccaggagtttgagaccagcctagccaacacggtgaaaccccacctctactaaaaatataaaaattagccaggtgtggtggtgcacacctgtaatcccagctacttgggacgctgaggcacaagaatggcttgaacctgggaggcagaagttgcagtgaacaactgcagttacagttgagccactgcactccagcctgggcgacagtacagactgttttctctaaataaataaataataaaaataaatactcaaataaaactaaaaacacgtccacatagaaccataggcaaatgtttactcataatcatccgaaactaaaaacaacccatgggtctgtaagataaacggataaaaacggtactacatccacaaaacacagtactattcagcacacacaggcacacacacaaatttataacatgcaacaacatggatgaatctcaacagcagcatgaaaagtgaaagaaaccacactcaaaggctatcaactatctgattctatacatagggcttctgcaaaaggcaaaacaataagaatcagatcagtggttgccaagcggggtagaggactaactacaaaggggcaaaaggtagctttctggagtgatggaaatgtcgcacacttctcttgtagtaaaatgatcctcatataatcgcagtttcactttctctggtttcagttacccacagtcaaccgttgcctgaaaatattaataatggaaaattctagaaataaagaaaattcacaaattataaattgtactccattctaagtagtgtgatgaaatcccacaccattttgtttcctctcacccaggaggtgaatcatccatttctccagctcatccacactgtatatgctatccacccactggcgtgtagtgccatcttggttaaaggaccaactctcagtatcgcagtatttgtgttccagtaatccttattttacttaataatggccccaaagtgcaagagtagtgatgctctcatattgttataattattctattttattattagctattgttaatttcttactatgcctaaattataaattaaatcttatagatttaatttattaaaggactactgtatacattcttcaaaactcaaattatagcattttatgtaaatttaatctttaaaaatcttaaaagttgcatgtaaattatacttcaattatcatattaaaatttgatttttctaaaattgtaggtaaatgtttacatatctcccactcaacaacagtagaagcaaaaagaacttatcataataaaattgaaacaacccaaatgtgttaacaaaggaatagataattaatggtggtagaagtatacactagaatactatatagcaataaaacagaactactattatacaaaacaacatagattaaattcagagacattatgctaaacaaaagaatgctagcacagaccatacataatcaataatggtaagtcagaacagtagagatgggtaggatataaggtgtcaccataaagactgagaagagtcacaagctaaacctactgggcattagaaattttgtatcctgacctgagtggtgattataaggggagatgtatgtgggtgtgtattggaatggagctattattaaagattaatattcctatgtactttactgtatgttagacatcaacaaaaaatataatacaggaaatacttatactttatttcactttctaccttagaagaagtattgaagggaaataaaggcctcatctgctagaagagaatccttaagtcccaaagatgcactatagatgacagaatgcactgtcgtggctgtaagttcctatctcatcatcactttggtgcaactccacatctgcaactagccatgagataagagaaaaggccagatgacatatataccctacaccaagaatgcatggatgaagaatgaagttgataacaacctacaagctggttcttaggcgctgtcagaactctaggagaacaaagaagccttctattaaggcagaagacaatcctgcttcctaatatagaaaagaggaaaggattttatattcaaataacttctcccctatatccctttagtaacacattttttcccaagtagttagaaaacaagaatttttattcagtaaagtcataactggctttgagaagcataccattgcatggcagttatatattactagtaaaatatacatcttgacaatatcccagaaaaccgaggtacttgttttgatagaaaaacatgtatcaaaattcacatattgataaatcataaaattactgttgctatgctgttctacttagaatttcaaagtaatctatcatgtttctacatcactgtaaccaatataagtaatctagaacatgttaatttaagcatataatttataacttattaatgacaaaactttgacatgaacatgcaatgtaaaaggtagttataaaccttgtaactatgtgagttaatttgaagaaacaaagtatgccatcaaagtaacatttcaaaatgtgtaaaggtgaaacagagacatttttacaggtaaacattttatatatatatttagtagctgccaaactcagggagcactgggaaggcctcatttagatgttttacctaaaaatgcatatgacacactgttctctaccctaatgtaggcatgtagaccctaaccatatagatttatagacccagaaaatatacataggtacctcttcttggaaatggcagattccactctcaaaattgagtaaggatagcaggcatctacaacaatcccaaacacatgctacttagatgagatccggatactatgaaaagttgccaaaatatgtcacttaatggccaaacatgctcctaataaaagtttactgtagtgcagctgaaaatagttcaaaattctttggcctggacaaatactgttaaatttagataatccagtgctaccacacttgactggaatacaacctctgcaattcttcaagtttgttatctctccttcacttgcctttgtctctgagcttattcatcactcacaacatgtcacgtaacacagtaaatcttcctctgtttcctggaatagtctatctgaagagatactctacaagtgttttctggtaagagtcataccttaactaaaaagtaaataaattcacaaagctcagtaatgaagatgaaaataatacaaataacataaaatttaaagaatctttattcaccaagagaaggaaaatatgaattatgttattactaaaagaactgtgcacttaatataaaatctacgtcttaactaagcccatgtaattatttatggagtgcattattacgtatttctctaacaacaacaaaaaaaccattctatcagtcaccccttcctattatactgaagtctgcatcttgaccctcaaagtttatattatagaagaaactgtttttaataatctaattatttcttcaatgtgtttttgttactaactctgtaagctttttgacatcctaatatgatttactgaaataacaattcaagtaaattgagttacttgaaaggtaaaagaccctgaaaaaatgataaaaagaaactgatgatataaatatatatataaaaaacatcttaagaatgcatatgcatgaagataaagggaactcaaagtatttctgatttccaacatgctaaacaactaaattactattatctcttttcttttggagggagaaaaatttttcctcttaaaaatcaatccagtttatatatcatcggttagtattatcatgtctttaaaaaattccaacaaagaaatgagccatgcatgcaacatgatctcattacaatcatagtacaaaagtgaagagaagaaatggtttatccaagacagacagtaacttactttctttaagcaaatcaattagaagattaggtaaaacaaatgaagcttaagtattcaaattaaggttaatcatggactttacttataaaacaaatagaatgtaatgttttccaagcattttgttgctataatttactttttaaatttttagatgaaatataaacagaatttaatgaatcaatcccttgtaattaacaaaccagacaataaaaatggaaaaaaaattaatgatataattgacaatttatgaaacaggtatctatgaaactgaaataaaagaagtttatcaaaatgaagtacttaatacaatatggctctattttggatcttgcccaaggttatgaatagcaaatttactacactatataaccagcttctactaaaacaaagctatagtacaggtgctaacattttaatttattttaaaaatcagactaacaacatatatttaatcaagtctttatcatattttactctcaagggataaaaatatttgatagtcatgcactgcataataatgttcctgtaaatgctgcacccttaagattatacctcattcttactatatcttttctatagatatatttaggtacacagtaacactgtgttacaaattgtttacagtatttagtacaataacattctgtacaggtttgtagcttaggagcaaataccatatagcctaggcgtgtagttgttagtcggctataccatctaggtttgtgtaagtacactctacgatgtttacacaataaagaaattgcctcatttctcagaatgtattcctgtcattaagtgacaaatatgttaagggaccaaagcactgcctacattatcttgaaatgtagcaatgaatttttctaaaaggatataaaagaaactattttttacttttttttgttaaattttattttaagttccgggatacatgtgaaggacatgcaggtttcttacataggtaaacctgtgccatggtggtttgctgcacctatcaacccatcacctaggtattaagccccgcatgcattaggtatttatcatgatgctctccctccccccaaaaaaagaaactactaaagggagctatcttgaggggagagggagcatgcttttactttctatcaattgggatttatctgacttttcctaccatttacatattacttttttcttttctatctgtgcagttatgggtcactaatgttttcttcttttatatgttaaaaatatcatttttaaaatggtctcaggagtcaacaataatctcatggtgaaactgttgagtggagttcagacagctccctgtatatgtataggtcataaaacaggaacaagttgattgctgatgccgatgtctttttttttttttttaaatctccagagtccagttcatcactggcctatagtacacaattaacaaaaagaggatgagtagctagaacaccctagggatatttatcagccttgaaaaaaatccaaaagtatttccaacagcaaaaacaggtactgtaattagcatactgtaatagtaattatggcagtggttcctttcctgtatcatgataagttgggtcttattcatttgtgccctgatactcagcacagcacctgacaatgtttattaactactgactgatatgaaaatttggagatttctacagaaggttaccattttgttagcaatgatatgtgttaacagtaagaaatatctacacttaaaagattatagctcaaagatcagtatgcaaacctatgtttgattaaaaatcatgctttctggccgggcacagtggctcacacctgtaatcccagcactttgggaggccaaggcgggcacatcacgaggtcaagagatgtagaccatcctggccaacatggtgaaactccgtctctatactaaaaatacaaaaattagctgggtgtggtgatgcacacctgtagtcccagctactagggaggctgaggcaggagaatcgcttgaacctgggaggcgaagcttgcagtgaaccaagatcacgccactgcactccagcctggcaacagagcgagaccccatcttaaataaataaataaataaataaataaataaataaataaataatgctttctgacccttgcggtctagcctcatttcagtcagacctagggaaacttcaactaatctgcacaactaattttagtttgctattaatatagagataaatttgaaagacagtcttcaatggccatacttcgttctattttggaagtgtgaagtttcaggagcatgttttcattgtctaacattcattatacggactcatacttatccaaatattgaattttgggttatgttactttttcaagttagctaagggaaaaaaaatcaatgtattaatactggagtcaacaatcaacttttcagatatccatagtaccctcaattaagcaataagcccattgagaaaagaatacattaacggggcagccttacaaatgactttgccaaaggcatcctcttgatcctaatgttggtcctggagcccactcatcacctttgaccaactgaagggcaaattaaatcagcagatgatgagatgttcatgcccttttgctatgctatgcaagcttttaatttggagatgagttaaggatgaagtatggctttcctgaaatatagcaaaaccatgtataactctcagtagcgtaattaagttgccagtaaaaagttacaatgcttacatatcaggaagttgggtttatttccactggaacatttttacatcttttgctttataaagtaaatatgaattccacatatcaaaatctattttcataaccttctcaagaatgtatctgctgaaaaatcaaggttcagttctaattttactctacaaacttaaagagggctaactgtgtaactgaagcatagaagccattatgttttagaggttctccacctgaagcaatcaagaacctatcttaaatgttgatattatcaaagtctttaaataaaagctcagatctacattaaggtaggattacctccctcatccttagagcaggagcactgatcaaaaagccacttgatcttaactaaaagtgcaatttctttagttgcttagttggtacagtcatgtcactcaggatgtttactaattcagagtttaattctcaccccaaaaatgtataattttagctcattttctcaaagaagtttctctaattataaggaaatgtaactgaccaaatcttgaaaattattacatttcaaaaacaaatcaaattcatttacaagcctgatcagccttacatgaactaatgtttaggaataacaagtttacagaaccaagagaaaaaagagaatttaacagatttatttacatagatggaatcacagtgttgttttttaaggtttataatggcaaaaattatatcccctgatattcaataagaaaattcacaaattatggtgtattatatgccaaactcacatttacatagtaaaaataagacattaaaatttgtaacatatatttttaataaacagcacacaaaaatgcccaagcatatttaaaattattctccaatgaacaggtaatgttttagggttttttagagtttttaaaagcttaacatgcctgaagataaggactttttttttaagtgcattccttacctaatagagtgcctgacaaccagtaaaccagtagtttaaagaaatgaattaagaactggcttcttgtgaaatttacatgtttaacaaaattagctaaaattaatagctactttcaaaataaccacatttttcaagctagtttagtataatcagaacatttgggcttcaaagagactttagaaattaattcgatctgccttccatttatttacgagaaaactacagtacagaaagattcattttctgaaaatcatagagtaaggtagagagaggacaaaaaaatgagaatgacagttccaattcaactcctcattaatattccttgaccaaccttcaaccactccaaaaatctcttatattatggttacacaaaactatggaatgccattgttttggactgagacttaatagcccacgccaaaccacaatgcagtcactctggtttgttttgggctgagtcttaacagaccagaccaaacaagaatggagccactcctgctaggagccacataaccaaactgaacttcaacatcaccaagttttcccaaaaaaaaaaaaaaaaaaaaaaacaggatattcacagcaaccaatcagaaagggcccagtttacctgaattagcatgataaagaagtctgttttaaccttataaggaaagtaacttacaataaccaattcactttttgttccttctttctttagcctctttctgcctagaaagcccacctcctccacttagctcatctgatggcctatttttatagagacactgcccaattcatgaatcattaatcaaagccaattaattaaactcaatttgttgaaattgttttttgatgttacacacacgtcaaagtgtgaacaagttaaagaattaagtgcaagaaaaatctcaacttttcagaggcaatcattagggacaaagaaaattagtttatctaagtttctgagggcctttattctctcttctttcaacttatcctttttaagagttcacttgtaatagaaaaataatattctaaatatccattaagtataaaaatatcttattgagccttctaagggataaacagtgtgtagagcttaaaaaaatcaatcagtctctattcatgaagtttatggcaaggaaaataaatagacctatataatataaaaagtcccccaccaacttcagatttatctgacttttctgaattataagagatattcacttattacttgtataattagaaattaagaacaagcaaaacagggcttctccccacctacttctgaataatgaaggagttctataagaacaagacagtaaggaaaataattcggatagaagaaataacatataatggcagagttgtcaaatcgttatggtaggcatacatggcaatggacagatcaggaacgatgttttatgtaattctgtaaagagtgggtttttcatctcgaaagagaaatcaataaaaagttctcagcatgtgaatgacaatcaaatgtgcacttggatatcagagtaaaaactgagtaggaaagagtcacaacgaagggtagaaaaactagttaataaacgtctatgaaagttaagaggagagttggtcaggctatgagaacaaagacatatttcacaatctgcatttggtttctaagtgaatggggagtctggcagaagacagaaaaggtatgagcctccaatttcaattttgtatcaaaatcagtgatagtgccaccacaaagtttgcgaatgcgaggagctcaaagggctgagatatcaaccacaaagataagaaatttaatatgtctggagaaatactacaatcattaaattgaaatagaaccttcttaacaatgtaacagcatcatgatcgggaccctatagaattttgaagcaagtatttggagacctaagggttggtttttgttgttaaatttgttttgtgatgtatgtgtttccctttgttatttttggctttggttctgtccgtttcctttgtacaaaacatgcacttctcttagaagtcatactgcttattattacacgtgctcatttgactctcaattgggaatttctttttctcctggtgttatcttgcactagtggttaccttctaaatgttaaattttcatttccatattatttgtatactgataaaccataatttccttgaagccacgtagcatgctatagcatttctatcacttagaatgtttaataactttccaaaatttatgtagacctatatgagtccttttcttaatccatctggcctctcttaatgtcaatgctcttctccacccctcatcaagatgaggaaagagaatttgcccagaattcagatatttatgaaaaaataaaatgtttgggtctccaggttatctggcaaatcaagtgaaaagtgaacctacctcccccaaatgacccctaagctttataggttactttatcactgggttatatcaacagccccccaactccagttgatgagtaaatcttattttcttttccctattgccctatggagagaatttccatcctctcaatctcagaccactaattcttattcgcagttttgcttagatgttttttgaaccagtccttccctacgtagctttaaaatttaaggcagtaattatcaaaccctcaagtaccctcaagagataggtaaaatcttcttcctgggtgtctaggagatctaatctaaaaaaagctccttatctttgatgtattgtgaacattacaaaaattgattcaaagcttgcattttactgtatctctgtctaaatattaaaatgctttaatttagtcatcacttatattaacttctggtcaaaaatttccaaaaaccgattctattttgaagcttcttcgccctccggatacaccactacagactggagtttaaatgctcaatgtaaaagattactacatacatcacagtgcccttcacaaaacgttagtaatatagctgggcgcggtggctcacgcctgtaatcccagcactttgggaggccgaggtgggcagatcacgaggtcaggagtttgagaccagcctgggcaatatggtgaaaccccatctctactaaaaatacaaaagttagctgggcgtggtggcacacgcctgtagtctcagctacttgggaggctgaggcaggagaatcgcttgaacccgagagggagaggttgcagtgagctgagatcgcaccattcactcggggctgagtaacagagtgagactccgcacccccttccaaaaaaaattagtaatacttttgaggaacacatttaaaatgctacaaaactatataaaaacaaaagtaaagacatgaactcatgattcagttgaaactgaatactaaatttcatttagagcttagtaaaaataaatttgtaattattttcccatccaagttcaaagacactttacccttaagaatccaccttctaaaggaaaaaagaaaataagtgctaacactaaatgaacactgttgcaggatctctgataatcactatgtacacttcatgtcattaaaccatcacaaatactattccacagattaggctgcttaggaaagttatttgtataaagccatgtgaccaaaaatacattcaaactatagtgtaactccaaatgaagactgtgacaaagcacctcaaaaaaattttctagcctctagctgaggaatcattgaggaacactctactgataacactataactcattaatactcctattaaacaactttctgtttgggcaattaaaaacaatgttcagttaaaactaaaatctaatacttcctagagttccacatgagatcatcaccatcatcgtcatcttcactagctaacccaaaggaacaaggtaaacacaaaaactccccactcttgtaccaatctaaaaagtaaatttttgaatccattttccaactgtgtcacacacagttgttagtatccttctaaggtgtgtatatgcctatgtatactttttaagtaaacttataaacatgtggtaactagggcatattttattctgtctacggcagcttcttggtttatccaactaagtattactaattctattttcttagaatgagaagttctcagaacaatgatctatcacctaaatttcaaatgaatgtgtaactggtagacaaacttaaagcagactttctaaaactattaacagtgctcaagaatgcatctatttacatcttaaaaatttctcagttactatatgctactctaatgaaagctatattcaaattataattttttcccacagcatgccaacagattaggaattataaacagacagatctggatttgaatcctgtctattctttagcagctggttatctctgacaaattactgtaaacctcgttaggcttctcggttttgtattatcaatcatcattggtaactgatagtactgagagatcctcattatgtaaggattgaaagaaaaatggttgtagcactgagaaaagtatcaaacattattctgcaatttccttaacttgggttttacttttaagttgtaaattttcccttggcaatgttcacaggatatctttgctaaaatattatttttcagttagttttaagctgactctttaaatatcaaatgatttgctctagagatggattttctttctttggaagaagccaagatcatttccatttaagggcatgtaagcagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcatttttatagtaattttcaggaaagcaactgctagattaaatgaggcacatcctttcaaaaacattacaaaacttaaatttcaacacatcaaacctataaagcctcattaactgagatgtaactgatttggaatctgtaattatttcttttttgccataaagttgcccttaatactgcatcagtttattaaaaatttggtaagattgtgtaataatttaatgcaattgtttttaaaaaatcttaaatacttaaagtagcatattgctattttgggggtgttgtatgtatcagtttaaatataagtattactattcacaaatatattgttaaactgctaattgaagaaaacacaaatgaattaaatacatttattagttctttaactgtaagataaaaataattttttaaaacaaaaagcaattagcctgattttctcatactccttctcccatacacacaagaacaagaacaaaataagaaaacaggtataaaattttattgtgtaaaaatatttcactttcactaaaagctaacattatgaagacacgtattaaagcaacagcagcaagaattcaatgaaagttgttttgcttatacctgtgtttatttttctcataattaaaattcctgcagtaactattttagctcttcaacatcttcaccattaatattcaattatctctaagcctgaagatgcatgaatctttaacaaaagctttccaccacctcaagtttacttatttttttcatttatctaccatatactgttttaaattaaaaacaaaagatgaagcacaaagtgttaatgacttttccatacctaaagtaagaagttctaaagtttggttgtgataagactgagactgtggctaaccaatcgaaacttcagaattcctatgtgacatcataagacctccctagaacactttttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactcagtggggctgctctataatacacttacaattgatactaacgataaaacgctctaattatagttttaattttataggggtttttttggtgactttccccaaataaaacaaaatcaagacgcccaagtccagacacacaagagggcagacgtatataagataacaaattgctactacatagcgattatttatcttttgattatttttgagacttctggcaaagtaggactataataaattttcagaaaagatctgctcttctgctaagtaacagcacacttcaaaatgtccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatttcatgttagacaaaaaacaagtcattttactttaactcattttatcaattttttttttttaaatcaagagacagggtgttactctgtcatgcaggctggaatgcagtcacatgatcattgcacactgcagccttgaactcttggggtgcaaaggattctccaaccttggttcccaagtagctggcactacaggggcacatcaccatatatggctaattctttttattttttgtagagatggggtctcattgcccaggctggtcccaaactcctatcctcaagctatccaccccccatcagcctcccaaagtgttgggattacaggggtgagctaccatgcttggtccaaattttttgtttatacaagggaaaatctccagtaaaatatgtataggtgccaataccataactgttcaaacacccttatgactaaataggcacaaaatttcatctttttaatgactgccacctgaagttcagaaacatcctagggaaaaaaggataaacaacttcatcaataaagaggctactattatttcactactgtctgggagatccatcgtgggcttacaggaatccaaatggatactgccgttacgtgtagaagtgtttatcctccatcccttccaccctaccttccccaagaaaaggaactcaagggggccatggaaagggaaggagtcttcccaaaaagaccagactgtttttcctcctctgtcatagtccctatagagtcaggcagcttaggggttgcagggggtgggtagcataagtgtgatgtactaccgaggaaagagtcaaagactagcagtaggcattacacatggagccttctgtcataaaccatctgagggcataatggcttcttttcattcacaaaggaaaatgattcagagtactacactcctgcactcttgatgatttagcagaaaaccatggaaatcaaggaacaacacacacataagaatgtgtgtctggctcaataattattctggactaagtcctaggaagagcaaaccttcaatgttacaaattaacctggggagtggggagctgtgagaatcaaatgagataaaatactgtgaaagctacagaattctataacatataaatctaaggttttattagattatgactttcagccaaattccttttcttagttgtaaaaatattgttttttcatggtgagtgtttaggagttgtgcttgcaaatcacaatttatcagacggcctggtccttattaaggttcttctctttatgtaaaaattagactaaaagaaaatcagtgtttctatgatttttatcttttttcctttttagagacggggtctggccatgttgcccaggctagtctcaaactcctggactcaggcaattctcctgccttggcctcccaaattgctgggattacaggcgtgcgctacagtgcctggccagaagtcaatgtttcaaagaggcttttaagaaacaactatgatgaaagcttttaaaataaagataatactacttggaggctccaagaaggtatttaacaacttttttctgtagttttctaaggaggaaattagaagggaagcagtcatttaatgattacaacttagtttgtctagttttctttacctgaattcatctttctactccaaaacttaaaagcgctataaagagaccatcccaaataaagttaatcaagaagtagggctttccagggtatatgcaaattttgctctttagttgccttctctctctactatgcactagaaagaagatttaaaaacaaatttatctcaacagtgtgtccccaacctccctaccctcctctgcattgctttgaggctaagaaaaacaccttgtttaaaccagagatttgtccaagcagaataaaaagcatgaatcagtatttactccttgaaatttgcccaattatctctatcacacctactctagtttggaatagcatactcagccccactggacagctccaattctgtgtaaagacaccagctggagaaacaactgcctggatctctgttttcctataatgacaaacatttgaaaactaaaacttgacagtatttgaaaaattaggtttcctatttttcatcacttgaatggataaatcacaaatttctaattcaatcataatgattcttctgttttgattgtgttgtttaaatacataatcaaaattataagaactgtatctaaaataagaataaaggtacatgcgacatgttaagggttctcctatgaatgtagtatgttagggttctatgttttgagatcatactcatatttgtgaggttcctggacaagtgatttccttatcctttcatagcctatgttcatttattctatttgtttttattagtagtagtaatgaataccaattttacatttttactctagggaaaatttgcaattttttatagaattaatttgtttcagaaaattctgatgataaaaaacagatgacaggacttatatcagaaaattagtttccttgttaaaacaagctacagaaaattgtcttggaatagaaacattcccagattaagaaatttacacatttacatgctattccctagaccaactgggggctgtatactatttttctttatatatgatatcatcataaagcactttctataagctgattaatgaatgccttgacacataattttttttaaaaaaaagtacatctgatttataaacctaaataacatcatgtatcaccaaaactttacaaatgactgtagttccaccttctcattgtacagatgaagaaactgaggcccagagaaattaagtgaaaaagtcatccacgttctaaatctaacagaaccagacacaaaatctaagaccttgtatagccaagttgatgctctttctattatacctatgctagcttttttgtttctgtttccaagtttatttagattgagtatgttttgctttatttttatgcccatttaacaaatgaaaaggaaagaacaagctaggtacaaggttttcagattttcatgttaattagtctcaaatgctttgcaagtttatcaacaacacttttcggtttgtaacatttctgcctattaacttgcagggaaaaggaaatgcaaaacaatctgtgaacacttgttatatgcttactgtaagtgtgctactgtactcataacatccactggagggaagcaaacactagattttgcaccttacctgcattggtgtttcacttccttgtcgaaagtcttcaatttgctgctgttgccaaggagctaaactgtaagaatcctctgtatttctaccttccaaaggatttgtccgcagctgctctgtaagccacatctgagtccttacggaaggctgaatgggaactccacctactgcctgttgaccaagcattaaatattttggaggttcaaaagcctctgagcttgtcataatgggcttgctttcaggtaaggcactatatgtcatgtctacaggctgtctcctaagagtagaggaagaggctctaaagtcctccttgctacagctctcaaatttatacttgcagtccagagttgatgaccgttttttatttatttccttgtcctctaacctaagcatctccatactatcatgtaaacagctaggcccaattgtcctcagttgtgatgttaaagccttagccttccctatcttctccaaaccattccttgactcttctctgcatacagtgccaccctggccacagttatccggggcagtgagtttggataaagatgaccatttccgaagtggccggaagtccttcatgtctagggaagagtcctgctcccccctactgtggtttcccaatgtttgcatgaggcttgtactccattttgagccatctggtgtcaatgattccctaagtttggaaattgaagcgctggaattagacggcatcacatgggcagtaggaagagtaatcaatgattgactaggcttaaaagataatgtgccacttgaagttgaatgatctggaaagaaaaaagatggtcaaattagttacaattaacagacaaaagagaatgaggtaaaatgcaatatgccaaaagaaatatctgaacatggtttcatagcacaagcttttttttttgagacgtagttttagcttgttgcctaggctggagtgcagtggcaagatctcggctcaccgcaatctctgcctcctgggttcaagtgactctcctgcctcagcctcccgagtagcagggattccaggcgcctgccagcacgcccgactaattttttgtatttttagtagagacggggctttgccatgttgggcaggctggtctcgaactcctgacttaaggtgatctgcctgcctcagcctcccaaagtgctgggattacaggcatgagccactgtgcccagcccagcacaagcttttcaaaaagacgtcctcaaaatgagtaaattattattatccttttatctgaaacaagtcaacatagtttcagattggattttctaaatatggatacctaatagagtatatggcctttcaccatctactgtacttacaggtgaaaagtgatttaaaataggtttatatttaccctaattaaagtattgtacctttaaaaggaaaaatccaactccttactgagaggtgttattcataatccagcaatgaagtctcagacacaactttgtcagaaaaatggtatttttcagtgtctttcctgaactgtgaaaatctatgccagatctaaacattttagaacctccccaaactctaattcaaatgagaaatatgagtaaaggtgctcctgcaataatgaaaaatagtcccaaagggttcacttccagtctcatttaatggcatatatatatgtgtgtacatatatgtatgaatatatatgtatgtgtgtgtgtgtgtgtgtgtgtgtgtgtgtgtgtgtgtgtatatatatatatatatatatatatatatatatatatatccatattcaccccaagctagaaccttagagtctacttttattcctttctctctatatttattaaatccccaagttgtacatttttacctccaaaatagttgagtttctattactttaggtcaggccctcacatcatactcttctatacaaatgaatagttttagcagactaaatgaaaggctgaaagataaataatggcttaaatactcaataaatttaccatcaagtgccatgttatcatcatatatatcaaattaaaaccaaagactataattttgtaatcaagggatatctagaaagggggtagcaatttaaattggtgtgtggggaggaagtaagcgatggagacctttgcaatttattctgtatctccccacactgtttgactcttataccagaagatacttattacttgtattctcttacattgtcttatggaaaaagttatgttgataaagttgtaagaaaattcagattaaaacgagccaggtagactattcaaaaaataaaattccagtgggtctttgcacagaatgtgttaacttggacatgaaaagggaaaaacattacaaatgaaggaatataaacagaagtattgtagtggatagttatcatattcaagactgcctatcagcttctgaagaaacttcctgcatttaggaaaattctcacattactgactccaaccctcccaaaatatatttcagacctcaaaatcccagtacaccctgaaactatgatgcagacattcagaggcagcagcacaagattgcagttttggaagtaagtcacatgataaaatggactcggtgtggagctaccatttttgggtgatacaggcaacagcagaggcatcacctttccacaacagcagtgacagacgtggccccgtagtggctgcagaatcaaaattcctatcccagaactggcagcagctagacagcttagtggtggaagactgacagttctcatatatgatttgaggcatattacttggaagcttatccttaagcctggctctccagccttcctaaaaattctgtgaagcaccaaatatatttaagtaaatttcctatgtgctcaaccagccagtaaacaacttctgctgactgaaaacactgaatcgtccaatcatgaagccaaaagaatgtggctgtataacaagaaaaataaatccatgtatctacagtatggagttaaagtgccaagaaaagttgtcaaggtaactcttgataggtaaaggtgaagcagaattatacacatcttcaaacgctctgctaagtaaagagcctggccttcattcagcatgaaatgtggtatcactgagcttccaaacaaaggagtgaatgatatgatcaaaaaaattgtacttaagatgactgattattctgacagcagagttgccaatggattaaagcaaaacaactggcaaacacagtgattaacagactattctggtaatcaggagaacaagaaaataaaggggaatatgctactgagggttggttctaaatagaaacaggacagacgtccccaaaagtttatggaatatttgtattcacatattatagcattatatatattttacatatatttgtattaatattactaaaggagtagttatactaaaatcatcatagcctctaaaagatatctttaaattaaaaaaaataaaaaattagtcttgtatcaagttgcaggtaaaaatacagaccaaaggttaagtataacagttttaatttcaaaactattatatagagtaaaatatagggctgggggcagtggctcacacctgtaattccagcaatttgggaggccaaggcaggcggattacttgaggtcaggagttcaagaccaccttcaccaacaataatgaaactccatctctactaaaaatacaaaacttagccaggtgtggtggcaggcgcctgtaatcccagctacacaagaggctgtggcaggagaatggcttgaacctgtgaggcggaggctgcagtaagcagagattgtgccactgtactccagcctgggtgacaaggctagactctgtctcaaaaaaaaaaaaaaaaaaaaaaaaaaaggagtaaaatatacagccttttcatggcacatgtatacatatgtaacaaacctgcacgttgtgcatatgtaccctagaacttaaagtataataaaaatatatattcaaaaaaataaataaataaaaataaaaaaataaaaaacatacagcctttttagattcaaattctggctctatcactcagtagttatgcatgctcaaacatgttatttaatagttagttacctcctccatacaatggagatgacaacagtgagaattaaatcaaaacacataaaatacacagaagaattcctggcagaaagcaaaatgttagttattatgatgtcattaaaaagctacaagtaaatattaatttcaatgtaacagacaaaggctaaatacccatacatataaagagcttcaacaaatcaacaaaaaaaaaacctagcaactcaattttaaaataggccaaaaaaattcaataagtaaataaacaagaaacacaactagagaatatatattttttaaaaatcctcaaacgcactaatagtaaagatacattctctatcatattcagaaaactattaaaggctgcaaatatactacagtaatgggaacacaaactgttatagtctttgaaagaagggaggcaatttgtacatatcactgtttaaaatatgaatacacatatgtgaacatacatatctagatatgtagatgcgtgcatatctatatataaatacatatacattcattagcagagaaaagatccgaaagaatacacacaaaacttaataaacaaaggtaacctctacatagtggaaagggggcaaaaggagaaaaatacttccacattttactttatacaatgtcttattttaattgcttccaaggaatataacttgaccatatggtcaaacttctgcaaaggtattttgttgttctgtgacctcaaaagagtttaaaatacttctaaagtatgaataataaataggtaattgtctcactttccatatcacagcggaatcctctaagacccagtttggctgcttcttgtatccagtaatgggctactttccaatctgcctttactaactcagtactttccaaatgcaaagaaaaatcagcaatgagtgaaaaatcaatttcacatcagactagtgtttattccctaaatctgaaagcagctgatatatgctgtccatagactatgatactgaatatagaatttattcctaaaattcccttattacaaattctcaaatcttggcataaaaaaagttgcctgagagctggtgccctactccaagagattatgatccagtaagagtagagaagggcctaggaaataccacttctaaataagtgattttgctgcttcatttactataacatcattccatatgggtctgattccagttctgaaggctttaagcttaaatatcccaagttcaaccataaccagtatctgagttctagtgtaaaatctgattaactgtgacattcagaattcattactgtcaaaactaaggatcaaagcttagtctactgacatacatatgcacacacacacacatgcacacacaacatatgaataaatgaaaaaagaattatttgaaagaattaaatatttagtatttataagagaattaaatataagaattaaaatttttaaattaaatatttaagaatatatgaacaaagaatattttcccccagtatgaatatctaggtgggaaaagggtcattattataccttagaaatgagtctagaaaatgttaactttaacaatttcaacacttaaaaatgttattttaccctgaggaaacacagttaattagaggtagatataatgcaattcctaatgtgcttgattaggctacctaattgtagccacaaatcccaaatgcaagttattactatctatcccacatctaagtcacaacagtgatatctgaaaccaacagagggtagtccttttaaaaacaagaatgtggcttatagcattgacagtaggcatagatgagctaatggtttcagacagatttaagttttaaaggccagaatataagaaagggacgctgatatagtctgataatgcaagtgagttgtatttaagacagcatatttctcaattccaaacaaaatcccaatcttctgtttcgctatcatgttattctcatctggtattaaatgaaaacattgattctatcttctcttatatacagggatggtatctctctctctctctctgtctgctctatccttctgatagtaataaggaattaaatgcaaaaaaagaccactcccaccctccagatctacattaaagaataaatcatcagtcttcacagtttaaaaaataatcagtaaactatataaccctgtatcaaaacactgatttaaaataacattttcatacttatcagtcaacataaaatattataacaaatattttattttttaaataaaattgttaaccctaaccacaaaggcaataattttgttttgttttgttttcttggagacagttttgctcttgttgcccaggctggagtgcaagggaacaatctcagctcaccacaacctctgcctcccaggttcaagcgattctcctgcctcagcctcctgagtagctgggattacaggcaagcaccaccacacctggctaactttgtatttttagtagagacggggtttctccatgttggtcaggctggtctcgaactcccaacctcatgtgatctgcccgccttgccctcccaaagtgctgggattacaggcggaagccaccactcctggcccaggtaataatttttatacaacacaatgagttttttttcccttcctgctaacgccatgatcatatcatgttacataggaaaaaaaaaacatgttatgccacatgtaacccattctttaaaaaaaaaaaaaaaaaaaaaaggtgtattcctagcactttgggaagccaaagttgccaggtgacgaggtcaagatatcaagaccatcctggccaacatcgtgaaaccccgtctctacttagaaaaaaacaaaaaacaaacacaaaaaaattagcagggtgtcctggtgggcgcctgtagtcccagctacttgggaggctgaggcaggagattcacttgaacccgggaggcagaggttgcagtgagctgagattgcgccattgcactccagtctggagacagagcgagactctgtctcaaataaataaataaacaaataaataaatatttcaaagtattctctatatttttaggtaaatatattttaatattctaaaccacacactgctaggagtggggctatataaagtaattcatctaaagagtctcctaggaatgtatcatgtacaaggcattatgctaggtagaaaagacaatacaaacatattaatctcaataaaaatatgaggccgggtgcggtggctcacgcctgtaatcccagcaatttgggaggccgaggcgggcagatcacctgaggtcaggagttagagaccagcctggctaacatggtaaaacccatttctactaaaaatacaaaaaattagccgggcgcagtggtgcacgcctctaataccagctactcgggaggctgaggcaggagaatcacttgaacccaggaggcagaggttgcagtgagctaagactgtgccattgcactccagcttgggtaacaagagtgatactccgtctccaaaaaaaataataataataatatgaatcaggccttcccctaagggcttacatttcacagctgcagagcaggactaaagctcatgaagaaactgcaaaacatcagacaatgagaagtggtgagccatggagaaagggcaaactattaataaaacaactatcaatgatagccaacttctcaacagcaataatggaatccagaacacaatggactaatatcttcaaagggttgggtaaataactgacatccaaaaattgtttttgcagggaaactaaactgtctttccagatagaaaaatatattttcagctaagcaaaaacagaatttggagactcactgaaagaactgctaaagttccttgagtttatttcagaataatgaataatgaattctgagttgaaaaaaggaagagcaaagagacaaatggtaaacttgtgattaaatctaaaaaacagtaacaatgcatacaacaataaaaacaatatctaacatgtggttaaaagtaaaaatatatatacttagcaaccatgacatataactcacaacaggggtgactggtattccaacgttttatagtcctcatatttaccagtagagaataaagattctgattaccattatagatagatgggtatatattataccattatagatgggtatatattataatttctatattaaaaaccagaagatacgtagagatggtgtgactggatagccacaggcaaaagaataaagttagacccctatttcatagcacccatgaatattaattcaaatgaatcaataggcctaaatgtaacagctaaaactataaaactcttagaagaaactaaataaaattcataaaagaaatcttcatgaccttgtacactgtctcttagcaaccattaataacaaactaagaaatttattcttatatgcttacataaagcaagatgaaaagctggtgttaaggacaataagttcttcttcaaagctcccttggtctcttgctttgtacacagcccttcctgctcaatctgtaatgagcatgtgttcctcagcgtaatctgtaactagcaaacctcttactctgtaaacaactctttgtcagcccagacatgtccagacatgccttgaacttgttctgtaggcaactcttcccaccttagcaacaatctcctcctcccctcctctcttagcaaattgcatgttcaccatagttagaaaagtttaagtcttagccagtcaggttagtttagatggtttggtccgaccccagccaatggggaaataacacagaaacaggaactgcattagggataaaaacccttctctcctttgttcaatgtgctcttgcgatcgttactgacgcaggcaccacccttctgcagaagtaaattgccttgctgagaaaacgttttgcctgagtgctggttcttctttgtagcactgagcaaagaattacccatctgggatatcattctcctccgggaaagggtctccaatcacctctcataaggagacatgtcctgctgcctcactgcggtggcctcaggggtaaggaatcagaacccacccagtgtgaagaataaacctggactctcggcaacacaggaagaaaaagcctacagtacagataccacggcgacaaggtaactctgtgcacagaccaaagtaggaaaagccagggggcagcaggagtacttccttggtggtggggacatcctggaggttgaaagtgtgtgaatgagacatacaattaagtgcgaagcgagtgtggagtccagatccatggttccatggtcacctgatatgccttagggtagctttcctgtcgagggtttataccaacctaaattcctgcgagggaagtgaccagagaaggaagaagtgaaagcaaaggagtgcaagaaacctccagttggttggggggcgggggcagtggtgagcctctagggaaaaggtgcaagaaatctctagtaaacagaggttgagccccatacacacacaagaaactcgagttgagccgtagagaaagggtgcaagaaatttctattaggagaggttgagctccactgactcaggaaaactcaggaagcacctaaaacttccaggatgggaaataccccagacaaggcagggaatcaaaaggaaaagacagacaatataattccctctgatagctctctaggtctcatgttaaaatattggagagaaaatgaaagcaccaaacataaaaagaagcaacaaataataaaatattgttgctttatttaaaccaaagaacctactctcaaacattcagttttctggccaaggtttgaatccagttaggactggatttgtcaacttttaatagaatatgtcaatgacaaaagtcctgtttcccaggaggaaataaactatgccctgtgttggcggcaagtgcctgtcatcctatatcccctaaaaactacaggagacaagccagaaactacttaccctttagatcaccttcccccgccaaacacctctaacttccctccccacttcaagcaaatgcagaaaaaattaggagctgaagaaaacacagaaggaaagtgtgtattaccagatggaagggaaatgttgtctaaacctcttgagagaaatactgtctcagcttcatcaaggaactcattggggtcctcaagctatatgtgatgcagtccttagagtctatgggtacataggaatacaaaccctcgctaagcaagtagtggatagttgcatagtgtgcagaaaaactaatgagtaaaccctaaaaaaaaaacctcccgggggaagaaatccagggttaaggccatgccaaagcatccaagttgactatactgaaatgcccccaacaggccgcctcaagtatttactagtaatagtagaccaccttacccactgggtagaagctctccccttcccaaggacaacagccagtaatgtagtcaaagccctgttagaacatatcatacccaggcactagaaataaaatgggaatattatactccctggcatctgtcctcatcagggaaagtagaaaaaaaaatgaaccaaaatctaaaaaatcacctaaccaaattaattctggaaacctggttaccatggacaagatgccttcctattgccttaccaagaatccaaactgcccccctcaaaaagaccttagcctgtctgtctctttcctccctcaggactcaaggcctcctagcgagattacatccttgtcaaaggttggaaagagggaaagctcaaacccacctgggaaggaccttacctggtactcctaacaactgaaatagcactccggaaagccgaaaaagggtgaacccaccacacaagtgaagaaggccccacctctggcaaagtcatggaccatcactccaggaccaacagcctcaaaactaacattcaaacgggtttgtctttttcttctccccttagctactcaaggatatcttactgttaatgtaactatgcttgtctagtcttaccttgtggagatctccaaagtcaaagacagttagcttgtacagaaaagtacttctgcccctctgtggaaagagttaatactcctgtgtcttgcatatggggggaatcctcagaggaagagttaggcaattgggggttatggtctcagtgggcagttttagggcactgccctaaaaccatacctacacttcaccaaaggggccaccccttctgactgtcaatctaatcattgcaatccagtacttatccattgtaaaaattaaagatctaaagcaaaccatagccattgaaacacggtaccaagatgcaaatgcctggctggaatagattaaatattccatctgcacgctaaacaaaagcgattgttacgcttgtgcgacaggtaggccagaaacccaaactgtcccctttccacttgattgatcctctgatcaaccgggcatgaactgtatggtagccctcttccaaaatcccacagcctggggcagtaaggcatgtcaaaccctcttgctgctattcctagaagtgaaaagccctgcaggtcggcccctgagggctatccaaccccgtactacaaatatcaatttcacctcgtgtctctcacggcaaggggaaaatttggcattccttgggagtctaatgggatgcagtgaatctaagccttttcaacagctaaccaatcagtctgcccttgttcatccccaagcagatgtatggtggtattgcagtggaccactattggatactctgccaagtaactggagcggcacttgcgctctaatccaattggcaatccctttcactctggcatttcatcaactaagcaaaaaggacaatcgtgaaaaaagaagtaccccccacgggtcctttgaccctcacatttatatagatgccatcagagttccacaaggggtgccaaatgaatttaaagcccaaaatcaaatcgctgcaggatttgaatctgtattgttctcgtgggtaactataaagaaaaatgtaaactggataaattacatttaccataatcaacagcagtttgtcagttatactaggaatgccattaaaggaacagctgaacaattaagttctaccagccagatggcctgggaaaacagaatagccctgaacaaaatattagctgaaaaaggtggggtctgtgtcataattggggcccaatgcttacagagccttaacaccctagcaaatgaattagccaaaaattctaaaatagaattctagaattcttctctagtctcacggaaaaatggtttagaaaatggaagggactcataacctttactccccttgcaattattataggtgtactcattcttgtaggttgctgcatcataccttgtattcgtggattagtgcaaaggcttatagaaaaagccttcaccaaaacccctcatgattctcccctgccctactcacataagttcgtactcctaaatgaccaagaggaacaacaaatctaaaatatgttaaagaaatttgaaggggaagaactataaaatcaagagagggaaactgttaaggacagtaagttcctcttcaaagttcccttggtctcttgctctgtacacagcccttcctgcttgatctgtaacgagcacttgttcctcagcttaatctgtaactagcaaacctcttactccgtaaacatctctgtcacacccagacatgtccaaacaccccttaaacttattctgtaggcaactcttcccaccttagcaacagacagtctctccctcccctcctctcttagcaaactgcgtgttcaccatatttagaaaggtttaagtcttagccaattgggttaatttagattgtttggtccaaccctagccaatggggaaaggacacagaaacaggaactgtgttaggaataaaaaccctttggccgggagcggtggctcacgcctgtaatcccagcactttgggaggctgaggcgggcggatcacgaggtcaggagattgagaccatcccagccaacatggtgaaacttgtctctactaaaaatacaaaaattagctgggcgtggtggtgggcgcctgtaatcccagctactcaggaggctgaggcaggagaatgacttgaacccaggaggcggacgttgccatgagccgagaccgcgccactgcactccagcctggtgaccgggcaagactccatctcaaaaaaaataaataaataaaaatcctctcttttgttcggtgtgctctcgcgagcgtgactgatgcaggcagcacccttctgtagaagtaaattgccttgctgagaaaactttttgcctgagtgctagttcttctttgcggcaccgagcacttgtttctaacactggttttttgtttgagtttttttgagacaaagtctcactctgtcacccaggctggtgtgcaatggtgtgatcttggctcactgtagccccaacctcccaagctctagaaatactcccatctcagccccccaagtagctgggactacaggcatgtgccacaacacccagctaatatttgtatttattgtagagacattgtttcaccatgataccaaggctggtcttgaactcttaggctcaagcaatctgcctgccttggcttcccatagtgttgggattacaggtgtgagccaccacgcctggctgaaaagctgtttttaaaaatcaaaaaacaaaaaaacaggcattctgatctctagccagattactgccaatttaaaggacaatttgatgtatggttcaaagaggtcaacaattcaaaataaaatattttccaatttggtcaaggggtggggacgggcgggaagctggtcagaaaaaaaaaaaaacagtgactttttacatttaccaaaaaaaattagaatttttttcttgcctgccttttaaaatttcattcaactctactattttctggacatctcacactagtttcaacttaagattaagtctcatcaggcagttgacctgtagagagctgtaagtgttacttctctcctacaaaaatttttacaaatcaaactatcatgggatgtaagttttgaaaacacaaagtttcttagaaataaaactattactttatgataggacagataataaatgataatctggtccttaatctacctgcactgtttggagagatatggagtcaataatctccctatgttataggagttattaagaaattattttaggcagatagagaagacaaggggtccttggcaagtttcttttcttttaaggcagctccagatacatttcttgcatagcagaaaaatggcctgaagggcgggccagcaagctttgatatgcaaatgccagccattagaaactgggtccactcaatatggcaattcccaccttcttcttgtcactacaagtgcctagcatcatggccacccccacatatccccacgtgtgtagaacatcatggtgccctgcatttgcatattaaaaggctagggtgggaggaccagatttttgtgggctacatgaatgacatacctggtcaacccaatcccctggactctatgcaaatcagacaccagctcctccagcctcctaatataaatggctgttttctgctgcactcagggttccctctctcagcttggagccccctccctctgtctctgtatgggggagccccttccttctttcttgccgatttattaaactctctccgctccttaaaaccactccacgtatatccatgtcgtcgtatttaaactggcgtgagaaaaggaccctggtattcccctccagtcatcagagtcgtatcattttggtgcactggccgggaatccgaggtacaacattcactgaagtggtgattatacaagcgagcttaaaatctgttctatcattctgaggtgctcttggcctctattttaaaatcaaatcaaatcaatcaaaaggcatctatctgtctgctggttagctacacttatcgttggctgctgttctaaagactcagatgtgaggcttgctggtgagaacatggagaaccccccaatacccacaggtgattgggaatgttggccgtatttcgaatcagcttcctttcatggggagacctcgccgttgcgcaaggctgggaaaagttctgaggcaactgagcatctctgggcagggcacaccctggtgtgactcaaagacctctggaccagacccagcctccaacagcccatttcaggtgctggcagagaatcctcagctatccggtcatgaaactttccttccttttctatctgtggtctcttactctgtgtgtatgtgtcaactgtgtgggaatttagtaaccgggagtttaactcaagaatgccattgcaatctcctgaacagagggttcctccgggacagtgagcctctctctctcagccccttggtctggagagcacacggcatttccaggtctctctaccgcttgtctgaggagcacacagtatttctaagccaacagtgccacctagaggaaacagaaatcctctacatgaggcactttttttaatgctaacactgcagcttccttttgcactgctagaaatcaggctctaagcctcttccaggaatgggaaaattctgctttcaacagttagaaattaaatgtcttccatagccaaattttagtctcaatattgtcccatcagcaggaaaacagccatttggttcctacatttctttaagtcacctattctgtctccaacagagacagtacttaattagtaaggggattttaagtctggaagttaactgaaaccatttttctaagggtaaatgctttagcatgggccataatagcaggatatagagttcaatctagcataacccctccattaaaggggccttccccaattacacagttttccctgagatccatttttttttagggaggtacacaggtcacacaagtctaggaggtcaaagggaaataacaagcagaggactgggactacttgggtaagtgtgactaggcctcaaaagtctagtttctctggtgccatggcttggagggtcacacctacagccacaggcggcacatttaactgggtgccgggacccaggaaccagggagggagactagttagaggaatgccccctactgttttcttctccaccctgagtcatacaccaaaaggaaggagactaaaaggacacttttattctcacttctctttctagatggccaacagatcgtcttcagcatgcactcctctggaatgtattttaaagcactgggactccttcaaccctgagactttgaaaaaaaagtgactcatattctattgcacaagagcatagccttcttactatcttggggacagataaacctggcccgctgcggggagccttgattttaatattatccaacagttagatcttttctccaaacagaagggcaaatggactgagatcccctatgtacagactttctttgccctgtgaaacagcccagacctttacaagttctgtacaattgacccagttcttttagcggccacagggaatcgttccccagagctaaagcaggttccagaggagcaatctgaaacagctattgaatgtcccaatccttccagtccccctccaatcatactatcagctcctccagctccactatctccagtatatcctactctccccgcttcattcttacctctgcaggaaatggctgataggaatggtgccatgagggttcaagtttccttctcattacaggaccttaagcaaataaacagagacttggcccaattttctgatgactccgataagtatatagaaattttccaaaatttaactcaggtgtttgatctcacatagagggatgttatgttgctgctaagtcagaccctcactggggctgaaaagccagcagttccacaggcagcagaaaaatatggatataagcaacatgcctcctgtagcagaccaaggagaaaaagaggagacaaggaaggtaaggaagaagtggaaactccattcccactaggaagggaagcagttccagcggacaaccctgattggaaccccaataacgcaggaaatgaatggaaaaggaagcacttcttaaggtctatgttagagggcctatggaagaccagggccaaacctctcgattactctaaactatctatgatagaccagatgagaatcccacagcctttatggaaaggctaagagaggcactaataaaacacacctctttatcatgattcagtcgagggacagctaatcctgaaggacaagtttattacacagtcagctcccgatattggaaagaaactacagaaacaagctataggaccagatagcaccctagagaacctcctgagaatagccacttcagtcatttacaatacagatcaggaggaggcccaagaaaaggaaaggaaatataagtgaagaacagaggctctagtagcagcattgcacgcttgtaaagtccaggatccctgaggtgcatctgctagctgttatcaatgtggcaagtcagggcattttaagagggaatgcccaggcagcaagacgaagccaccttgaccctgtccagcctgtggcggagaccactggagatggatctgcccccagaggcagaggtcgctgggttcagaaccagtctcatagatggtccagcaggactgacgggtcccgaggcttaaacccccggctccagcgactcagactgccattacagcacaggaaccctgagtgattctggaaattgaaggaaggaaggtagatctccttctggatactgaagccagtctcttgctcctcctctctaattcaggcctcccctcttcccagagcacaaccataaggggtgtatcacgaaaaactctaacccaatatttttctcaaccccttttgcagatggggagacttactatttaaacatgcctttttaatcacgcctgaaagtcccactcctttattaggtagatatattctagcttgcatgggggcctgcagcatctttacagccccaggacaaactctatctccccctgatggaagctaacattaatgtggaagtgtgggcaacttaaggaagaataggttgagctataaccactacgccagtccagatctatcttaaggatcccacttcttttcctaaccagagatattatccctaaggccagtggctaggaaagggctagaagccattattaataacctaaagatgcagggcctcctcaaaccctgtaatagcccctgcaacaccccaatattaggagcacagaaacccaatggggaatgaagcctggttcaggaccttcgcctcattaatgaagctgtagttccaatccatccagtggtccctaatccctataccctgttaactcaaatacctgagggaactaaatggtttacagtcctagatttaaaggatgcctttttctgtacaccgttacatcctgactgtcaataccggtttgccttcaaatattcctccagccagacgcccagttaacactgacggtgctgcctcagggattttgaaatagtcctcatctgtttggacaggcactgtcacaagacctctctgagttctctcaaccttaagttaaggtcttgcagtatgttgatgatattctgctatgtgccccaactgaggatgcttttcaggaaggcactgaagctcttctcaatatgttagctaacagagaatataaagtttcaaaacccaaggcccagctctgcaaaacctcagtgaagtacacctaggcttagtgctgtctgaggggaccagagcattagggaaggagggagttgagaatatttcttcctttcccctccccaaaaccctcaagcaactcagaggattttggggcattacaggattttgtagactatggatacctgggtatggtgaaataggctgtccatgatataacctcataaaataaactcaaggaactaaaactcatcttttaacctgggaatctgaagctcaaaaggcctttgaccagctaaagcaagccttgcttaaggcaccaactttcacccttcctatagggaaggacttcaatctgtatgtatcagaaaagaagggaatggccctgggagtattaacacaggcccaaagaccaggccaacagccagtgggttgcctaagtaaggaacttgagttggtggctaaaggatggccagcatgcctccccgccattgcctcagtggctctgttggtcccagaagcctccaaattaactctggaaaatgatttaactatttatgccccacctaacgtggcaggactactgcacttttgggggagcctttggctaacagatagctgacttcttaaatatcaggccctgctgttaaagggttccaacatccaattaaagaattgttctcacctaaatccagccgccttccaccaggaggaaactggggaatctgagcatgactatgaacaaatcatagtacagacctatgcagccagggaagatctcaaggaaactcccctagagaacccagactggaccctcttgacagatgggagctcttttgtagaacaaggaatctgtaaggcaggatacacagtagtcactctacatgacatcactgaaagtgtgtcactccctccaggcacaagcgctcaattagctgagctaatcgctcttacagaagcaattgaattaagcaaaggaaaggtagctaacatttacacagactccaaatatgctttcctggttctccatgctcatgctgccatttggaacgaaaggcattttcttaccaccgatggatctcctataaatacctccaggaaattaacaggttattatcctcagtttttcttccatgagaaatagcagtgatgcattgtaggagacatcaaaagggaacagatgaggtagccaaaggaaacagattagctgatcaggcagctaagtcagcagcaaggaaggctcaagacaacacacttcaaacccctctaatctgggaaggctccatgagagaaattaaacctcagtactcccccacagaaataggatgggccacttctcgagggtatacatttcagccctcaggatggctacagtcacaagatggcaaactccccttgacggcctccagccaatggaaagtccttaaagtgcttcaccaagcttttcacttgggagaggataaaacttatcaatgtgcccagagattgttttcaggaaagaacttactaaaaacaatcaagcaagttgttcatgcttgtgaagtctgtcttaaaaataatcccctgaacaggcgactccttcctcctcaaacccaaagaacaaaaagatacccaagggaggagtggcaggtaaacttcacccacatgccaaagacaaagggcattcaatacctgctgtatgggtagataccttcactaactgggtagaagcatttccatgttgtacagaaaaagcctctgaggtaataaaagtattagttaatgaaataactccctgctttcatctatccaagtaccttcaaagtgacaatgggccctcatttaaggcagctgtcacacaagggatctcaaaagcactaggcatagaatatcatctccattgggcttagagaccctaatcctcaggaaaggtagagaaaactaatgatattaccaagagacacaccagaaaattgtcccaagaaactcaccttccttgggtcactcttcctcccacggccttactacgaataagagataccccttgaaaattaggtcttagcttttttgaaatgctgtatggacacactttccttaccaatgatttttctattagatcgggaaacctctgagctagttaagcatgtaacctctctggctcacttccaacaggaattagcacaattagcgaaaacccaatcccaggaaattggaccacctctatttaacccaggagatttggtactggtaaaggatcctcctctctctctcccttcctaagcccaacctaggaagggcctcacactgttcttcttccaactcccccaacaataaaaggtacaggaatcgaccgactcctggaaacatcacactcaagtcaaagcctggagagctgagggagcaacccccaacagcccagaggaacgtcctgaatagcaatgtgaagaaatggaagatcttaagctgaaaatcataaaagataagtaactatatgagaactaatcatcttattcagtctcacccctacctcaacaaatactttttgtcatttctacctctccttttgagccaaatatcagaacttctttttggtggaaattatttactactccaaccttgcaggaattgctatactcactctgctatttgcagtagaactatatactgtagcaccctcagggtggaatgtcagagagagaatctcaattactactgcattttgcttaattattaacctcacagcaggaataacagttactaacaggaagtaaacatgagcattttactatcactaaatctgttagaactctttattggacttagtaatacgtcgcaccatctagctcctacaatatctgccatggcccatttgtacagtaagactaattgttgggtctgtcctaagtggttcgctcagttcagtgacactaaggaaccttatagttacccggaactcaccatcttaggattccctttgttggctttacctttaacccttaaagacttatcaggcataaatgggacatggtatgggaacactttcaattgggtgactaactcttcccaggagaacactctgccccagcgccaaagaactttctcccaaagataagcttcacaccctcaggcttggaaaagttgatggagtaatagcaaatgcctccctctgctttaaaagtagtggggaagaaccatacttgggagtaacatcacacttgtaattgctgatagttcaaagatttgaggagagtgcaacaagggtgatatacaaggatagaagccctagtggggggctttcagaaactagtctccttctggttggaagtaccgatgggagtggcatgctctaagtaaccaacttgactataatgtaaaaaataacacatgggtctttccaaactcccccccacccatggaattccagacccttgtatgatgtttgctaacagtggcggcttactgatctgagggcgaactgaagacatctggactgacaccccttgccacaagaatcatctgagatattggccagggcatattacgtctctaatttttcaaaactccatttgtcaggtggacccttttcacttggcatgtcaaattccaaatgacatcgtaaatgactaccctaaatatggttatctttatcccaaggatgcctctattatatgtaaagaaaggaaagttctaagatatgagaaaaatctgccagtgtctctcacaagccacaacttagaaccatcccttcaaggaacagggctacattttctttgtggctcctggatacacttaatcctcccaaggcattagaagggaacttgtactatagctgcagtagttctcaacttattaaattctaccaagatgacagcatcatctggggacatccctaacttagcctcttttctagaaactgcactattctgaatacatcggacaaagggatctatcatttctatgccctcatatggagatttaactgaaagggcagcctggggagggcatgcacatgacaatctcatcttagaaaaagcatggatgggaaattctatagccagaggtatattctggtttatgggcatcccctctccttgaaagatcaatacttaatatctctattataatgcaatgaggatggaaggcaactgtatgggccatagaggcacaaccacaatctatagactctttagccttagtaggtagtagcacaaaatcgacaggccttagatgtccttacagctgaagtgggaggtacctgtgcacttttaaatgcaacatgctgcttctggattaaccctctagtagattaaggaaaatctacaggtacttaaagatcaaatcaaaattattgacaggctaagagaaaatgaaggcttcagccccaggtgactacaatccctctttaatgaattccagtcttctttatggaattggttagcccctttattaagctccctcttgcttacatgtcttacattaactcaatactataactcaatactatataacttgtataactcagtactataactagaattgtttcctatcgcctagaagcaatcaaattccaagtggtgttgcaaaccaaaccacacatggacatgccattcttccgaggatccttggatctaccccaggaggagccctagctgctgttccccattcaatgctccttttcagcaggaagtagccggaaagagtcatcacccaaaaccccctaacagcagttagggtgacatctcctccgggtagaatgttataggagttattaaaaaattatttggccactgccctcactgccgctgctgctgttgacctcgccagggctgcttcgtctccgaggtcagactgctcccaatgccatgaacggagacagcacctttgcaaagagacccagggatgatgctcagatatcagagaagaaacacaaggccttcaatgatattgccagatacttatctaataaagagtggggaaagctgaaaaactcagagaaaatcacctatgtgtatatgaagagaaactatgagaccatgactaaactaggtctctaggccaccctcccaactttcatgtacaataaatgggctgcagaattccaggggaatgattctgatatagactaaaactgcaggaatcaggatgaatatcctcagatggctttcggcatgctacaagggaactttccaaagatgatgcccaagaagccagcagaggaaggaaatgatttgaagggagtgccagaaacatctggctcacaaaacaatgggaaacagctgtgtcccctgggaaaagaaagtacctctgagaagactaacaagacatctagacccaagaaaagggggaacacgtctggacccacggactgcgagagagaaagtatctagtgatttatgaagagatcagaaaccctgaggaagatgacaaataactcccctcagggataggatgcaagcccatgatgagaagcagaaactggtgaccttctatgaacatgggcatggctgcgaacccctcatcatcaggtgtatagcaagtgaaagcaggagttcacgacagtgaaaagttgagcgtcatttttcttacagtgtgccaagagttagatattagcattttcattgtattttcttacagtgtgccatcctgttagatatttgcatttttgttgatgaatgagacatagttaatgcatatttctgtttgtgtatccatgcacctacctcagaaaacaagtattgtcaggtattctctgcatagaacagcactaccctcctctctccccagatgtgactattgaggccagttctgggtgtttcagattttttttctctgcatttacacacacacacacacacacacacatacacacgtggaataccactataaatatctccatctgcttttccccatcgctaatgagtcctggtcaagcccccctcactctgtttcctgttcaacatgcactccctgctgcaaactcccctcatctgattcccctgtgttggtcactgccagttaataaacatttacaaacttaaaaaaacagataggacaaggggtccttggcaaggtttttttcttttaaagcagctccagaaactttattgcctagcagaaaaacagcttgaggggctgagccggcaagctttgatatgcaaataccagccatcagaaactgggtccactcaatacagcgattcctgcctcaacttcttgtcaccacaagtgcctagcatcatggacaccaccacatatccccatgtgtatagaacatcatagccccctgcatttgcatactcaaaggctagggtgggaggaccctttttttggcgggttaagtgaatgatatacctggtcaaaccaatcccctgggcctcaaatcagacactgcctcctccagcctcctaatataactggctcttttccacactcggagttccccctctcagcttggagcccccctccatctctgtacaggagagcctcttccttctttcttgcttattattatttgtgtatccatgcacctaccccagaaaacaagtattgtcaggtattctgtgcatagaacatcactaccctcctctctccccagatgtgactactgaggccagttctgggtgtttcttggtattaaactctctctgctccttaaaagcactccacatgtgtccgtgtcgttttatttaaaccggcgagacaaaggaccctggtgttcctccggtcatcggagccatatcacctacattcacgattgtgtgacaagagcccttccaggtccatgggttcttcacacatctctaaaatcaattcagttcagttcagctgggtaagggtccagcaatcacactctctctaccaggctgagaagcaaaatgatggcaaaaatgaatgaatgaatgatatatactgaaggtaaaactgaggtccataaagatacaaaaatatgcctccaacaattttaatttctgcaaacttactagagctgaggcaggagaacagggtctggaggcagggaacctaaggccaattcacgctgacttcctagaactaaattaagatgaaaaccccaacttttcacacccaagtaacaaaagtaccagaggctactactccctttgcaaaggccccctcccaccctgccttttctgtgtggcagatgaaaaactgaacgtacctctgattggtcccctcctgcaaccaatcaggctggtcatgggccaagtcttcatttgcatagaagtgtaattttgtaacttcacttcagcctctgacaggtcactttccacaaccaatcagacgtctgcatagggtgtaactttgtaacttcacttcagcctctgattggtcactttctgcaaccaatcagactgatcatgggacactacttcatttacatagggtgtacacgaagtaacaaaatgggaaacctctagagggtatttaaaccccagagaattctgtaaccagattcttgagctgcttgcttgagcccactcccaccctgttgagtgtgctttcattttcaataaatctatgcttttattgcttcattctttccttgctttgtgtattttgtccaattctttgttcaaagcaccaagaacctggacaccctccaccggtaacagagctataatgacattatacatcatgtttaagaatttatgattcaaatatttaattttcagcaataacataaattaacgagaatttagagataaggaacaaagttacttgatttacaaaagaatgtaaatcaaattgttttgaatactgccttgaaattacgatttcacaagcaaaaaagttctttgtataacctctgacctgctaccatctataaataaagaactaaagtacaaagaggttaaattacttgaccaagaacagagctcaaaataaaatcctagtatcctgtttctcaatctagtgttacctatattatcctacactatatctctcagggcttttctccctttggattctgccttccaaatacagacatctagcaccaatggttaaagaacagggcttggggctaaacaaacagactaagagaaactcgtctccaccacttgaaaagctatataaccctgaatacattaacatcctctaggtctttttttttttttttttttgatcagtaaaaaggagataattgtattttacctcaaaaggactccataataaaagaattttaaaataagttatatataatgtgtaacatattgcaaaattttatgagagatattttctgttaattttaaggctaattgaccaaataattcactgtcatatctggaagtgatgttatttgaatatccattatcagagtcctgaaagtttcaaagttgcaaaaacatagtattattcaccaatgaattgactgttaataaaaagcagaacaggctagaaaatggttgaaatatcacctaccttatatataaaatgggtttataattgtaccacattaaattttttaattaaatgaaaaatttatgcaaacctcttatcatgatcatgatgccctgtaaataaatagtaaatgctcaataaatgttggtatcattattaccaaaaggttaaaaaggagttctctatttgcttaaaaatagtaccaagggtatacgtggatgagcagaagtaatggctgaaataagattgtcatgtattataattgtataaatttggtgtgtacaaatataggttaccacttttgccttctttctactttggtgtatgtttgaaattttatggaaaaaaaagaaaaagatagtgagaacaagaagatattttacattaagatgagttgttttaaagaaaccattcagcaaagtaaactaatgaacaaatgaaacctaatcattgtaataaaatacataagcaaggaaaagagacagagcccctgggaagttttcatattgtccttcaaaattagtagttgcctacagctgggaaaatagagggtttgaaggataatggctaaaggggatataatttctttttggtgtaataaaaatgttctaaaattgacagtggtaatagatgtatgactctgtgaatatactaaaagtcattgaattgtacacttcaaacgggtgtatggtataagtccattactgtactgctataaatacctgaaaaagaatttaaaaaaaaaaaaagaaaagaaaagaaatatcgagcctgaggtttttataaaagaaagaggtttgattggaaggcaaagcaggagtaggtgtcttacatggcaggaggaagagagagaggagagaggtgctacacacttttaaacaacctgatcttgtgagaagtctatcacgagaaccgcactagggggatgatgctaaaccattcacgagaaactgcctccatgatgcaatcacctcccaccaggccctaccaacattggggaatacaatttgacatgagattggtggggggaggggcagcgcatcgcaataatgctgtttaaaaaaaaaaaaaaaagtatggtcttgatttcccaaatatctccgaaatcatctagttgtctttttcctgtctctttttatgaacaagtcaccaccagcttctacttcaacagcaagtggtctcctaccttccagttttgttttctgggatgtgatccatcctcaacacatcatccacaatgttcttttacttcccagcctttgaccaagctactctctcagcctagactactctcctcccaaaccccttttaccttgctggttcctactcacctttttgggcctcaacctaaacaacatttctgccaggagtcttttccctaatcccctggacttctgtatgtccctctgttgtctatccctaccaccctgtgtacttcgcctatcgtaacgctcctaactatttactgtcttctcctctagacttcatatatacaatgattaggggaaatgtctaattcatacccccagcacagtgcttaacatgcaacagacattcaattaatattggctaaacaaataaataatccaacaagtccttatctttataaggcttttgtttttacacaaaatgaagatagtgtaccaaatgataacttgtttcttcctttctgatatatatccacaggatgacctcaaaatttatagtattcaagagccctacgatttctcagtaaaaacaaccaactaatgaagatatgattaaattgaagttcatttttatcagcccctatttaaaataaaataggttaattagataagaaaattatctctaatacaaattagctgttgggaataatcaaaagaaaaaacttaacactatctgtacctttttaaaataaaatacataagtacacttaaaaatcagcccaaaacagacattaaaaactatatttaagaactcgccgggcacggtggctcacgcctgtaatcccagcactttgggaggccgaggctggtggatcacgaggtcaggagatcgagaccatggtgaaaccccatctctactaaaaatacaaaaaattagccgggtgtggtggcaggcgcctgtagtcccagctactcggtaggctgaggcaggagaatggcgtgaacccgggaggcggagcttgcagtgagccgagatcccgccactacactccagccagggcgacacagcgagattgtctcaaaaaaaaaaaaacaaacaaaacaaaacaaaaaaaaaaaacctcaaatttttgaaaaagataaatgaattgcctgagagcctgcctatcaggagccacatgatacaggagagaaagactgtcctgaggaaggttacgagccaagcctaagcaaaaagtaagtttcttttttttgcctcaaggtcctatactcccagtttcctcttacaatccctctgtcactcaactctggtcccacagcaagattatgctatgtacaacaagtgctgcatacttcaaaaacaacttcctcaaactaatatctgtggcaacagtagctatttaatggcctccaggtctcagcaaagaaatcctaggaaaacactggggatcagctatgtaccttatgttacaatttggtagcctggtagacacatctatcctcattgtcgtagatctatttccttccaacctggaatttgaaactccatgaacaaattacaacagctaaaaagtggtgctgctaatgttagtgtctcaatttagcattatttgaaatctcaaaataccctggctaaacgaaaattcctcaatggtaagtctagaataattttctgtactagaatcccttcgctgctgagattctcatgtaatcctctcctccatgtttatctccctgcaattctgccattcttggaacacagtaagtattcaataaatatatataagtgaataaatgaatgaaccttctaaaagctccaggttaaaaaggaagaggcaaccaccacctcaaatatctcctaaaagtaactaacagtgtcgtacatataatgcatgaagtataataagtgtgtaaattataaggtatatttgtcaactcccatgtagcatgtaaattgtgtcattatttaatatgtacactgaggtttttacaataatcagtcttttaagaatttaagtgcattcacacatttcacctaaaaattatcacaacaaaccaaattaatgcagcacttcatgccacagtctcaccaatcaagaagaaatgcttactccaagccaaatagtaatagtaataaagttgaaggcagctaactaaaatatgttgtagatacaatctaaaagtaaaattatatttgataatacacaaatttcatgtacattatttagaaattaatataattatgtgacatggtaattctcagctgggtgttgtaataaaaggagataaacacattttaggttattctaaaatgtttggaatttagctagcatagatttgtttaattttataaatgagaaaaaaatgaacatcttatagacctgtggttaatggatgaccccaaaaaattatataatcaaagaccaaaggataaaaaacatatctgcttgacacggatatgacataatctgatatatggcatgttttaaagttgctattatattataaatatcaacctattccttatgttctgatgcaggttattcccaatattcagtaatcttccacagtggttattttcctgagtgctttacaataaacagataagccatgaggcaaacccaacaatgaaaaacaatgtttatcaactacaagactcaggacttggtaagcacacttaccaaagaacagataaggtaaagaacaaatagctcccataaattaaaaatcatgaaaacttcagaaagacatgaattaaggaaggaaagcacacactaattggaaccaagcgttacatcaacacacatagcaggctttccttctaaatagtctttattatgcctgctaaaactacttatattcaggtaatatcttaatacaactgatttttttaaaaaaaaaacaagagtacctttccaggcaataataaatgcaaccagtatcattcattaccagcaccaatcactcaaaccacaattctaattcattttccacagaagtctcgatttcctgttatttattgtaagtcttccagcagtcttactattccttcttatttttatccaccattccttatgcctctttcctagaactatttgccctttgatatggtttggctgtgtccccacccaaatctcatcttgaattgtagttcccataatccccacatgtcgtgggagggacccagtgggaggtaatttcatcatgggggcggctgccccatgctgttctcatgatagcgagagagttctcatgagatctgatggcttcataaggaaatttttttccccctttgctcgaaacttctctctcctgacaccctgttaagaggtgctttcccccatgattctaagtttcctaaggcctccccagccatgtggaactctgagtccatttaacctcttttctttataaattacccagtcccaggcatttcttcatagcagcatgagaacagagtaatacacccttgatcttgaaactctgacactgctttatctatgtagaatagcttctaaataacagtacctactaatcatgccttaaactcaggattcttttccattagaatattctgtattctgactatataacataccagtgcaatcactcactgtttcatacattaataaaaaattgttggggaaaaagagtcaaagttcagcttggaggtaattgcaagaactaatgaaagtaacaaaaattttaacatatttacatcaacccaattcaaggaaaaagtgaaaatcatactctcccatctctgaaagattatagaaacttatatttaacatttgatgaattactcagtgagaaaaacaaggatatttgctactgctaactaaattagttttaaattaattcaaagaataaaaagaaaagacagttttctaaatagcaatagaaaaggtgagtataaaacaatgcacaacaggatcaaagggtttctggagacttatgaaaaagataacgactatagtcatctattcagtggtgtttttcagttcttcagctagccattgtcatgaaaaaggcagcataccagtctggataccgtgtggggcctagtctgagaacaggagagagttattttttaagctctcctcagccaaactgaggaaggctagttcctgactggacccaggttaataccgtaatactctattgaggttgaagtcagtgactataagaagattattgagttttgaagccaaagcttcaaaaaataaaagagtttgtctgtgaatctcaagtaaatttttgagaagtcatgacacaggaacacagttttaaaaagagtatgatttgcttacagcagctttacaataacactaagaaaatctcagagcatctgttcttcaacttctcaatcctcattccccacatcattcttccctcaaaaagttaattttaatgtttattaatgagaccaaacagctagaacacatttttaaaaagatctccacgcacttctgatttattctcaactcaactttgttcaattactgtccagcacttttttaatgattttctgtttaaccacgtagtgtgtatagagggtgctgtgggttgaattatgtcctccataaaaatacattaaaattttaacccctagaagctgtgaatgtgaccttatttggaaatagggtctttgcagatgtaatccgaggtaaaatgaggtcatgctggttcagggtgagccctaagtccacttactggtatccctatatggagagagaaaagatatgaagacagaaagctcagggaagaaggacatgtgaaggtgacaaagactggagttatggtgccacaagccaatgaataatatactaaggactgccagtaagcacccgaagctagaaaaggcaaggaagaattcttccctagacccttcagagggagcatggccctgccaacaccttcattttgaaccttatagtctccaaaactgtgagaaaaaatatttttgttgtttaagtcctctagtttgtggtaatttgttatagcagccctaggaaactaatacaggggagtagaggttaacagttctgaacctgctttatacacatatactggggactgagcaaacaagtaaatggatggtagatggtgggaggcttctaactgttggagagggaagttatagataagcaagggagaagggctaaaataaatcctgctgtctggattagagtcaaagacatcataaggaactcatgtttggctcaatactaatactgacgaataaacagataaataattctagatatatgtgtaattataggctaatatacatacctgcataacctagccctgtcctctgaaagggcctaaaagcaatgacaacccaataataacaagtatgtccagcacccagatcttggtttctgaataccactctccaataaaaagaaccagagctcattggtgaaatgattgattcaagggctaaggtaggactaagatgaacatggagcattttgtggtacccaaaagtaaggaagtgctcaaaaaacaaaaggatggcagggtggtgtccatgtcaaagtgtcaccagaacaaccctgaaagagttctcaatggcaaaatttgaacaacaaaatattattactaagtcataatcaaaaatataaaacaaattcacatagtctatactggcataaataaatgattgaataaataaataaatgagagagaagaggttactttcttacagaagaattccaaatcatatatataagtatttagtcctccaggatgtagaacttagtgcctctaactcctattttcagtgtgggcaggactcagtgacttgcttccaaaaaatagagtatgattttaaaaaataatagaaatggtaaaatactgttttatagaagagaaacctggcaaacatatcttaaacaagcgaccaaggtaaatatcactaatgatgtcgaattattattatgtacccctgatatgatatgatgaaaagaatattttcatatctgtagtattcttgccaaaaacttacaaccacagtctaatcatgagaaaaacgtaagacaaatctaatttgaaagacatctataaaatatttgactagttctcctcaaaactgttaaggttatgaaaaataggaagagaatgagaaaccgtcacagaccagaggagattaagaaaacattacaattaaatgtaatgtggtgtcctggataggaaccaggaacagaaaaggacattcatagaaaaactggtaaaattctaataaagtctatggttaaaaaataaatgtgtacatataggagtccacattgatataaataaacaattaaataaatggaagagaagtggaagtggcaaatatgtcttaaagaagaattccaaataataaattcacatattctccctcacaggagatggagttaaaccctccgttcttgacttgcctccaaagaacagaatatggaaagaagaaaatttgttactatacaatgcagagaacttgcaaacctagtactgcctgtccctgagccttcctgggggtgtgtgtgtgtgtgtgtgtgtgtgtgtgtgtgtgtgtgtgtgtgtgtgtgtgtgtgtgtgtgtgtgtgtaacgccatggagcaatctcagctcactgcaacctccgccttccaggttcaagcaattctcctgtctcagcccctctgctgtaggtgggactcaggcacttgccaccaggcccagctaatttttgtattttcagtagagacggggtttcaccatattggtcaggctggtctccaactcctgacctcaggtgatccacccaccttggcctcccaaagtgctgggattacacatgtgagccaccacacccagccctggggtttttttaatgatataaattaccagtcaagctaccaacctggtccttaatttctctggtgctggctgaaaattcagccccttggggtctgctaacaaactttcttacatattgatctgacaccatttctagaattttgtcattttctccctgccttcagagggttgtcttttttaaaaaaaaaaaaaatcttgagttttagtgggatgccataaaggaataaaattgaggcgtgtgttcaatttgccatcttaccctagaaatttgcttgaatttctttctaggttggtacatatatagctatctaattagttttaactggatataccgtggaataaccatttctccattggtaagcatataaagttgtttcttatttttcactaaacgatgttgcagtgaatattcttatacatattatctttgttcatctgtgtgcctgtgctgagttaagaacatatacactttatgtaagttattcatggttaagctatttagcctcttagtctcactttcctcatttgtgaaatgcagagaacagtgcctacctcatatggttattgtgaagatcaaatgagttaacatgtgtaaagtgcctaaaacatagtaacagctatataggttgttagttattgtcaaattgccctctgtaaaggctatcagttattacagagccgcatttcccacctttgctcaaaccctggttattacagtctactttttgagaaggaagggcaattttattggtaaagacagcatcagcacctcattgtctaaactgtcgcttcactgtgactgagtttgataatcttctttccaatgtttatcgatcaatttcccttttccccatgcttatgtatatcttttacttataaattatgaaatatttgaaatgatatacatgaatatctgttttggggtatcatccttatttatttgagctttttcttcccaaagtgaaagcaagtttattaagaaagtaaaggaataaaacaatggctactccacagacagtgtagtcctatgggctgctggttgcccatttttatggttaatttttgatgatatgctaaacagggggtggattattcatgcctcccccttttagaccatatagggtaacttcctgacgttgccatagcatttgtaaactgtcatgacgctggtgggagtgtcgcagtgaggacaaccagaggtaaatctcgtcgccattttggttttggtaggttttggccagctcctttactgcaacatgttttatcagcaaggtctttatgacctgtagtttgtactgacctcctatctcatcctgtgatgtagagtgccttaaccgtctgggaatgcagcccagtaggtttcagcctcattttacccagctcctgtttaagatggagttgctcaggttcacacgcctctaacatttcccccctcccttttataagagaacccttaatcctaatgattgcagagggatgaagatccatcttcttctgtaacttcttcaggctgaataggggcaatgatattcctgcctaagtatgagggtctcttgcactcagggtagagaggagctcagtcagaaagcaccagtatggtaaggtccattcataactctttaagtttcaacagaaggtaaatgtttaatttatgaaaatattcagtaagcttctcctatattcctacacaaagagtgtaacagcaatatattccacaagagtacagcaaaataagtaaagttattccaagtaaactaaactagaaggttttccatgaactggacaactgttgaaaccaagttgatatggggttgctagctgattgcaatgtgcccagaattagaatactgattcagatttttacattacccatcccacttgttctgagcaacagtcagagatcacctggttggttcacaggaattagttcacagggttagcctacgttgcagaaacaaacttaaaaacaattaatgagactagaatttaacaacaagtgtaccatagtttttgaaacatagtatttccctctccagtttctcatttttactaaagacaaattatggtaagaccgatatgctttataaaacttggcctgattatttgcataaagtgcagcaagaataattatttttgacataagctcttttttaaattggctttgatggaactctgttccatagatggaatttcagataagactttttttttttttggagatatagtctcgcacggtcacccaggctggagtgcaatggcacaatctcagctcactgcaacctccacctcccacgttcaaacgattctcctacctcaaccttctgagtagctgggattacaggtaccaaccaccaagtccaactaattttttgtatttttagtagagatagggtttcaccatgttggccaggctggtctcgaactcctgacctcatgatccacccaccttggcctcccaaagtgctgagattacaggtgtgagccaccacgccaggccccagataagactttttaaaagccaagcccagccttgggtttctaccctcaagtagctatgaattgggtaaattcctctcctcttggggtcccaagataacttggagctcctggacctgatatgaaagtgacactctttacttaccacaggtcagaaatcctgtttacagggactgtgtaggcaaggaatgaggccatttcctcaagggactttaattggctctgtaagtcaagtttaatttcttaaaggaaaacacaccattccagtcaaagccttggtaaaataaccaatttacccaattgtgtcctgttacaaaagaaaacagattcttactgcacctatgcaaataaccatattgccataagttaagaatactcgcaactagtttccaaattctggagaaatcaggtagagagaaataaatatgctccaaagtttgttcataggagtacactcaactgttaaaagctgtaaaaagctcaaaagaagttttcttgactctgaaaaacaaaggatcagcaacattttaagcaaagttaaaaagactaggcttcttcagtttagtccatgtcgttatcttctgttggatagttatgaacattttagctctgagagttctgaaagttttttcctttattctgatgtcataatctccaaagctatcagaaaacttgcacttaagaatacctgctagagttctatagttgattataaatcgccttctaaagaggactaaaacaagacaacaattgtctgtggatagtaaaaagttttaggccagcccctattaaagccacagtagataaggaaatttggttgattttgtggtacacagaattttacataacaattataaataacatacattaagtcgtattagaattataggagtttcccataactttggaacatattccaataacacatttatgcaaatatagtacaatgcaaacaaaacaccattttacatttgataatgcttcctgtatgacttttacaccaaataagccaaatttcacctttatattaatgttctattaatgttaaacccaattcttaataaaattttacaaatatgtctatccaatcttaatcggtttgaccataaggtaagattcttataaccctttacatttttttgtgaaagagcagattagtgctctaagaaaaacctgttgtgcttttattccaatgtttaatttacggaaaaactgagtaacacccctttaactttagtcaatatgttcacacacagaatctctctcaatttttttcacaccatccacaactgttcaaacttttagctttattctaacttaaaataattatttaactctttaggcaaaaaaatccacattcccgtgccttcttataatcttttaccaaaagtacattttattttccttacacaccttgcatatagaactgtttcttcaatagtctcaattacatgttacgatgttaacttttacgtttggtgaaaaccctggttagtaagcaattttaattgtgttactaggacacaccaggcagaactgcagataagaactgactctccagcatagctagggggcatggctaactccacatgtccccaggccttatctagaatctaatggctttacggtaggcaaattgaacagtttccaaagtcaaccagtttgaccttaaagcatttagcaaatctaatatctgaccttaatttagaccaaatgtctacattttcaagacattttattttacctataatttttaaaactgtctttatttccaaaagattactaaagtcacgtgaacaaaaaggcattaaagtttccatttttctgaaaaaatattaagtgcttatttttctaagccaatcaattagagctcttttatacataaacatacaacacatattaatacatagaagattccgcacgtgtaagatttttcattgccagtttcttaagtggattactggcttcagggtggagcccttggaggaaaagcgccaggaaagcatgcgtttctggggccaaataagcagctgaaggcaaagacagatccccaaaattaagggtgccattttatgctggttcctggatccccaaaaggagggaaatactacagaagacagtacagtgcttctactctgcatttcactgcaaggcaacccaaagccaatcagcccatttcgtcatcagcccatccttcatggaagtctcatctcccagtggggggtggggatgtttccttatcttccaggtggccaagagcatacttctccgatccaagtgtgcaaagagtcaagtgcccctccctaactactattagccatcccttaaagtatatttcctacctagttattacacaccaaagctctctcataatgcaaagtaatttctgatacccccaaaactcaaaactgtcagataacacaatgcaaaacagaacacagcctttgattttgagagggatccatgtgcttttaattcctggggtttcatgaggaaaagagggttttttccctaaacagggtctgtggcacttcctctgtttttcccaaggggtcttaggctaccagaagttatcttagggcctctcatgtgtgcattaagagtggaaagacagctgggcaccatggctcgggcctgtaatcccagcactttgagaggccgaggcgggcagatcacgaggtcaggagatcgaggccatcctggctaacacagtgaaatcccgtctctaccaaaaatacaaaaaaaattagccgggcatggtggcacacacctgtagtcccagctacttgggaggctgaggcaggagaatcgcttgaacccgggaggcagaggttgcggtgagccaagatcgcgccactgcactccagcctgggcaacagagcaagactctgtctcaaaaaaaaaaaaaaaaaagtggaaagccaaaaaacaaatggagaaaaataatttagtcgactgaaaagaaaaaacctttttccataaaaacaagttccaagaagagaaaaaaataaaggcctgttaaatatatctatagcttgtctatccatttttacgtaagctgacttttaaccatagtgctctttaaaaaaacaaatcctttcagatctcttattacctgactttagccttcccaaatgaccaatatttctagcttctgaactttatcaaaggtgctgagagaaaggaaaatttaagacagtccacggaggagaagagaatagacaagatcacacagatattaaaccacagaaatgacttacttcctagtggagaactgaaccaggactgccagtgtgaaagtgcaaaatgtcagctactgagctacatacagtaaggggtagtccccatttcctttcccagaacaagtctacagtagttaattttgagcttgcagaggcttttaactatttaatatgatttttagagctaactatgacatgaaccctaaaattcctgttccctggaaaggggagaccaaaagtactgccacgtggttacaaggtcaagctcccaaggacgtaaaacaaggtggagacttcatccagtatttgtgtttgtttcagagacctgcagccaaatttgttactgaccagcttgctggttattcttgaaaagcgggcttacaggtgttctaagcccgtgttttatcctgaagtacccctcaacacagaaaaacaaattcatagcacaaaatacaccagcttaagactagccttagaattcttttttgcattaatcaaaactttacagaggagataaacactgatttttttttttaaccattcagtcaaccgtttgcacagagagagagagaagcctgaaatctgactggtaagaaattcttactcttttgccggcatgccaggcttctgggttccctttccctgagcagccctagtgatccagcttgtggcaccatagccatgggggccaagctgcatcataaaggaaaattttttttttcgttctggccagagcaaagtccatgtgataaaaacagagacattagccactctgcttagcacccaatatcaaactggcaaggcttaaatttgtccccagatgggccccatcatctttaatccaaactccgacttaagagtttcaacacgtggtctctgggcaagatggtcaccctgagtaatagaaaagataggaaaggaaaagtagagaaggaaagtattgcctgtggcagggtggggaaggtgaacagcttagggaggccagagaaagacccacccattgcagcaacactgaaaagttcaggcggctgtttctcagtaccaaagagatcttttccagccagtctcatcagctctcatttccccttttagggaagaaaaacctccccatgtcctacgatcctgtacatgcctaatcctgccacccacagccatagcaaagagtgcaaggcagattaatccaaagagaatagcagttaacatccaatagtgacgagaggggactctaatcctcctaagttgggcctctaacccaaggtcagtcaagcatccttgccttttattaagaggggctccaacccactgtgtcttaggagagactctaactcccctaagttgggcctctaacccaatcccatcctttacccaggtaccccactacttacccaaagttgtccaatcagtgctgcatctatttcctttgggtcgggggtctcaatattgtcccttttgtggttcatgagaaagatgttactagaccccaccacttacccaaagttagcctttgggtcaggggtttctgcagtatagtcccttctatggtcgccagaaatatgttacaggaacgaggtcctgatccagaccccaagagagggttcctgtatctcgtgcaagaaagaagtcagggcgagtccacagtgcaaaatgaaagcaagtttattaagaaagtaaaggaataaaaggatggctgctccacagcctacaggagctctttaggcactagagatactatttcctggtcaattatattacaaatatttgcttccagtatgtgtcttttttattttgcatcttttgtcaatgttcaatttctttaaatttttattaaatgttttgtgacttaagaacatttctgctgggcacggtggctcacacctgtgatcccagcactttaggaggccgaggcaggcggatcacgaggtcaggagatcgagaccatcctggctaacacggtgaaaccccatctctactaaaaatacaaaaaattagccaggcgtggtggcgtacgcctgaagtcccagctactcgggaggctgaggcaggagaatggcatgaacccgggaggcagaggttgcagtgagcggagatcgcaccactgcactccagcctgggcgacagagcaagattccatctcaaaaaaaaaaaagaacatttctgacctaagaatataaaattaatctcttatctcctagatttttatgatttttaaaagaaatcaaaagctctttattccatctcaaatctgaggtagggatctactaccacatttttcaggcctaatacttccctgctgctttaaaatgctgtctttatatcatgtattaaatttccatatacgcatgtgttttaaaaaagtacttaagttaatatgcttgctacagaaatgtgttatacatataaacatgtatgtatgtatatgggggtatttttgccaaatagtggaacagaaattctaggtttttgttttattctctgatttgtttggctcatataccataaattggcagggattttattaattatgtgtgttctttccaacacagaaaaaaggcccccatagaagccttctttactcttaaatgcccatggagatcaaacctaatcctaggcttatcttaatggctaaatctccttggagaataaactaattctaggagcttcaggtggtgtgaattagactatgtgaatcatttcaaaataaaaattattttttaaagaaatccaatatatagatgtttttaggaaaagaaagcaaatcataaaacatgtatgggatgatcagtttatttaaaagcctgtgtgtatgtgactaaatgaacagcaaaaggtctggaagaacatagaacacattaataacactggggacctcttgaaaagcaagaattaaagaaggaaacgaaataaagggagacttctttttttgctccatataatttttcaaaataattgtatgtggagtcaaatttttcaaatccatgaataatatctgaaatatgaatttgcttttaaaacaatattcatctttatgctcttgtaaatgtgtatttattacctttataaatcagaaaaaataagaagaaatacataatagtagttgacattaaggacaagtttgacaatctctttttaagttctttttctcttcattttctttttcacttacacctatatgacaacaggacttctggttcaagatcactgcctgagtatacagacatatattccctccctttcaagacccagtgaaatgacaaaaagtaaagcatggaaaccacaccaatgaacaatatgggaccatcaagcaaaagagatcagaacaaaattcctgacaatagaaaacaaagggcgttaaatattgaagtagaatgtacactacaacctcagaaataccaggtacaaaaccaggattgaaaaaaaaacgtaggtggaaacagaaaccttaactgacagtctacatatccattgtttcattcaacaaaattgaacacccaggacataccagttcctgtcctatgatacaaacaataggcaaacccaaaataaagcagggggcacaaaattgtgagggtggcagtagaaatatcacttcagataagtcaggaaacatttctagggaaaaaaattgagaagagagacgcaaaaaaaaataagggagcaaggaaggagaacaagaatcatttcttaagcaatgataatgatgtaaactgtgctaagatatttaaaaatcatcgtattaaatcatcaccacacatagagttacctccaatttagagatttttttaaaaaatgaggctcaaagaagtcagaaattattcaaggttgtacagataactataataagtaataccaggttttaaatgcagctcaagctcttcaccaaattaataatactaattttatcttctgggaacctacacccatgctaacaaaagccaagtggggtacctagacttctaaacttgccaggctgtaataaagcaccctaaaactgccaccatagtagtatccaagaagcccaagtagggagatagggcctttactcctgtccagcaatatggtgacacctcttcccctcttccccttaggtggtatcagaggaggcctggtagagactgaggactttcaccatcactgagtagtaacaaggcaacccacactgtggtgtcaatggtgataacctgggaatcctggacttccatccctacccagcagtaacaaggtgctcttccttatccctcaggtatcagcaaaggcctcacaggaaattgggacttctatcaccacctggcaataaggagacagtgccccataactttcaactacaagacccaaagaaatccaccgaaaggcacatgataattgaatttctgaaaactgaagaaaaaaaatattgaaatcagccagaaaaaaaaatgacaacttatcaatgggggagggagggcacaaaacaattcaaatgacagcagatttgtcatcagaaatcatggcagccagaaagaagaagaaaaatattttcacgtgataaaagaaaagaagcatcagactagaaatgtgtatccagtaaaattgccctcaaagaatcaaggggaagtcaagacattctcagataaaagaaaactaagataatttgtcattggagatctaaaagaatgaagaatgactattggaggttctctaaacagaaaggaagcaataaaaaaagaaaccttggaacatacaaaggaagaaaaaacacaagaaacaaaattatgaataaataaaataggctttccttcttctcctgagtttcttaaattatgtttgacagttgttggaagtggttttaaatgtatgtagaggaaatatgtgaaactcttttatcataaatgagggacggtaaaggaatataaaaacaggtaagatttctctactccactcaaagtggtaaaaaaaatcagtaaactgtgatacatatgtatatataatataccaagagcaatgtatataaaaatacctaaagcaactactagaagaactatacaaagagagacactgaaaaacacagatgaatccaaatggaattctaaaaatgttcaagtaacccataggaaggcagataatgaaaacagaaatggagaacaaatacaaagacttaagtattaacatataaataattacattaaatgtaaatggtctaaatataccaattaaaagatagaaattggcacagcagattgatgagaaaccacgtcccaactatgccgttacaagtcatttacctcaaataataacatagataggttgtatgtaaaaggatataaaacatatgccatgtgaacattaatgaaaaaagcgtgttagctatattaacatcagataaagtaagctttggagaaaataaaattaccaaagacagagagggacattatataatgataaaagggccgacagaccaagaagtaatagcaattctaaatgtctacacaccaaacaatgtggctgcaatatataaagcaaaaacacagaaataaaaaaatacacaaatctataattatatttgtagactttcaaacactcctctttcaacaactgatagaaaaactagacagaaaatcatcaagtatacagaactcaacataaacaagatctaatcaacatttataggacactcccccactacaacagcagaatacacattctttccaagtacccacagaacatacatcaaatataccatacggtgggccctaaaacaaatgtcaacaaatttaaaggactgaaatcacatgaagagtttctggctacaatggaaaaaactagaaattaataacagaaagacagcaggaaaatctccaaacactttgaaactaaacaacacacttacagtcctgagaagcaaagaggaagtcataaggcaaataaaaaaaaaaaccacactgaactaaaatgaaaatataaaatatcaaaatttgtgggacacagctaaagcagttctgagaggaaaatttataatagcatattttaaaagtggcaaacggccaggtgcggtggctcacacctataatcccggcactttgtgaggccgaggcgggtggatcatgaggtcaggagatccagatcctggctaacatagtgaaaccctgtctctactaaaaatacaaaaaaaaaaaaaattagccaggcatggtgacgggtgcctgtagtcccagctactggggaggctgaggcaggagaatggtgtgaaccaggaggcggagctggcagtgagccgagactgcaccactgcactctagcctgggcgacagagtgagactctgtctcaaaaaaaaaaaaaagcgggggggggggggggggactctcaaatcagtaatctaatctgctaacaagaacctagaaaaaaagaagagttcaacagacccaaagcagaaaaaaaggaagcaacaaagagcagaaattgctgaaattgaaaacagaaaacaaatgagaaaattaatgtgatcaggagatggttctttgtagagatcagtaaaatcaacaaactgctaccaaaactgaaaaacaaggcaggaagacacaaattaacaataactgaaatgaggccaggtgtggtggctcacacctgtaatcccagcactttgggaggtcgaggcgggcggatcgcctgaagtcaggagtttgagaccagcctgaccaacatggagaaatcccctctactaaaaatacaaaaattagccaggagtggtgggcctgtaatcccagctactcaggaggctgaggcaagagaatcgcttaacccggcgggcagaggttgcagtgagccgagatcgcgccactgtactccagcctgggcaacaagagcaaaactccgtctcgaaaaaaagaaagaaaaacaataactgaaatgaaacaggagacatcaccacatagcctgcagacatctaacaaataataagagaatgttataaacaattctacacacataaacttgataatttaggtgaaatcaaccacttcctctaaaaaacaaatgcaacgcatccaatttgaaacagataatttgaattactttataactattaaggaaatcgaattcataattttaaaatttcaaaaattaaaaatctctgggcccactggccaggtgcagtggctcacgcctgtaatcctagtactttgtggggccaaggcgggtggatcacctgaggtcaggagttcaagaccagcctggtcaacatggcaaaatcctctctctactaaaactacaaagattagcccggcgtggtggcacacacctataatcccagctactcgggaggctgaggaaggagaatcgcttgaacccaggagttggaggttgtggtgacccgagatcgcaccactgcactccagcctgggcaacaagagcaaatctgtgtctcaaaaaaaaaaaaaaaattctgggcccagagtgtttcactgaaaattctaccaaatgtataaaaaagaatcagcaccattctatacaatctcttccaaaaaataagagagaacatttccccattcatttataaaggtattatagtattaaccctgatatccagagagtacctgagaaaaaaactacaggacaatattccttatcgatacacgaaaacaatccttaacaaactataaacaaaattcagcaatatataaaaagaattatataccatgaccaagtggcgcttattccagggataaaaagttcgttaaacattttttaaatcaagtaataaaatgcaccaccatatcaacaaactaaagaagaaaatcataaatcaattcattgaggaaaaaaaattgacaacatctaatacctattcatgataaaaaccctctgcaaactaggaataagaagtgccctcaaattgataaatggtatctacaaaaacctacagctaacagctatactactgctacttaatagtgaaaagactgaatgctatatctgtgtaatcagaaacaaggcaaggatatccacttctactactcataaacattgtgctagattcttctagtcactgcagtaagtcaagagaagaaaacaaaaggcacacaaatcagaaagaaaaaactccttatttatagacaatgtgattgtctacattcaaaattccaaggtatctaccaaaacaaactcttagaactaatgcgtgagttcagcaaggtaacaaatacaagataaatatacaaaaagcaaatgtggccgggcgcagtggctcacacctgtaatcccagcactttgggaggctgaggcaggtggatcacctgaggtcaggagttcaaggacagcctgaccaacatggagaaaccccgtctctattgaaaataaaaaaattagctggtggtggcacatgcctgtaatcccagctactcgggaggctgaggcaggagaattgcttggaccccggaggtggaggttgcagtgagccaagatcgtgccattgcactccagcctgggcaacaagaacaaaactccatcattcattcatagacagacagacagacagatagatagatagatagatagatagatagatagatagatagatttttttaaaagcaaatgtatttctatattataaatgtatttctaaacttatttctgtgttctatgtcttaaaacttgaaaatacaatataatttacaatcactccaaaaacataaaatattaagtgtaaatctaacaacatatgcatagaaaatattaaaaactatacaacgctgatgagcaaaataaaaaatctaaataaatgaagaacataccatgttcatagactggaaaactcaccaagaaaagatgttatttctccccaatctgatagctaaacaacaaaattcctatcaaattcctaggaagactttttttgtattcttttttgtgcaaacacaatttttaagagttttacttacagtagcttgattattctaagcttatttttctctttcttcctttttttaaccaaatacccagacttcaatattctaagcttatacagaaaggaaaagaaactagaagagctaaaacaatttgaaaaacaaaacagtacacataataactctacccaaaaagtaaatgggaaaaaaaaaaacctcagtctatgtctcacactgtgcaataaggattaattaactcagcaaaagtctgggtttcccacaccgtgcacgttccgagaaagatttggcccttgcccagctcctaggaagtaacctctaagcccttggaatgtccagcctagtaagaaagtctttctttacctgggggttttaggccactccatatagtctatgctaataatgtgattaatggtgggggccttggaccaaatggtatcagcttgagggctgcagacggaggtcatccatgagggcagtcaaccacacctacataccgacctaccaaaaaaccctggacaccagggctcagctgagcttacccagttttcaatattccacatgttctcatacatcactgctagaagaaacaaactgtgcacatgacttcgcagtgatagaacgactataaatttgggtctggtgtctcctggaccctgtcctttgcttctttttccatcactgatttaaatctgtatcctttagctgtaacaaaccatagccgtaagtataacaactttaagttctgtgattctttatgagaatcactgagtctaggagaagccttggggactcctaaacacacatatataaaaaattaactcaaaatggatcacaaatataataataaaatatttaagaaaaaaatgagaaaatatcttcaagatgtagaaccaggcaaagagttcttaaacttgacataaaaagcacaaaccataaagggaaaaaaccagtacagtgaatttcaaattttaaaacttgtgctctatgaggccagatgtggtgggtcatgcctgtaatcccaacacttagagaggcagaggctggaggatcacttgagcccaggagttcaagaccaacctggacaacataataggaccctgtccttacaaaaaacaaaaacaaaaacaaaagccaggaatggtggtacaagcctgtaaccaaagctacttgggaggctgaagcagaaggatcacttgagaccatgatagaaggatcacagtgagccatgatagcacaactgcacgccagcctgggtgacagagtgagactatcttcaaaacaatgaaaaaaaaaaaacagggagtatgggagggaacctgtgctctgtggccaggtatgacggtatgcaccactacactacagcctgggcaacactgcaggaccctgtctttaaaaaaaaaaaaaaaaaagtccaggtgcagtggctcatgcctgtaatcccagcactttgggaggctgaggcaggtggatcacaaggtcaggagttcgagaccagcctggccaacatggtgaaacgctgtctctagtaaaaatacaaaaattagccaggcgtggtggcgtgcacctgtaatcccagctactcaggaggctgaggcaggagaatcacttgaacccgggaggcggagcttgcagtgaaccatgatagtgccactgcactccagcctgggcaagagagcgagactctgtgtcaaaaaaaaaaaaaggctgaggtaggaggggatcacttgagcccaggagttcaagaccagcctgggcaatgtagcaagctccagtctctaaaaaataaaaataaaaaaaattttaaaaatagtaaaaccttgcgctttgcaggagatacaattaaaagtgagaggtgatgccagctgggcttcctgggtcgagtaggggcttggaaagctgtaaaactcactcatttcctgcatcagggattacttcggttctggataaataatattgaggtataatatatgcttaaaatattcctaacaccaggatttacttatatgttttcttccccaagaaagctataaacagcgagaattttaggtgtaagttttcctgtgtgccctcccccgaaaccagagttaaagaaaagattaactgcccatttttctgtgatcagtgggccttatctatcctcccaattccttgtaaacactgtttgtaagttctataagatcctgcttttttgctgtgcagctgcaaggccataaatcaggtaagcgtaagtcgcaatttcagtttttctcaaaatctaaagcatgtcacaaaataatttactgcctttgtttctcgctcctgtactggaacatacttcccgcctcacatatctcccgccttaaagagtttaaaaggcaatcacccgagctagcagtggcaacccattcgggaccccttccatgctgtggaagctttgtactttcgctctgctcaataaaacctacagctcattctctctcttggtccaagtatctgtcactcgccatggtcagccgccacaccaattctttggcgtggctaggcaaagaaccttgggtgttacatcttagtgagccagccaggagactccaggaagagcatcccaactgccacgcagtgagtaccctcggacctcttttgcttgctattctgtcccatccttccttagaattcggaggctaaacactgggcacctgtcagccagttaaaggcgattagcaagaccactggactaaaaacacgagtgtcagcctgggaaagggctctctgacaatccctgaccctttggagttgggagcactggtttgcccggaaccagttttaagtctttcactttctgtagtggtcccgaagtacacccgggagtgctcagcaaatgtcatggtctcccagatatccaggttgagaccatggccccaccagaggctcccacagcatgggttactaagcgtgagacagccacatcttctgactcctgcgtcctgggttcaaataactgccggttagatttctttcctcacctggtaagcaagattattcccactagacaggaccaagaatccctatttaggagacttaagtttttaaggtggtgttcagaagttccttgttgatggtgccctctggaatttaggcaggtgttgccatctgatggccactttgaaaggccagttccccaccatcgtgtatggtctcccacatcaggacaatttgaagacagatctgtaattttcatgtggatggtagaggccctaggacattttcttcattgttccccagatgaatttcctttttttggtgcctctcaagtataatctgtggtgtatgggtacggcccttagagcagttgaattgctttttcaaccattcaatcatggatattggaagaaagaaaatatagtcaattgagacacgggatactggtaccaccttaagatgggggcttactcctttgatggaaagtggggacaaaaggctagagtgcagcagttgttctctcagccctggcctagaggacatcaaccatcccctttgagcttactaagcctcctgtcactaattcagagattcctccttgaagggcagttttatggccaggcccacgtaaattgggccttgacatgcaagcatcagtggtgcccccgacccaggccttgccaccccagaacagataggacgcgttggcaaagggaccacaataaatccaacagtcctcatgccccatctagtggtcaatgggtgcacggcagagggcaaggatgatttccattctgccggtaagcgtggttaaatctggtaaatggaaggctcaaggacgatcatgcgctccgagcacaattggactggacccttgggggatgccctaaggggaagatgagtccctaagactaaccaggggtgcgggcatacctgtgtttaaaattccagttgggcaccacgccttcaaaactggacactcccttgagatgtatcctgaataactgggacaagttcgaccctgagaccttaaaaaagaagcgactgattgtcttctgtaccaatgcctggccacagtactccttacaaaatggagaaacttggccccctgagggaagtattaattataacaccattctacaactagatcttttctgtaaacgggaaggtaaatggagtgaaatcccttatgtacaggctttctttgcccttcgtgacaatactgctctatgccaagcctgcaagatttgcccaaatgacaaaaacccacaattgcctccatactcagggcctccttccttagccccactctcttccctcactgactctcctccatccagccccaccaaagtgttagaggcacaccgaaaagaaaacgtaaactccgcgaaccaggcgcccaaactaagtcccttacaagcagtaggaggagaatttaggcccacccatgtgcatgtctctttctcactctcagatttaaaacaaataaaggcagatacagggaaattctcggatgatcccaataactatatagatgtcttacaagggttaggacagtcctttgatctagcatggaggggcatcatgttgctccttgatcagaccttaagtcctactgaaaaggagggagctttagcggcagcccagcaatttagggatttatggtatctcagccaggtaaacagatcaaatggccccagaggagaaggaaaaattcccccacagggcaacaggaggtcaccgctgtagaccctcattgggatactgactcagatcatgaagattggagccgcaggcatttgctaacttgtatcttggaagggttaagaagaagtaggaagaagcctatgaactactcaatgctatccacaattacacagggaaaagaagaaaacccctcagcttttctagaaagggtatgggaggctctaagaaagtatacctccctaactccggattccctggaaggccaacttattctaaaggataaatttatcacccaatcagcggccaatattaggagaaaactccaaaagtctgccttaggcccagaacaaaatttggaggcattattaaacctggtgaccttggtgttctataaaatggaccgagaggaacaggccaaaagggaaaagcaagataagagaaagaccgcagccttggtcatggctctcagacaagcaaacattggaggttcagaaaggacaaaaaatggagcaggacaatcacctggtagggcttgtgatcactgtggtttgcaaagacactttaaaaaagattgtccaacaaaaaacaaactgcccccttgcccacgtccaatatgccaaggaaaccattggaaggcatgctgccccagatgatgaaggctctctgggccagaagcccccagccagatgattcagcaagaggactgagggtgcctggggcaagcgccagctcatatcaccctcacagagccccgggtaagctcaaccattaagaaccaggaaatcgatttcctcctggacaccagcacggtcttctcagtgttaatctcctgccctagacagttatcctcaagatccattaccatccaaggaatcctaggacagcctgtaaccaggtatttctcccacctcctcagctgcaactgggagaccttgctcttttcacgtctttcttatcatgcctgaaagtcccacacccttattaaggagggacatattatccaaagctggagctattaactacacgaatacgggggacaaattacccatttgttgtcccttacttgaggagggaatcgaccctgaagtctgggcaatggaaggacaattcggtagggcaaaaaatgcctgtccagttcaaattaggctaaaagaccccaccacttttccttatcaaaggcaatatcccctatggcctgaagctcataaaggaccagaggatattattaggcatttaaaagctcaaggcttagtgagaaaatgggacagtccctgcaacaccccaatcctacgagtacaaaaaccaaatggtcagtggagaccagtgcaagacctcagaatcatcaatgaggcagtaattcctttatatgctgctgtacccaacccctaagccccgctctctcagataccagaggaagcagaacggttcactgttctggacctcaaggatgccttctcctgcattccccagcacactgactcccagttcctctttgcctttgaggatcctacagaccacacatcccgactttcgtggatggtcctgccccaggggtttagggatagccctcatctgtttggtcaggcactggcccaagacctaggccaattctcaagtccaggcactctagtcctccaatacgcagatgacttactttgggctaccagtttggaagcctcacatcaacagactactctagatctcttgaattttctagctaatcgagggtacaaggtatttaagtcagaggcccagctctgccaacaacaaattaaatatctaggcttaaacctagccgaaagaactagggccctcagcaaagaacaaattgagcctatactggcttatcctcgccctaagacattgaaacagttgcagggattccttggaatcgccggcttttgccaactgtgaatccctggatacagtgagaaggccaagccactctatattctgataaaggagacccagagggcaaataactcatctagtagaatgggaatcagaggcggaaacagccttcaaaactttataacagaccctagtacatgctccagccctaagccttcccacgggacaaaatttatctttatatgtcacagagagaccaggaatagctcttggagttctaagtcagacccgtgggatagccctacaaccaggggcatacctaagtaaggaaactaatgtagtagcaaaaggctggcctcactgtttatgggtggttgcagcagcggccatcttagtatcagagactatcaaaataatacaaggaaaggatctcactgtctggactactcatgatgtaagtggcatattaaatgctaaaggaagtttgtggctctcagataaccacctactcaaataccaggcactaatccttgaaggatcagtgtttcaaatatgcacatgtgcagccctcaactctgccacttttctcccagaggatggggagccaattgagcataactgccaccaaattattgcccagacttatgccgcctgggaggatctcttagaagttcctttaactaaccctgaccttaacctgtatactgatagaagttcatttaggtacaaagggcaggctatgccatagttagcaatgcaacagtacttgagagtaagcctcttcccccagggaccagcacccagttagcagaactcgtggcacttacctgagccttagaactgggagaaggaaaaagaataaatgtgtatacagatagcagatatgcttatctagttctacatgcccatgctgcaatatggaaagagagggagtttataacctctcaggggacacccattaagtaccacaaggaaatcatgaaattactgcacgcagtgcagaaacccaagaaggcggcagtcttacactgccggggtcatcaaaaagatgaaggagaagcagcagaaggaaactgccgaggagatgctgaggccaaaactgctgctaagcaggacttccctttagaagtgcccatggaaggacccttagtatggagcaaccccctccaggaggttaagccccagtattccccaagcgaaacagaatggggactctcatgggggcatagttttctcccctcagggtggttagcgacagaagagggaaaggtgctcatacctgaagccagccagtggaaaatacttaagaccctccaacaaacctttcatacaggttttgaaagtacccgtaagatggccaaatccctatttacagggccaaaccttctccaaactatgcggcaggtagtcaaggcctgggagatgtgccaaagaaataatcccttggtccatcataaggcccctctgggggaacaaagaatagggcactatcctgtagaggactggcagttaaacttcacccacatgcctaagtcaagaggatttcaatacttgttggtctatgttgatacctttacaaagtgggtggaagccttcccctgcacaacagagaaggcccaagaagtagttaaaatcttacttcatgaaataattcctatattcggacttcccccaaagcttacagagcaacaatggtccagcttttaaagctacaataactcaaggaatttccaaggcactaggaatacaatatcaccttcactgtgcctggagaccacaatcctcagggaaagtcgaaaaggcaaatgaaacactaaagaggcatttgagaaagtatctcccatggccactctcttgcccatggccttgttaagaatccgaaattcccctggaaatttgatccaaaatcaaagggggctcagtccatatgaaatgctgtatggatggccttttctcacaaatgacctcctgctcaatcaggaaacggccaatttggtcaaagatataataacttctctagcaaagtatcaacaaaaccttaaaactttacccaaagggtatgacaggagaaaagggatagagctgttccaaccagaagatctagtagtggtcaagtccctcccctctaccttcccatctatggatcccttgtgggagggaccatactcagtaatcctctctatccccactgaggttaaggtggcaggagtggaatcctggattcaccacacccgagttaaaccttggacaccccttgaggaacttacaggactatcagctcaggagtctgaagatcagccagaccagccttgatacacctgtgacccacttgaggccctgcttctcctatttcggaaggaagcatcccaggctaaaaagactcctgcagttaatcctaaagaagaaaaactcatctctacctaatagaggataagcagaaagcctacatggatctttgacatctctccttgctctctttaatggagtccttatactgtttcatcatattaaacagtatactaaccataccctttgcagtaggattatatactgtagctcctgccaggacaaaaatcctgaccacatcaaccttttttctatcgtccttccttttaacaatttactccttcttccctcctcctttctactaccgctccacctacagagcaccatgactccctttataaggatctcctaagcttcttttaactctcctaagtattctttctgccacctcttcatccctccccaactgcacttgcttctctagtgcatactctcctccccttcccagaaacactgatgtagtctacttcgaaaggatattgtttaaaactaaatcagggtttactacccacacctatatgagaaaggaatgttatagtgctgcttctctctgctcccacaatggccatacatatcaccaaggacaaatgacccagtccaactgtcccgatgccctagggactacccaatgttggacatattacacccatgtgggtataactgatgagagaggtgtccaggataaagccaaaaacaacatgtccaacaagtaattaaaaacttgatccaaccatctaacactccaagtccatataagaaactagacctttccgggttacaaaagactcttgactctcattcccatctctagagtctatttaacaccacattcacaggaatgcaggaggcctctcctaacaatccaactaactactggatgtgtcttcccttgcgtttccaaccacatgtcccagtagtccctgtcccaggacattggaacctatccacctcagtcctaaacaccaccgggataattggctccccagtcaccaatctgccagccacacaggcctcaaatctcacatgtataaattttagcatgactcccaatagaaacatctcccaaagtcaatcctggataccagtgacctcaggtttcacctgtctaactccagacatctttttcatccgtgctaacatagcttattgatgtctaaagggcaccccaaaagagttatgctttctctcatttctagcacccccatgtccatttataccgaacaagagttggaaagtctccttataccccagtcccgccacgcccgagcgcctattctcccttttatggtaggagccagaatactgggtgggcttgggacaggaattggaggtataacctccttcacccaattctattataaaatatcacaagaattaaatgatgatatggaatgggttgccaattccctgatgaccctacaaagccagcttaattctctgactggggtggccctccaaaaacgaagggccctagacttactaacagctaaaagaagaagaacctgcctcttcttaggagaagaatgttgctactttgtcaaccagtcaggaattattgccgaaaaagtccaggagctaagggaatgaagagaacgtagaaagagtgaactccaactctcaggaccctggagtatatttaaccaatgagtaccttggcttctcccctttctaggccctgtaacagccatcttgctatcactcgccttcggtccctgtatttttaacctccttgtcaaatttatttcctctaggataaaggccatcaagctacaaatggccttacaaatggaacctcaaatgaatttaactcaagcttctaccgaggaccccaggatcagcccactggtctcttaactggcctagaaagttcccctctggaggacaatacaacagcagggccccatcgtcgcccctaaccagcaggaagtagctagagcagtcatcgcccagttcccaacagcagttggggtgtcctgtttagaggggggactgagaggtgatgccagctgagcttcctgggttgagtaggggcttggaaagctgtaaaactcactcatttcctgcatcaggacttacttcagttctggataaataatactgaggatatatgcttaaaatattcctaacaccaggatttgcttatatgttttcttcccaagaaagctataaacagcgagaattttagctgtaagttttcctgtatgccccactcctcccctgccaaaaccagagttaaagaaaagattaactgcccatttttctgtgatcagcggaccttatctatcctcccaattccttatgaacatagttcgttaagttctataagatcctctttttcttgctgtacagctccaaggccacaaaacgagtaagcataagtcgcaatttcagattttctcaaaatctaaggcatgtcacaaaataatttactgcctttgtttcttgctcctgtaacattcttcccgcctcacgtatctcccgccttaaagagtttaaaaggcaatcacccaagctagcagtggcaacccatttgggaccccttccacactgtagaagctttgtactttcactctgctcaataaaacctacagctcactctctctctcagtccaagtctctgtcactcgccgcagtcagcctccacaccaattctttggcgtggctaggcacagaaccttgggtgttacaaaaggataaaaagacaagatacagagtgcaagaaaatatttgcaaacaatgtatcaaacagagtagtatctaaaatatataaagaactctcaaactcaacagtaaagaagaaaacttctgggcacagtggctcatgcctgtaatcccagcagtttgagaggccaaggtgggtggatcacttgaggccaggagttcaagaacaacctggccaaaaggtgaaaccccatctctactaaaaatagaaaaattagccaggcatggtggtgggtgcctgtaatcccagctactcaggaggctgaggcaggagaatcacttgaacctgggaggcagaggttacagtgagacaaaatcccgccaccgcactcctgcctggacaacagagcaagactccatctcaaaaaaaaaaaaaaaaaaaaggaaacaatacaattaaaacacaggtaaaaggcatgaagagacatttcactgaagaaaaaagaaaacagacaagtgggaaaataagcatatgaaaaactggtcaacattacagtgattaagacctggttttcaggccagcatgtgagaagcctgaaagtcattatctaacaagtaaaaagctgaacaaagtgaaaaagcaacaactcttcttagatcccaaagagaactgaggtcacagtgcaaacagctgctcccaaaacagaagagagcaacatggcaaatgcatagaatacttattagagcttgaaacttgtgtgggacacagcacctaggtgggaaaacttgaattgtattaattgctggaggctgagtatgaagaagtctgagagttaaaaattccaaaacgaccccgtcatagggagactaccagacttttacgagttttacttccaggagtttgacctggttctcacagtaagtatcagagaaaaatcccctcatgactccagaaaagggaagataaaagggtccattttgaaatataccagaacattctattcttaataaggtctgccctcaggagaaactatttaaccagagcctaaactctttgtagttttaacagagcctaacttaccttggggaagagaaataaccaactccagtcaattctagtcttccgggtggttaaagggaaatacccaactaaagctccctgtagccatcctgtcccactcaagttagtaaaaacagaaaaaaactgagaagcatctgtgaagttacaacccaggggcaccggctcactaaaacactgaggccaaatcgtaggacacttcccctccccacacaccttaccaccacattactaaaggtctgctcaccagtttcttttacccagtatatcacgatcagctttcaaaaaataaaaataaaaagtacaaggcatactgtaagacaaaaaaaaaatagtttgaagaaatagagcaagcttcaggactagactcaaacacggcagggatattggaattactagaccaggaatttaaaacaactatgataaatagggtaaaggctttaattgaaaaagtagacatcttccaagaacagacggataatgtaagccgagggataaaaattccaagaatcaaaaagaaatgctacagatcaaaaatactctaatagaaatgaagaatgcctttgatgggatcattagtagactggacttggcacagaaatctctgagcttgaagatatgtcaacagaaactcttaaaactgaaaataaagagaaaaaggctggtaaaaatggaacataattatttaattaaaaaaaaaaggagaagaaggcagaggctgcagccagccaagatcacaccactacactctagcctgggcaacagagcaagactccatccaaaaaaacaaacaaacaaacaaacaaacaaacaaacaaaacacattatatccaagaattgtgggacaactacaaaaggtatgccttacacccttcacaaaatttaactcaaaatagatcacaaccctaaatgtaaaacacaaaactataaaactcccagaaaataacataatagaaaacctagatgacattggttatagcaatgattttttagataaaacggcacaatccgtgaaagcaacaactgataagcttaacttcattaaaatagaaagcatctgctctgcaaaagacaatgccaagagaataagacaagccacagaatgagagaaaatacagtaggccctccatatccgcaggttccacatctgcagactcaaccaaccgtggatcaaaaatattaacaataaaaataatcaaactttaaaaacaatatagtatggcaactatttacacagcacttacattgtattacgtattgtaaggaatctagagatgatttaaagtatacagaagtaagtgtgtagattatatgtaaatactacactattctatataaaggacttgagcatcctcagattttggtatcaggggtcctggaaccaagcctccacaataccaaaggatgtctttatttgcaaaagacatgttcgataaaggcctctcatccaaatatacaaagaactctaaactcaacaataagaaaactaacaacccaattaagaaatgggctttataaagacctttacagagacctcatcaaagatgatatacaggcagcaaacaagcatatgaaaaggtgttccacctcatacatcatcaggaaaatgcaaattaaaacaacaaaatactacacatttattagaaaggcaaaatccagaacactgacaacaccaaatgctaagtaggatgtggagcaacagaaccctcatgtattgctggaatgcaaaatggtacagcctctttggaagacagtttggtggtttttttacaaaactaaatatacaaaattaaatatatagaaaactaaatatactcttaccacatgatccagcaattgagctcctaagtatttaggcaagagagttgggaaccaaaataaaagtcctaacccttccaacagactactggaccctcctttagctaaaagaccccaaaattttaagttagcagccatggcaagacagtaagctgttcatgatccatttgcttccaacccacttctctcctttctaatcactggattttctcaaaagccagtgtgagaaaacaaaagtccaaaagaccccttcgttcaagtcatctaaacacaccccctcctgtttttatagtttcaacatgacaactattttaggccacaaagattttcttcttgataagtggcttttggaagggactggttctggccagtcacctgaggatgcagtttatggacttcttccctacatttcaccttttacatatagaacctaactacaatgcatttaaatattaaatctccacctcaaagtgattatgggaggtattttacatatgagtaaacctaaaacgcatgtgtgtgggtctccttcatgaatattcatggttccttctgtaacctgttgaatatagctgtatgcctagccaatcatcagcataagttcttatcttaaaccctcaccttactggaccccactctgcctggaaatgcctctcaatttctgctgagactatgcctcccagcctgtcagaatggcctatacaagctgcaaacctttgtgagaaatgaagctctcctttccaaatctatgaacctcatcattcttcagctgacagagttgaaagctgacatccacacaaaaacctacacacggctgtttacagcaactttcctcataattgccaaaacctggaaacaaccaagatgtccttcagtaggtgaatgttgataaactgtggtacatccagacaatgggatattactcagcactaaaagcaaatgagccatcaagccatgaaaagacatggagaaacttaaatgcatattactaagtgaataaagccaaacccacagaatatacaacaccaaaagtgaaccctaatgcaggggtccccaaaccccaggccacaaaccagcaccggtcagtggcctgttgggagcccagctgcacagcaggaggtgagtggctgcaggtgagtgagggcagctgagcaccacctcctgtcagatcaatggcagcattaaattctcatagaagcacaaacccactgcacatgcaagggatataggttgtgcgctccttatgagaatctaatgataaatataatgcaatgcacctgaatcatcccaaaaccaaccaccccactccaccctggtccgtggaaaaactatcttccaccaaaccagttcctggtgccaaaaaggttggggactgctaccctaatgcatgaacactgggtgataatagtgtgtccatgtagttttatcaattgtaacaaatatactacactagtaggagataatgacattggaggaggctgtgcatgtgtggggacaagagatatacaggaaatctctgtacctcccaatgaattttcctgctgctctaaaaaaactgctctaaaaaatacagtctattttttaaaatgagacatcactaccacaaggaaataccattatactatcaaaatggctaaatttttttacactaagtggtagcaaagataaaaagaaaactagatcacttatacatacattgctgatggaaatggtacagtcactctagaaaactgtgtggcagtttctttaaaatctaaatatgctactacacaatccagctactacactcctaggcatctactcacccaaagaaatgaagacataggttcacagaaaaacctatacccacatgtttatagcaactttactcataatagtcaaaaactgaaaacatcccaaatgtttttcaataggtaaatggttaaagtgtattctctccaataccaccattactgaatgctactcatcaataaaaaggaatggactgttgatacatgtaacaactggatgaaaatccagagaaaaaagccactttcaaattccagttatgattccatttataaagtattcttgaaaaacaaaactatagaaatggagagtaaatggcttccaagagttaagagataaaggagagggggcagagagagaagtgggtgtgggaaacatgaggtatgtggaaatgttctgaatctcagctctatcaatgtcaataccctggttacaacactattatttcttaaaactgtatataaatctataattatctcaaagtaagaagtttagttaaaaagatgaaggaaaaactcttatgactagagggacaattttctttttttgagatggagtctcgctctgtcccccaggctggagtgcagtggcacgatctcagctcactgcaagctccgcctcctgggttcacgccattctcgtgcctcagcctctcaagtagctgggactacaggcgcccgccaccacgtccagctaattttttgtatttttagtagagacgggatttcattgtattagacaagatggtctcgatctcctgacctcgtgatccgcccacctcagcctcccaaagtgctgggattataggcatgagccaccgcgcccggtcgattagagggacaattttatttgatatacagcaacactgaacattattaaatattcaaacactataattttcagtatgaaacaataaaacatatcccctgaaaattcttgtaccacaaccactcttcaaagattcatatataaacaataagaattttagctcaccttccacgctatcagaacaggaagttccaatgccagtgtctccactgtcagaagctatactgtgtctcctgatatggttatttcgatggttagatggaacagttgtggcctgccacaatgattcattagcaggtagccatgctgatgaataatctgggcctaaaaagggaaatatgtaacagttaacacatatatctgagtaggcagaagattttttttttaccttgtggaaaatacacatagggtataaaaggtataaaaggttcttttctgcccaaaataatttaaaatgatcaacaaaattaaccaaataaatgtatatatcacacatatatcaattaagtgtgattacatagcttcctctagctgaagaactctgttttctgcttccgggcattaaacttttaaagacgtactgctgtgttattaaaaatgttggaactatccacttatcttcaaatgtcagtactctgctctagaataattgataggtggcatctgtgattatacatacatgcgttagctgaaaatcagggctcaggaaaattcaataataatgcatgataatataaataggatatccacatggaatatgaaaacaatccatttttttctgctatatatctactaaattttttctacaatcatcacttaaaatttttaaattttacattattttatttgaattatttccttaattattatttaataacagtttaatagcacagcattttcctactcttagcttgatttgtctttttttttttttgagacgagtctcgctgtcacccaggctgggtggagtgcagtggcgcgatctctgctcactgtaagcgctgcctcccgggttcacgccattctcctgcctcagcctccggagcagctgagactacaggtgcccaccaccacaccccgctaatttttggcatttttagtagagatgaggtttcaccgtgttaaccaggatggtctccatctcctgacctcgtgatccacccgcctccgcctcccaaagtgctgggattgcaggtgtgagccaccgcgcccagctagatttgtccttttaatttaaatactttttagctaatttaaggtttttcaatgttctttcaatgtttatttccacttactcacttttacttaacttttatttgactttttctgttttacccatcacttattttattgtctagtacagtgctactcaaaggatatcaatggaccagtgccaatctgtactatttgttacaagttagatgcagaaataaataagcatctagaaatgttattgtactataattagaaagagaaattttaaattcgttcaactttacataaaacctgtagaagcacaaatctttactaatgcctaatacagtaagtctcaattcagggcttacagaattattcataaaagttaagaagttcccctacatgaattttaggctctcatttcaatgacagttcttaaaaaattaataagcacattacagattatctgaacagccaacttaaaacattatttccacataatttcaatgctcccgtatctgtatagcagccttaaaaagatttatcacataattcaatgtccccatctgtgttttgcggttgaaatagcagttgcttctaagtaaagagcaaatgacatcactgggtatttaccattatttgaaagaagatagctttacagaattattcattgataccctattgaaaccggcatgcaaggaatgccttctggcagtttaaacataagggtaacaaaacaacaaacgtgcataaaattaattataccagtttttttaaccacacttttaggattagttgttctctatgtcagtattaaaatcaaaatatataaacaaattaataaaaccagacctaaagctacctctatcatactaagctcaacattaatgattcacttttaataaaacattgtcacattattttatttaatgcatttatttatttaaatgcaatttatcaattaaatttaggctttatacatgtataaagtatataagcagccttaaaagccttatacatttaaattaacaaatcaaatttgaaaaacagtggccaaagagacacttttaccagctttgaggttcagaacaaccacttaaagctttgtagattctagacttctctcagaatgagacttttcaattcaagtgattcaacactcacattaaagcaccagaagaaggtgttctgtcaccagatctattctaattctgatctgtggtctgtaatctataccaaaattttttttcaatcaggtaacatcccatctaaatgagctcaaagtcctgcctaaactattatcaaaaatggcaaccagcctagtctcacaagtgcaaacctattagctggataattatttttttttaagaatacccagcaaatagcataaataggctgggactatatgtaaatgaaaaaataaatataagaaacgatgccaaatctcactaatggtgggagaagtgaaaaagacaataaattttctggatttttaaaactatcaagttgataaaagaaagactggtgtcaaccaagtgaggggaatgttcgtatatttttgtggccttgcaaattggtacaacctttctaaagggcaaactggaaagtggtatctaaatgtcaatatagacatgaccttctactgagaatttatcctaaggaaatatcagacaattacaaataaatatgagtataaggacattcctgacagcactgcttaaagtaaatgcctatgaacaaaatataaactgttaattagttgataatgtttaagtgctaaaaatgattttatcaacctattttttaacatggaagaacatccagaatatatctagtgtgtatggaagagaagcattttatgtagctatatacataatatgattccacagctggagaagagtttgtacatttacatacatggaagaagctttcagggagctctatatctaaatgctaacactgactatgttttactaaaggaagaaatacattacaggaacatttactccatcattggttattattattattcaatctaccagtttatgtggggaaatgctgaaaattatgcatactgatttgcagattacatcaacatttgattctgagattagaaaccagctatagctcaagatacgcaaattcagattcctagtaacaatttttacaaaagctgcataaaatggctagaattaaaacccttgcttttaggcaatataactattttgagcagtataaagtcatgctccattaaagcctacaacacacctccaccctattgattgttgacaagtcttggccaataaaccatttgtggattaaaaggcaataatcattctctctctcactctctctccactcactcactttctcactccagtaatggggaggaaagcccactgtacatattaatgctatggtgttattatcacaagctaggacaaccttcaatcattagtcttgtataattaactattgccagaaaaacagttcaataaaacctttttctgtcaagagccagattgtaaatattttcagttttgtgggtcactcaatctccgtctcaactagccaattctgccactgtagtctaaatcagctgtagacaataaaatggatgtggctatgttgtaataaaactttatttacaaaaacaggtgacaagtccaatgaaacctgggggccagtttgcagactcctgagatgtggtaaaaaatcattctaactgaaaagagtccctaaaattcaactgattcataagtaactacagccagcatattaattcatttctttatttggaagaaaagtgagctcatcctagagtacatatcagcaagccaggctgcccagaatctgacaattcatgaaagcactactgaggtttttcaaggattacaaagacaaataaatgtcaacaagtgttttaggtttctttttccagaataaatgatctcagtttatccatatggtatggaactcctggacaatgtcaaatatgtgtgatggttaattttacatgacaacttgactggaccatggggtgcccagatatgcagtcaaacattacttccgtgaaggtgtttggatgagctcaacattcagattggtcgactggataaggcagactgccctccataatgtgggtgggcttcactgaaccagctgaaggcctgaacacaacaaaaaagctaaccatcccctaagcagaagagaattcttcctgcctgatcccctttgattaaatacactagtacactggctttttcctaccttcaagcttgaactgatctcttcctggggcttgagcctgccagccttcagactggaactatgctatcaacaatcccaggtctccagcttgccaaatcacctcacagatcttgggacctgtcagccaccataatctcatgagccaattcttaattaattaattaaatgctattggctctgtttctctggagaacttcaatacaatattgggaaaactagaaaaattctaatcttgcctacagatatgaaaaagtggggacagccttctatttagaaaagaacaatagttgtaatcctcaatttccattacagtatttcaatatcatctactcaatatgatacctattccacagatttccaaagcacatcagtacaatctcaactatctgttatctaacttttatacaaaaaaagctataagaaatgacagagaaaatggtctaagacatgctatcattccgcccctctagaaaccctaaattctatctttgaatcacagagcagtacatacatacttagagcctttttatttagcaactcagggaaatgatcttcctaaaatttctttcagtgtactgccaccttataaacttgaacctctgacttttacagaaggacacaaaaagtaagcaaaccacataaatcatcaaattgttgtctaggccgggcaaggtggctcacacctgtaatcccagcactttgggaggccaacgctggcagacagcttgagttcaagagtttaagaccagcctggaaaacatggcaaaagcccatctctacaaaagaaaaaaaaaaaaaaattcaaaaaaatgcctctgtgcatggtggcacatgcctgtagtctcagctacctgggaagctaagctacttgaacccaggaggtggaggctgcagtaagccgagatcatgccactacactccagcctgggtaataaagcaagactgtctcaaaaaaaaaaaaaaaaaaaaaaagttgtctatatatttaagaagttaaaggcaaacactaaaaatatttgcagatatggtattaatgcataattataaagagatcataagcaaactaaaaataaataaataaatactaaatggtttagtctaaatggacaaaggacaaaccccaaagggaaaaacacaaataaaaaattctgaaaaatagtccaagcccactggtaagcaagtagtatcaaattcagaagacatgctatttttcagctatcaatctagcaaaaatgttaaaagaacaaaacaacagtgttcctagatactcccatacactgataatggtaatgttaatttattcattacaaaaacacaaccttttgataggctattaggcaatatacatcatgtgtagcacatgcctgtaataccagctactcaggaagccaaggtaagattgcttaagcccaggagttcgagaccagcctgggcaacatagtgagaccgtctcaaaaaaaaaaaaaggaaaagaattaactatataaattgatctcctcccacctgaactaatttgccttaacctttaaacataactatgtctttaaaaagaagatctggtattgtatgtgcctcaaacactgaagatgattaacaaatgtcatgaaaataacattctaatcttttaatttaaactgaaaaaattcacagtctgaaaagaatgacatgacttgtctttagacaagtcaatccagaagcacaatacaggaagaagtacatgtgaaatatgctgaccaggtgatttaataaggaaaattttctcacagaatagttacaagactatgttactgaaatgggaatattgatatctagtatgcaatatgcacttaaaaactcaaaataaggctgaataacctctggcaataatgtcttacctaaagacaaaaggactgctgtaagaacagcaaagatcccaagaaactctacattggaactcctccttggaagacaatatgttacatttttcaatactaattttttaatactaattttaattattttaatagaatactgagtgcctgcggataacattaaaaattctgaatatttctcagacaggaagattagcattaaataaaaaagcaacctattttacttctgaagctcttttattggaagcaaaaatgcatacagtatcaagtattccacagcatttgaatatatatgtaactgcactgagaacaagaactactctcattgaatattttaatgacagctctaaattgaagaaaataaaaataacactactgacaaagcagatttatacttttaaataagctgaatacataatacaaatcgagaatacaaattgcaatgtttttcagaatgcagattatctgtcacccattagtatgttttaaaatcaacttggaaaccaacactttcaaataaaatagtagataaagcatgtttacccttatattacataagtagcacgcggttcacattttaacatctctgaaatattaacaagtacttttgcacaaagaacctattctgctgctggaataactccactcaagccagcctctactctactatcttctagaatcaagcatgtttatgttattcttctacttacatagatctgtgagccccttacggcatattaaataaattcaaactccttaagttaggcaaagttcttcaccaattgtcagcttcactttgcaacttctacctacaaaaactatctagccacacttacctaatcacttcctccaaacagatgagactctttcatgactccaagctgtttcacttctgcaccttaagagtcctagttcagaattaacttgttctgtcttccctgattcctccaggtggcattaaatactttgttcactcccaatatattattcaaaattccaacaacatttaataaattatattaacccatatgtatatgactttcttctccctcaccaaactgtgaaaaatgaaaggcaactttttttagtgtccagtacctagcaaagagctgcacacttatacagggtctcaataaatgtagtcattataaccactggatacctaacaaatgttcacagaataaaattagaattttggaagccttacaattacaactacaaaaatatctttgtgttcagaaaaaggattcaaacaagcgttttgtttggtggttgttgtctgcttattttaaaatccaggatattttaaactatcccttgagccagtatgcatttaagtatctatttagagatcagtaaatatttatcaatgcagctttttttaaggtaattttaaataatttagagatctgatggccaacattcctaacatgggaaaacagtctccaataggttaaaaagacacaaaactcacacaaaaaattagaacattaaacggtaagaaaaaaacgttcatattaacagtagccaaacagaaaaaaccaacaaatctggaactacactgcagaatatctagctaagatgacagaaacatcacatagtgttattttctccatcccaatcctccactccatttcagtactatttatctctagggtaagtgactccaatagtcttagtttgtttcttttatcacagaattaccagtatagctcagtgtgcactgtgaaaccaggctacctgggttcaagttcattctacctcttattagcagtaagtcctcataaatcacttaacctctctgtgcctcaatttcttcatatgtaagagaagaaaaaaattatagaatagtacctatattatagggttgttgtgatcaatgaacatgtaaagttttttgttgttgttattgtttttgagacagagcctctctcagttgcccaggatggagtgcagtagtgcagtctcggctcactgcaacattcatcccccaggttcaagagattctcctgcctcagcctcccaagttgtgcggattacaggcacacaccaccatgtctggctaattttttaggttttttttaagtagagatggggtttcgccatgttggccaggctggtctcgaactcctgacctcaagtgatccgcctgctcagcctcccaaagtactgggattacaggcgtgagccactgcacctggcctgtaaatatatttttgaaagtgccagacatataattaggatctcaataaatgttattatttttattactgtccatgcatagaaattttccagaaggataactaaaaactattaaaaatggagtggaggactgacatgaaaggtagataaaaaagcttacttcactttaagcttttctgtactgagtcaacattttactgagcatgtgtaactttaataatgagaagaaaaaaatcatctgacaaataccacataacaataattcttctgctcctcatgaggtacagtaccccactctcttccaagtttttaaccttgctcttttccctccctatttaatcaaggacatctacactgtcaccagcttctctcttaatatcttactagcatgtttacaactacttatctccttcaaaacacaaacccaatgcccatctctctgataaccaccacttttttaacatcattccaagagattaagcataagctttctatctctatgatctgcaaagtgaatacatgcatgccagggagtacacgagccaatccactggcaagctgctggaagaaaaaaacttgtttatactgaaaattatctttaggaaaaagtaatgcattaaattttgctataatatttaacatacaggttaacactagtgcccttacttggattatcagagcattatgttacatatatataacataaacggaggtgctctatacagagggcttgacggtgacatcctcctttgttcatttgattttttcgtatgggtatgcattgcagttcatggctggttaagcagatttgcatatcgataacattaggtagttttacttaaactagccctcacaaaatggatttgtggctctatattactgcaaagaaacctgaagttgaaaaacctgaagataatactaaaaatgtaagtataaacaaacaagaaaatagtcaagctgatgcctcccatgcacacacttcaacattccttttgcaagagaaaaaaaaaaaattacaaaattagatctgacagtaatatgtcacctagcatttctgtttgaaaaaataaccattgatccccataagggtaaagatgatgctttcaaatgaaacgttcaatatgtagagggcatactggaaatcaacatgactcttgtatctgcatatgcgagttggaaaaaataatttttaaaatatatcaactgtatgtaccactaaaaaaaaggatgccaattaaatgacaccctgaattacatgatgcatccatatatcagaaatgctaaaacatttttaaagtacattttaaaattgataaagtataataaatattgcatacataaaataggagcatttgggtgaaatttttgctgttaggcatgtctaaaaaataaggagtccattggttctctatggtctcaaaacatttgctataccctaccctttttatgaaaggtttgtaaaatgtgtcaaaaaaataaaaataaacaacaggtagcaaaacggggaggtgaattgagaaactgtgctgctccaatcccaaaagagatccaaagatctgctcagacatgaaaagttaggttctagccagaagtaaaattctaggccagaagaaagtaagaatcaagaataaagtaagatcagattccaagattgggaattaaacttaagcagtcactgaagatgctttcactcagctaaaataaggttagcagcatcaagtaagtatactttctcacataaacacactagttaaaaaatacctacattaaaatctagctcaatctaagctaataggctttcttgggttgggcacggtggttcacatctgtaacaccagcactttgggaggctgagcagggtggatcacctaaggtcaggagttcgagaccagcctggccaacacggtgaaaccctgtctctactaaaaatatatatatataataaattagtccagcatggtggtgcacacctgtaatcccagctacttgggaggcggaggttgcagtgagccgagatcacaccactgcactccagcctgggtgacagagagactccgtctcaaaaacaaaaaaagctgtgttcaaaaaagcattttggcaactattaggaataacagccacgtatttagtttttggtaagtccttgttcctgtttaaaaactgggaaaataaggtacagttaacaactaatgaggctgttcataaaaccactacaaatatatacaacttggtatttcagacgggcttatctttgtcctagaacataagaatcatacacaatacatttaaatggctaaagaaaaataaagtcttaaaatattacaaaataattgagaaaatttataaatatatggaagttttctgttcccaaaattaaagcacttaacttctagtccaacttttcagtacattattcctaaaatgagacagaatgctcagtattaatgagaatgctttagaaaagcttcagaaatgtcatagcaaggccatatatatgtaatttcttatggtcaggaggcaatctctgcctctacaaaagcaatgtaatcaactggtagaaaatgctaaactacatgaaacatagtccaaatctttcatcccaaaatctttcagagaaatatataactaaaaactatagttcatttcagaactctaaactttaatactaaaaactattttcaaaacgagtatcaataaagcaaataagtttcattcactagacattaacagtgtagaaaggcatacaacagtttctgatcttacattaactctctttaaaggaacttaaaatcctatcaacgactttaattaatttagcactacctaatgaagtctttaaacaatttacagcaggagaaaaaaaacaaaagtaggggtagagttacttttctgaggtagattctcagatcagacagaggttaagaaaagcatgaaataaaactagatacagtactaaagtctggttccctgattgagagaatcttctattctgaggggcgagaacactgttaacaccagttcagacgccctgagcagacagagtaccctggtcaagacttggccactgttcagtgtaaggaatcccagaaaacccttcagtcctaggcaacctatgacacacaacccctagttttaaaactgaaacgtcaggcaaacccagacaactggtcaccctagcttaataagtggtaaagagcaattcaaacatttattaagcacttatgtatcaatccttatgcaataaagtcagctccactggattagataatctctaatttctgctaggtttatatttttaagtatctcactgaaactggccaaatgcattgatgcattttcttctgactcatcttacatggctgcctggaagcatgagactggtgatcactactgccttcagactcctctctaccagaacacttcattgtcctgcttttactcctaccaccctggctgctccttctcagtgtctttggacggcacatcttcctctgcctgaagagaaaatgttagtgtcccagggcttagtcctctactgtcttctctattctctcggtgtgatccatgacctttaaacaccatttataaccaagtaattctcaaattcctatctctcacccagcaacctccctactgagctccagcatttatacccaacttcatattcaacatctcacctgaatttctcaaaaggatctcaaatttcacatggccaaaaagaactcttgattccatttattttccttacactctctccccaccgccctctgcccactaaccttccccatctcaggaaatggcatcactatcgattataatcacagaagccaaaatcaagatgtcatttttgactcctctttcccttaattgacaactccaaaccatcagtaaatccttaagatttctcatgtatataccaaatccattttcttctctccaaatccaatctaaccattctaactcaagccatcatctctcacctaataactgcaatggcctattagctgtcttccctactgctgttcttgccccactcctctacaatttcttcttccacagaatagccaagactgattgtaaacacctaggacaaggaatatctgttccatgtccccaatacatgggaacagtatctgcctcatagtaggcactcaatgtgctcaggagtgaaagaatgaagtcactccccggcatcttctgacatgcagaatagaatccagactccctacaacccctaacattattatcaggccttcctcacctcacagtcctgctcactaagctccagactcactggagttcttcaaacttctcgaactcatttccgccttggagattttttgttccctccacctgaacacttctcccttcacgtctggcttcttctcatcattcaggtaacaatgttacctcctcagaggcctccctgaccagctactcaaggagctctgcccatcctctgccacctcaccaatcttcttttcctcttagtacttaacactagctgcatcatctcactatctgtttacttactgatcctcccctctaaaatgcaagccactaccaggcagcatggtggttcatgcctgtcatcccaatacttggaaggcccaggcaggagatcacttgagcctaaaagttcaagaccagcctgggtaacagtgagacctcatctctacagaaaatacaaaaattagccagcagtcagtgcacatgcctgtattcccagctgagcctgagaggctgaagtgagaggactgcttgatcctggcaggtcaaggctgcagagacctatgattgcacaaccgcactccagcctgactgacagagtgagacactgtctcaaaaacaaaacaaaacaaacaaacaaacaaaacctaaaaaatgtttttaaaagtaaaatacaagcctccgtagagcaagaaccttatctttcttgttcaatgatgtatccccagaggcttatacaatgtctagcacaccatatttattgaaagaataattcacaaacatttctaatgccaaggtaacaagcactatgctaggtaaccattttttttttaattaaagaaaaacagaaatcaaaatattggtatgaaaagtaatttggggccaggcgtggtggctcacgccttaatcccagcactttgggaggccgaggctggcagatcacgaggtcaggaattcaacaccagcctggccaatactgtgaaatcctgtctctactaaaaatacgaaaattagccaggcatggtggcacacgcccgtagtcccagctactcgggaggctgaggcagaagaatcacttgaacccatgaggcggaggttgcagtgagccgagattgcgccattgcactccagcctgggcaacagaacaagattctgtctaaaaaaaaagaaaagaaaagtaatttgatgttatttttatgttgatcatgcccatccttaaatgaccctatacaataaattgctcttcttagaatattactttgccagtgtaaaatatgaaaatcctgatagtaataataataatgaataacatgttattgcttaaaaattggctgggtgcagtggctcatgtctgtaatcccagcactctcggaggccaaggcaggcggatcacttgaggtcaggagttcaagaccaacctggtcaacatggtgaaaccccgactctacaaaaatacaaaacattagccaggtatggtggtttacgcctctaatcccagatactcgggaggctgaggtaggagaatcgcttgaaccccggagacggaggttgctgtgagccgagatcgcactccagcctgggtgacagaatgagactctgtctcaaaaaaaataaaaaatgatattgcttaaaaagtgtctgatgatcacgttcttcactttcttaatgcaaaatttatgtaattaggctataactcaggaaaatactatccagaagactttatgtcttcatcatcttttcagagtataaaaatacacatttcatccagtctgaaaaatcatgactctctcaaccctttctgttcacacacataaatattacaacatgacaatagaggttatcaactcaccatttattgcttggcctcagattaatttaccagcttcattcaagccaggaagtgatcaaattccaattattaatcaagttcatttcaccaaagtcatcactaaagttaagattcaccccttaccccccaatacctattatgaaagaacatgttcagttgggtttaggccagagttatgtttcattgttaccacagtattcctagaagtccatctaattcagaaccacagcagaaaacaatattattagttgtaaccataccagttattaccactatcattatgacatcactaaacaccttatggcaagcatcaattaagaggtaaatgtaaagctcaaagcaatgaacaaatgacattttttcagctcaagtgtttcctgtaacattttattttcgcacactataaaagtataatactctacctcaaaatgttttaagagttgaatatatgttttcgcttttgttttttaaagagacagagcctcactctgttgcccgggctggagtgcaacgacatgatctcagcccactgcaacctcagcctcccgggttcaggcaattctcctgccttcagcctcctgagtagctgggattacaggcgcacgccaccacgcccggctaatttttgtatttttagtagagactgggtttcaccgcgttggccaggctggtttgtaactcctgacctcaagtgatccgcccacctcggcctcccaaagtgctgggattataggcatgagccactgcgcctggcttatgttagtattttaaaaaaattatttacgaaaaggaacatacttagcacaactaggtattaggaagtactcaaagtatcactttatcatgcttgatttcaaaagcctacgggaaatatgtctatccttcatccaacttgaaaccagtatacattctgaacaatagggtaatctcaaatgcaatcaaccaaatgcataaaaagataccaattgttctattttaaattagccttctaaccacacttgccaatacaaaaaagagaggcttttatttgatatttgtaaggaaacttaagaaaacactcattttagctgggcgcggttactcatgcctgtaatcccagcactttgggaggctgaggccggtggatcacttgaggccaggagttcgcgaccagcatggccaacatggtgagaccttgtctctactaaaaatacaaaaattagctgggtgtggtggcacatgccggtaatcccagccatttgggagactgaggcacgagaaccgcttggaaccgggaggcggaagttgcagtgatccaagatcgcaccactgcactccaggctgggcaacagagggaaactctgtctcaaaaaataaataaataaatactcattttatttttggtttataacagttactccaaaaagctgaaaaatgggaaaagccaaattaaactgaatcctaaagcgaaggctaaaagttcagtatttttcaaactacacttattattcctattttttactgccatttctttaaaaaaaaatttcttctgatttttagaaagtggttctataagccgggcgcggtggctcacgcctgtaatcccagcactttgggaggccgaggcaggaggatcacgaggtcaggagatcgagaccaccctgggtaacacggtgaaaccccgtctctactaaaaatacaaaaaaataacccgggtgtggtggcgggagcctgtagtcccagctactcgggaggctgaggcaggagaatggcgtgaacctgggaggcggagcttgcagtgagccgagatcgcgccactacactccagcctgggcgacagagaaagactgtctcaaaaaaaaaaaaaaaaaaactaaagtggttctatagtacctttggcttttcctttagtctagttatatatttgtataaacaaataaaccagtttcaggacagcttgaattaatccacatattaagataaactcattttaataccagaaattatttacttatccctgccttcacactttgttttcagacaagtccaattttagggctggaataattgctcaaattattcaaaagatatactgaacaatatttcaaaaataaaaatttccttccaattatcaggaaaaaaggtccctacatgaatcaactcagaggtcattatcttgaccttcaccatctgctcacttgcacaagaagcaacacaagtttttcatctaaggtagaactttttaaaacttaaaattatctaagataattttaaatatttatatttgctcaaaaagggaagaaacacaataaataattacattactatttcagcatgtaactgaaaaaaaactttacaaaggcatgtcctgacttgtcaatagtttattactgacaaattgagataaaatacatactttggtacagctatactgtccaaatttcttcaattagggtagtaattacaaagtatcctcttccactattattctatgccatagcaaatgtctctctagaggctgcaacataacaaagtccttcgttacctaactttaaatactaaaatgttctcttcttcctagaaaacaatgaaaaatagacaccatgcctcagtgatatacctccaaacaagctgctattatcacgaataaattttaataggttagattgcaaagacattacagatggcttttgacattttcagataaactgaaaccactccctccagcccctagggataatgaagtagcttctcaatcactgaagttacttagatgacaggatttgtgaataatctgtaaactcgggaaacctctgaactgtctccttaggacaaataacatacaatttagaaaaaaaaaatccctacttaatactgctttttactaaattcatgcctacattaaatttcaggatcaaacttaagtgaatgattcaaatcattcattaacatacattaagtgtttcaggaccaaacttaagtgaatgattcaaatctaactctggctttttaaaatgtacatatgtctttttaaaaaccacacatcacaaatatctaaactatcaaagaattgcattattcgaaatttcaatagcctgatactagtgactcggtcagtgcctgattttttttaaatagcagaaaatattaccatcaaaagacccctttccaaatgctgcttctgcttttttgttttgtaaataacagctttggaaatgtatgcaaaaatatctctaagttacacaagtcgagctcaaacactttgtggagcaaggttacttaacaggagtcccagaaacagctaaaattgtagggaaaattttgcgtatgtatatatggcattgttttttctgcgcagaatgtccatataactcagtttctcaaaaggcctcaaaactcaagattaaaagtgcctggaaagaccatcatctttagagaacatatcacaggcaacccaagacttattttttatcccaagttaggggaggatttatcctaattttgtggctcctacacaacttctgagcgacgcaagcatgaaatggctgtccgatacaaacagaccccttcagatacggaatgcagcaaacccctaattttccttgaaggggccacggaaagccaaacggattcgtaacccggttgctcaatggtccattggctactgcaggacgcgccctcctcttacgccgcaggggctgcggggcggcgaccaggttcctccgaggggctgaagttcccttgggggtggctgagagcggccgcatctctggcagcatcctccctcccgaaaacgcgccctaaaagtagcggctgcgggcgtgggcacagccaaccccagcctgcgcctaccagaagtcgggagggcgcggaactgcggcccctccgagacgcgcccgggccgccgccgcagcactgtcgcagcgaccttcccgcccgggtccccgcgagcaaacgggcaagccccgttatcacgcaggtcacacaccccacgagtaaaaggaaaaaaccgggcagacaataaagcccaacccgcgggggcccaagcgagctggaagttgggggcgctggggctgcagcccaaggaggagcggcggggacgacgggatgcggggctgatgcgcctgggacgcggcaagccatatgtcagcccgggtgctgacagcggggaggacactgggcacgcggcggcgtcggggaggcggccggggtaagacaggcctgaggcgggaggggagcggcggcgaggtcccgaggcgccgcggtcggccgtgacccccaccccagccggggcgctgtcccgttccttaccggcagggaagctgcgggctccgccggggctatcccggccgctggcctccggagccaggaagcgcccccacatcgcgggcgagagggccgggtgggccagggacgcccgactcctcacgtccgtcctcctgcttcttcggcggcggaaacttgcgcggagcgtgggcctcggcgacacgggcaggaggaaaggcgggatggctggttaacggctgctcagctacgggcggggagcgcaggggccagattcgccgcactgccggcgcctgccatggccaagccggctgggctgaggcccgcgccggggaagcggcgactcggcggtgacggctgctagatccccggctgagcccaggctcaaaggctccaggcgaagttgcagctgcgggttctctccgccccctccgccggcagagccagagccggggctggggccgcgagggggcggggcctcgggcaatgacttcaggcgtgcgcggcgccgcgcggggcggggactgcggggggcggggactgcggggggcgggtgagctaccccgaccccgcttcgcctccttggcggcgactgggctgtcccgccctcccgccgcatccctctgtctccatcctcccgccctgcgagttgagtagagggcagcgacttggcctattttgcgatact

SEQ ID NO: 1674 - DNA, 249305 bp, Homo sapiens
atctttttataaaaaatttatttctctgtaaatacaaattccaacatcaacaaacaatagtccagtggaaaaatactagccattaacattgaaaacttttttcttaatttaataaatagaactttggcattcaaaattctagctgtaaaccctattaaaaaacagaacaacaagaagaaaacccctttacaaaaaaagaggcaagaatgatagatcagaaggcataagccaaccagtggcttcacattctttttttttttttttaaacaataactgtatttcaattaagtcatgaacactgtatttacacatgaggtattctgggtggttcaaaaactgaacccagcttacaaaaccaccagtcatagtgactgattatacactgtgctgtgctttttaatgtaaccacctagcaccttactacttcttgtcatcacaacaatgcgatgttaagttttatgtttatgtatttaactatttatacatatatgtacatatacatacacaccaatgaatacaatctaaaggagtttccagctcactacacagggaaggctgggctccaaagacatctatctgataattcccctcatgtttactaaggtatccacctagtaacaaaaaacggctccttgctttaaaaaaaaaaattccttaatcaagtttatatacagaagaacaaggtgcaataatcatcaacattcttagaactcatgtaaaatagaaataaatgcttactgcaggcaaaaaggcacaaaaggttctctctgtgtacagctgcaatagtgttattagacttgctgatttaaaactatattcttatatttagcacttttttaaataagaaaaaaaatccaaaatctttcccatacatgattaaatatatgatataatcatatggcaatatgccacccatggcattttggggcaaagttggaaattttgctctttataccaaataggaaattgttcctgttgttttgtgaacatgaattgtcaaaaatggaaacatggcagtttcaaatgatatagtctgagtgagcatggttatgaaaattgcttattaccataattacatatctacaatgatataattcctacgtaagagaatgccaataatccaaactaaaggtgtgcctaagctgaactatgctgtgaaaatatagtccatgttcttagctactatgttacttaatgaactattactgatatttaaagaacattttcccaattaagtagctcctttaaaaacatcctctaagaaattaataattcttgcactatgaaagaattactttataagctccttagtatatcagaaatgtatgacattcattttagcaacactttccagcccttgagattgtctctacaacaagctattgaaagaagtctaattaggtttaataaactgtcaccaccaaaataaatttcactaaaatataatactgttagcattaaatattgaatcctaggtgccacacttcttttaaaatgacctcaggaatatcttacctagccagtatttgtggttttttgtttttgtttaattagaggccactgaaaattaatagttcaaattaagccattttacttttctgagctcaagtgaaaagatagctattgtgcctttgattcagtgaattttatctgtacaggcaatttgggtctttcattgagtcaactgttactttatgcttgctgtaatgtgattgaggctgaataagctcaactttaaaacccaaaagaacaaaatattaatactggataagatactttctaagcaaacaagtgttggattcacaaaaagcacaattaaaacgaggtttcattatctaagtaaattttcaaatagattcactttaaaatttaggttaattttcatttcaggaatatattggtgtcataacttccacgaacatcctagttcaaactgggtgagatgctctagtgttgctatttgcccatcttatttggtctaacagtaaaatctgtttttaatgtgatacagaagaggatattctaatacaagagggtgtcctgggaaaggaaaattttctgaaaaataaaaatcaaaaagtaaatactgacaaactagatagaatactattagtttcaattcccccacaaaatccctccaagtctatctactgtttatgtaggcccctttacaaactccagattttaagaggatcaatctataattcagctaactacttaaactagcacatcttaactcccttttttatggggggagggtacagattttggaaactgaaatgcatcagcagtagttttgttaacttcctactaagtcagaaattttttaactttggaattttatttttaagatacgtgaattaaattactttctctaagttttagaaagctaacttacaaataaattattttatccccaactaagccaaaaaacaaaaacgtatctatagtagattaaaacaaactgtaacgtctgcttaaaaaaaaaaaaataaataaacccataaaatcccaaaacatacactaaaaatctaggagagatatttaagtaagaacctactggtccaattagtgattgtttgccaatttgttctattattttaggaagcctttatttctaaaatcatgggggagggtggttgggattctattcaaagagagtgtaaaaatatttgctgcacttgtggctgatctattttagacgttattatctgttttaccataaaggaccaaggcagaattcttcgcatcacatttttggtggaaatttactataccctgattatcgtcaagctactaatgttaaaaaccaagtgaatataattagaaagccaagttcttaccagtgactaagaccctccttaggttaaggactctgggatgcaggagcactacaatgtacttactgatttcttagtgcccagattctcagaagtaagaagagcaggaaggactcagacaccaaacagaaggaaaatctgatttctttacagtgtattataactgattattcaactataactataaaataatctattgagagctgtatagccaacattttaaactgtgtatcttcctgggtagtctccttgaaggccttgtctcacattttcacttttaaatatttaagaaaaatctttcctaggagagcctttattctagtatataagaaaacaggcatgtgctatgccctttatctggcaagaaaacaggcatgtgatatgctctttatcaaatcaatattatcctgcttgagtcacaccctctacccctccatctcttatttagtcttgacctaaatgagacttggttgcatcacaagatcaaaccaacttacaaaggacaaggctttcgccaaaactaagtatattcaaaagaacataatcaatgctgaaggcaataaaatgtataatccttccaaaataccaacagaaacatggacaacactcatttggaagtttaaatgactgtacgtctactgcaaaatcaactgcatttcatagtaataccctgtaattcagattaagaactaatttcgccaagttcatatcctgtgaaaaactgttgttaatgtactttaacaaaagggattaaaatacaatctcaattaaaaaatgtttatgctactgttgattcagatataaatagtattggctttctcttacagtagtttcaactttgaaacatacaaaactgttaaaatgtaaatgttgagatttggataagtaagctattgttccagggtaactttgttaatcttccttttataataatgatccaatgcctttattaattatatatggctttgtttacatttatatatgtatatatataaaacatataaataaaaaattgtaaatagtaaggaacatgttaaaattagttcaagttatgttaacctttcttgtaacacatacattacaatgctaaggaaaaagagcatcacgtcaaaatttcacacctcttgggaaatccacaatcactctggaaaaacagctgacctatctacagtactaaaatcagctcaaccacaaacatcctatcagtgcagtaagtgttcaaaatataaatggttttgcctcctgtactaccatgacaacacttgcctgctgtttgaactcttgttcagccagccactgaaaatcccaaagtacaacacaagcttctatatgaaagaaatataagaataaacagcgtgtgcctttctcagaagctctgctctgaccctagaaacccttataaatttgtgaataaagcacgtgcacacacacacaacaacacacatacatgcacacacaaacacacaaagctataggattaaaaggaatcctactccttcatgtgaagggtactcttcacagcttggtcctacaatcagtagtttgagaatatagacatttttttccttgtagattttatcatattttccaaaggtaatttgattttttttctttttgcctgattagataagccccttcaaaatctcttcacttcccttctccccttcaacaaaacaaatccacagaaaaaaaatccctaagtgcaagtcatgtcacttgcaaccttccattatggctccataacacagcagcatttaaacaacaggtcattattgctgtgggactaacacttgatcactgagtaatgcagttgtctcccatgtcctgagcatagcggtctgatattgtagtccttaattcatcaatgtctcttcgtaactggcacacatctgacagctttttagtgagtgtttctgtgctgtggtcattctcagtctcttcagctgaacagttcattgctgtgtaaataaaacatagagagaatatctcacatttttttgaacaaagacattttagaatttttcaccttaatcatcatggaaatacagtgctacacactgaataccagtgaggctcaggttcaagttatgtttaaatcatgcatcattcaatattaaacagatcttatccacttggtcctttataaatttcacaaattaaactgaattaaatgcacacagtgatacacacaaattcagcatgtttaatgggtaacaatattccaaaagtgaaaaaaagcatactctaatgtctctcttcaagctcaactagagcactcagtttttcccatttggcaaaatctgaagaccatttgtgtagtaagaggtggtatcttacatatttacgactgcaaagtgggtttactgccatgaaaatattaattttcaaatacatagtaagtgtcacacacacacacagagggagagcggggagggaaaatgagagagacagagagggagaggaagagggagaggaagagtgaaagctgggaccctacaatcccaaacaatttaatcaggctgatagctggttgcctaatggctgaataactgagggccttgagtcagccagcttttagttatttacttcagttcttctctttgtaagcatatctcaacataaaatcaggcagagccagtgattacaaaagaaacctctccttataccttcatagtagtttattgtaggcataagagtcagtgagtgactgttattttaacaaatgttaactgaacatctgccatgatataggaactatgttagatgttgaagtcagaaaaggaacagacacagtggcttgttctcgatgctttacatacaatttcataaacaaatgaacacagtgaggtactgtgggtaacctaccactatatacaagttgcagtggcataaaaaaacaaacaactagtcctaactggagaggtaacagttgcttgttcactgggttggccaaactgcaaaatgaacaaaagtggagtcagaaagcaaaacagtatgatagaatttgagaaacctcaagaaaatcagtatctagctctaaaatggtagagtacaaactgtgacaaaggagagtaccaagaaataaggctatagaggtaggtagtagctacctatcttgaccacagagcagtgtaggcattaggaaaccaggttcatagtttagacagatctgtctggcaacaatgtaaaatggattagggggaggggatgagaaagatggttgtcagagagaccagtataggtgacgggttatgaaaacttaaattaaggcaatagtgcaatggagatagaagggcaggaatgttagatgtagtaagcagatgacagaactgatagcactcaatcatcatcaacttgagtgatgggcagggattgggcacaggcgccagatgaaggaaaaagcagagtggagaataaattctgggttcaagtgacaggtgaatggtggtgttactcactgagaagaggaaccggttcagggagggaaggaaagtgtgttctggttttgaatgtgtagagtctgtgatgcatttgaaatagccagttctaatatacatgggaatataatctggagcccagaggagataaatgtctgggtaaaggagataaatgtctaggtgaaaggtatggcagtaacagaaaaaacaggagtggataagatcactcagataaagtactgaataaaaagaaacaaacacaaaaccagtaacaaaaggcttctggggataccaataattaagtggcagagaagtccacagaagacagagactgagcagtcataaaggcagaagcagaacctagagaatgatgtcatggaaaccaaggtagtgcacagttttcagaaggacagggtgagtaaatggagccatgaagtgactggtttttcacaaatcaactggctggtaaaactttcacaatgccaaatataaggtaaggattctggggtcaaactttaaagactagaaggagtattgggaggtgggcgtggtaagattcacattaggatagctctactactctattactgaaaaacttaacaaatgctaccttatgacagtgaaaatgtaggagactctaaagtaattaaaagggtgaccaactctaaaatcatgaagaaagtgagttccctttgtgtgtgagctttgcttcttgctcccaagagatattaaagcactccatgttcaccaggcaaacttctcctcttcctcgtctgagagcgacactgaacaccaactactctgtggagtctccacagcccttcccacgtagatttagttgtttttttcctcttgtgctcccactgtcctttgtccacatctcaactatagcacctatcagaatgctctaataatttggttaatgtgtggacaaggactgtgttcaggttatctgcattaccagcacttacttagtgtctggaccatagaaggcatctgataaatgtttactccgtgagtgaatatacttaaacattatgtgttttttcgatatccacatttgtgtatgtgtacaaatgtctatgaaatgaaagggacatagttgagcacagataatgtttcatttaacaagtgatatactttggtcaagagcattatttgatttgccaaaataactattatgatgcaaaatggtggaatctttttgatgaaactagaaacaaaatcagtttgtttgaaacaaaaccagtattattaaccataatattaggcagctactaaatacacgttggcccataaaccttattatatggtcttactgcattcctatttccttccaagttcatttcttctctattataaagagactaacatcctgatttggaaccacgtacagagatgagcgtttctgcaaaagtagcacagaaagaaagggacactaggattattactgtggcagctcccacaattatgtgtggaggaagacagaattgaggccaagagtgaatgggtgtcacattaagccagcaggtacgcatgacaaaggcaacagatttgtaggctgtgaaaactggctcatgtgaaatcactggcactcacgtgaagcagctgccatagaacatatactgcactggaaagcaaaaatatttctcaaatattttaccagtggacaatatggttgggtcacttaatctatacaactaacacatgaaagcaaatagaaggaatcattatttttggaagagaaaatgggaagtcacacctaactaccactctattcacatatttacagattcaacataggaaacatcaccaggcattctaccaagtggcagttaatgtcagctataaccctactcacttcttgcaatgaagtaataacaggtatacataaacccacagactgattctaagtaggaaaagagattacaaaaataaacagagaaaaggcagtcggaagttcctgattcatgaagataggtttctaattgccacaaaataaggacaagtcatcagacacttacatcttattcccagtaataatgaaagattaggctccttgccctgagcacgctgattaagaatactacacaatgctttcaagtcaaacaaacaacaggacatttccttgaacagctgatcaatcacagtcaaatcaaatagtggccgtttggaaagaactgtctgctgcctagattggtcaggttcctggccctgatccaataaagagcatgtctcatctgtttgtctttggttctgcaaggataaagaaaacaaacatcagattgttagaacagaggaaaggtactcaaagccatacaggttaacattctcccccaagtctataaacaaaacgatggagtcatattatatgcacattaaccaaattcaactacatatatgcagtgggaaaaaaaacacatagaaaaataacaatttaaatagtggaaattgtttctctgtgccatctgatgctttagcgtatatccaagggaggaaacataaatccagtctcagtttctaggagtctctcacgtaataagcatgttggttgtgtatgtatttttcttttttgggcctcaatctgtcacccaggctggagtacagtggcgcaatcatgactcactactgcagccttgacctcctcgggctctggtgatcctcccacctcagcctcctgaatatctgggaccacaggtaaacaccatgatgcctggctaatttttgcattttttgtagagagagggttttgtcacattgcctaagctggtctcaaactcctggggtgaagtgatctgcccacctcaggttcccaaaacaaagtattaggattacaggtgtgagccaccatacccagcctgtatttttctataatgagatttattccaaggataaaaagaactaaaaagtaactttgaacctcactctgtggtttttattgttagtagcaatagtggtttaattactttgaaactactttttgcatattggtggggggaagcatctatgttaatgttgataggaaccacaaacttcggtgcgagagacaaagaaataacaagtataaaatcaaagaagaagaaaaaaagaaaaaaccaacaactctgaattgctgatccccaaaactgctaccttcttatcttgaaaactgctaattaaaggtaactttaattagctttccaattggaactgtatttcagaataactcaatagcctggggtgattggaaaaaaacttttttatagatgaatgccagctaataaatataataaatatatactgtactataattatgtgaaactgtattctaaaacacaaaataaataaaggtttgtctttttataataattttggtaagaaacaatggaattaattaacaggcatatcaaaatcatgtctttaatctgaaaatgctctattaatatctataaaataagcattttatagtgaatcatcctttcaaagcaaaattgaatttcttctactcacttcaagcaatgcttttgttaatctctgtacatttctttctttcttttccagctcttccatcatcttttgagtggtcagtttctctttagaaagctttccttgcatagactagaatttttaaaaaaattggaaagcaaaacaggttaacatgtaaagaaaaatctcaaacagaaagaagtaggaatgttggctctgaatactttaaatcttctttcctccccatccccttggaagatgaagccttcacttttaaactaatccctatcagttagagagtggctgaatccaaataaaaaagaaaaagaaatgctggtttcccagaatacatttggatttttttaaattacagtttttaccaaggaagtttttaatttgtataaaacatgtcaaatctgaagttcctacttaatatggtattacaaacagttcttatttcattaactttttatatgtagagagtgtattagcaacaaatctatatttttgttttacattttgcttacagttaatgagatgcaagataataagatcatgatatcatccctattttctatcatttgaaacatagctcccgtctttcattgtatagtaatccaagcagtgaatatactgtgaactctgggtcaaaggtctattatgggaatttgataagctaatctccttcttactccttataaaattgcaaattacctagacatgacactattgtgagtacgccaaagcagcataaaggacattttgagtctttggttagtcttttcaccaatatattaaaagaaaaaattgccatacaccctgtagttattagtgaattctaagtgtttctatcaactattttccttttattagaccacaaaatcaataaacatatgaccagaagagaggttatcattttatttcaggtctgtatttagtctcaattctgacaatacttcagtttgctgaccacctaaatagcacacaatctactataaagatattttcctcacattatctttggatggagtaaaaaaagatagctatcaccatgggttgaaataagactccataaatataaagcagttttatcagtaacagatactcaaacttgttgcttttaaatttcatttgtctgctaaactctgaaaaaaatattacatttagtaactcagaagttggacagaaatgaatcaaactctataacaagtgtttctccttctagggaaaagttgttttatattccacaaaaatgaaaaaaaaaaaagcaccaagtcaacaaggggctctctgaatacgtgtattattgaaaactgaaatttcctttgtaacttcattagattgactcaaatcttatttgattaaatgaacatggagagttatttacctagctgaagatctatcctttctggcctaacaagattatttggctggaatccagaattcaacctaaattttctcaagatttgtgacggtttattagaattacagaagaagggcatcatagacacactactcaaactcacattctaacaaaaaaaaaactaaactcgaggggtgttttcacaatataattattatatataacagaataattataataatgatacattgtaacagaatacagtcctttaaaagataagagttttatatttttaccaattcagagtcatgttgaatgtgactaataattagctaataaatccaactaatatgtccctatgtaagactgattttaatcagtgcagaaacaggcaatcttctccatcagaaaaactgaaaatgtctggcagtattgccatttatcacaaaaaggaaaatcagatttctcatatgttgcttgagttgaagggcagttatcaagaagcactttaataggtaaaagacattgcagataggcttatcctgaaaggaccaagtgctgtacaaattggtctaggataatactaggtatgagtgctatagttgtctgacagtaacatttcacctaaaacattaattacttctctatcctaaattgtattaagatatgtttaaaagataacaagaaaaattctatcaagaatactgtgcgttattttataaatactttttgcagagcatttttttgaaatctcttaagctcttaaaatatacttgctcaaactggtagtactttacaatgcataaatgaaatatctcatattttctgaaacgagtgtttggccttgtgaattttacaataactatttatcattcactagacatgtaggggattaataaaattaaaaattaatttgcaaacacctacaacagctctcaaattctcagtttaatcatgacatttaaaaattctgccaaggtactaacctacaaggtctttataatgatcatgtttgaagttgaacagtggaaataagcacatttgttgttttaacgtaagtatccagaaatgccccatttacaaatagcttgaatgagggaaaaccaggtgtgccttagtccagattctatataatccccaaacccaatttaaaaggaactattttgaaagaaaatttatgttaacatttttactgcatatatacacacataaacatgcataccatataagaaattcacagggacattccttcatgcaaaaatcattgccaaacactgttctgttcattgagtgatacatcagtgaacaaacagtcaaaactcttggcctttgtggaactttactaggagaaaaaagaccaaaagaaataaaataaatatgcaagttacacagtatcatgtattagaatttgactagtgctgtggagaacagagcacagtaagggtcaggagactgaaatctcaggtaagcaagggcctgaaggaagtgagagattgtgtcccagagatatccagagttcctatcagtacaaaggttctgggacagatggtgtcttctgtgtttgagaaaaagcaagagagccaggatggctgagaatagtaggagaaagagtcagagaaggaagacagcatgcagaacagattgtatagggcctcagaaatcagtataagaactttgatttttattctggaaaaaaaaaatgaggatccactgaagagttctgagcagagacatgatgtaatctgatttttgttcaaaaggatcacttaacctaatgagagtatactgtgcacaggcaagggtagaagcatgaagaaataacccagatgagaaagggagacagcttggaacagggtggcaatggaggaggcaaggagaagaggtcagattctagacatactttcaaggtagtagaatttgctgtcaaatgtgaggtaagtgaggagtcaaggataaatctaggatacctggactgaacaaatggaagggcagagatgccattaataggaaatctgaaatgtatagcagggtgtttattttggtggtggggagataagaaataaaaaaaagagccttttttaatgtttctaagaatctaagacaatgtacagctcgaattcctttcttaaattagttatcatcttgtaacttgataaaactttaaaaacaatctgcctggagttttgcttctagcatgacagtgtgaggagctccacagacctaccactcaatgaaattggtgaatattataattaaaaatttctggaaatggtcctaagagcatatagcaaatgaagaaacattactcaaggaaatctactaaaactcagtaagaagagtaagagactggtatttgaaataaaactctgcttcacgaaaggattctagagtagaaaaatgaaacaaaactcaactccatctctgacttctcacatctcattgggatggaaattctacttcagactgacagagccaataacacacggctccctctcctcccagaccctagttagacagttctctttccagaaaagatagggcatcaacatttatcatcctagcaaaggctgttttaggcaagtgcaaccaagagatggggggctcccttcttctacctcaatccccttatgggatggaagcttacattgagtgcagaaatcctgacccttgccccagcttgtggggcactggttctacgctgggagaggcaagtcaaaaagatgtagggctgctgccagaactccctccagtgagcgttcagctactagagtgggggtaccattcagaaatttgtcattgtccccacaccaattaacctggcttaagagattttgcctgaggaaaagtaggccatagaactagaagctccaaatgtctctctataggaattcacttcatttgcaacagtgtgatgacaaagccttagagcactcaaaaacattggagattgtcatgaaaggcagttgacaggatactattagacccattggccctataggctaaatccatagactactttcccagggaaaaacagtgagatagctgggaagaatactcctgaggtcagaacaaatctcaaacactaagctaatgaactgtcccttcaaaagagctagaatggatcagtttgtgaagcaatttatgccacagggcattgttgaaaacaactgaatgattggctacaattagtggagcctaacagctggatatggtcaagagtcacagaagaccatatatacatttgtatgaaatgtttaaaataggtatatttatagagatagcaggtagatcagtggttgcttatggctggggaagtggatgggggcttagggaagtgacaaaaatgaggcttctattcgagatgataaaaatgttctaaaattgactatggtcttggttccacttatctgtgaatatattaaaaagtattgaattgcacacttcaaaaaaggtgggtgaattgtaggtgacatttttttttttttttttttttttttgagacgagtctcgctctgtcccccaggctggaggacagtggcacaatcttggctcactgcaagctccacctcctgggttcatgccattctcctgcctcagcctcctgagtagctgggactataggcgcccgccaccacgcctggctaattttttgtatttttagtagagatggaagtttcactgtgttagccaggatggtctcgatctcctaacctcatgatccgcctgcctcggcctcccaaagtgctgggatgacaggtgtgagccaccacgcccggtgacttatatcttaataaaactgttaatgcttgagttctttggcttctaacttctggaaaaaatgtattttctggtttataagtatatctaccaaaatatgttaaatgtgtttgatgacacctaagtatctcagaaactaaacttgttttttaaatttaaacctcagtctttctctccagttcccactctttggtccactgagcgtgctgaggattgtaatgcttcctaaatgctctagttttactgccagactatatggcaaagttagggactgcctgaggaacttaataatacataattcgaaattcatcccagagatactgattcattaggttcacaatagggcccagaaatatatatcttaaaaagtattacaaataatgtgagtatccatatagatttggtgactattcgcagcgctaacaggcccaagaacattctttcatgattcaagtgagctgtcttcactcgtacaactcccccccgcgacataactgatttttcaagttaaatccaccttttacacattttttgacatatcttaattatgcaactataacatgcatacaacagatctacgtgaacagtaaagactgttctctttacaagtaccaagactacagtgtgtgcgtttttttttttttaaagctacttttcatagaaggcatttggctggtacatttttcaaaatttagtattaacttctgataagaatacttttagtttttcaccatcataagcaattttacagaagtaaatgttttcaaaattaaacttgagaaaaagaactttatttcaagacataacacaattcggataacaaaaaataggagataaacatcacacaataataatgggaaaacattaaagcaattgatatttaaaggagttatgttctacctataagatattccattgacttatgatccattttcccactatttctactgaggaaaactgctagatgaaggatttatgagatttgctaaaaattggaatagaattttcttaggctgtgggaacatctcgatgtgttataaatagaacagactgtgtcacagttttgagactggtggttccaaccacggccaagtaaacagtcttaatgtcctctaacgtattattctatcttttgtgatattatgatcatctattgatggctgtcaattcagaaaggccatttaaatgcctaagttcttgcaattagtaaacattttaatgtcagagaaaacaagcacacattacaaaactctatgtcctctgccaaaagactacaatgataacagctcactgaaaaaggcttacggatttgaaatgcacttttgagaaataagaaggaaagtaatgcccaatgaagaactcaatcacattctgactgcagccatatgttcatggaattgacaagcaacattctaccgcaaaatgtctttatatactgtataatgacagaagaaaaaacctataggagaagcagccaggctagctatactagttttatggatataaataagggcgacatttctaaaaggtcaatgagtaaacaaggtattcatgccagttaacaatatgaccttgacagctgaaaaaaacagtagataaatctgtatttttacagcactcaactcaatttccaaattagcatatacttttacatgaagtattactttttctatattcaacaacaaatatagtataactagtagaggaatgatttctctccaacttcgaaagctgtgaataaataaacatgccagtgacctataacagataagtatttatttgacttttgtggcaaaaaaataaactatagctgtattttgaacacagcatctaagtatgaaacaatgccctattttttatctcctataaattggacataaaatgtacatagcctgggatttttttttcccttttgggagtaaatttaaactgtatgaataacttgcttgttcccaaggaaatgcagtgcaccaaatcaagacaagtgaacttcaaacaaatttggtgttctcaacagtttgcaaggacataaagaggcagtaacacatgaaattctaatagtaccaagttatctttgtctactgaatactctagaatggaaaaaccaagcactgtggaggaagaaagaatatcccaactatagcgtcagtgagattttacataaaattaatactatagtgatagtcaaaatgcataatttatattaaaaataattgggaggttctctggtatccttaattatatagtgttttgtgttattttggataggcaaaggtatttgaagaaattcaaaaacagagctatagcatatggaaaggacatcataatctacataggtataagctgaccattctttacgtaagttgatgaggaaaaatcaggcagctttaaggaagtagaaagtgaagggaattgctgtattaggtatatcagcttgataatacacccattaattatgtccattaaccacaatagaaagccacaagaatattttttcaacccaaagtgttcttttcagtgtgtccaatgctagggaaataatcagtgctcctcttttaataacaagcaatattttcagatttttatagatatgccttttagaaaaaggtcaccaaaaatgaccaaatacaaacaaaatttgtctttttaaatgatgaggggccaaaaaataacatgagtttaaaactagtaaataattttctcattatgtgagtcatattcatctccagctttgctattcaaataccatcttcacaaatatagctattttagccagttatcaacatttattgtctgtctctgtgacctgtatctatagatctctgtgtctctagatctgaaaaccttgatggtcagaatgggcaaatgagatgctaagaacaaaaaagaaaagaaaaccaaaaaagatagccattgtttcaaaagacaacagaattaataattatagtgtctaggcccaaatatttggaaataaatgcatctcattaattttacttcaattctctacatagtttgaataaaagatttgtgtttgctgaaacaatttagtaacaaagaacagtatggcccataattgcatattcttctacatattcatttatgtatggtcatgacatatttacatgtgactacagacttggttaacatataagagtaaattgcagtaagatgcctccacaaatgggggaaaatgcacatttcaatgaatgctaatatatactgaacacctataatgtgacagtatgtgataaatgaaatcttacaagtcattaaagtttcaatgccaaagttcaagtgtcgattattcttaatttagattgagataacttgtattagatttacttcttggaaaacgtgcccaagtgaaatggaaattccttgaattatggtccagcataagtcacataacaatagctgaggaaatctaacaatctagaggttctaatggcttatggaacagctgaagttatgtttgtaggaatataaaataaagtttataacctctgtcaatcaatccatcaggctcatacatttattgataaataatacaaccaaaagacaaagaaagaagactgtatataatggcaaatcatttaccacttttactttgattttaagaagtaacagtaaaattaggggtataaagctaaacatttttcagcaaaagatgaccaatgacttcccatcacactacctcacatttcctgcactccaggctaacagactttgtgctgttcttagagcatgccaggtacataaagggcacttgttgctccctttgcttggaatgctcttcccctggatgtcttcgttcagatccctgttcaaatatcacctcttcaggaaaaacatcatgaccactctattaaatgtagcactctctagcctacttaattttttaaaataacatgtttaacagcaatttttttcatagcacctggtattcattatattggttttgtattctctccaactcaccccactagagtggccagggatgtgacttgttcactgatgaatctttacaattttttaggattaatttatcaaacagcaaaaactggaagattaatattaaagaatttgcaactttacctcagtgctataaatattatctttccatacgatatatgcatgctttaatattttcagattaaataagcattaagagtatatcagaatatagctaaattaaaataagcacaaaatattccttacctgaatttctaaaatcattctgtcaatctcatcttgttggctgtctattatctaaaacaaaataaatacatctgattcaaataatttttacatcgcttcttaaaagtaccaacatttcaagaaaacagcacagaaatttataaatttattttttaaaagggtctttttaaaaaactgaaagtatccttatgatttgggtcacacacgtataaaactacaaaagtcttcctctagttctcaataaaagttttctcaaatttataaaatttttaagagtaactttgagacagactgaataattaaggaaggaaaaagatatccttttgttttggcttttatttcaattatttaattttgtttcaattgctatggtcctttcaaataaaaacattcaaactagaaactatgtaagtgattaaatattaacaaaatataaatcacataaaatagctataaattatgtatctatacacacatatccacatagcatagatttcacgtttatgatctaaggtatctactgaccttactagcagtctcattttgttgtctgagattatcattttcattctgaagctgttttgcatctaacatgggaaggcggattccatcttcaaggcatctttctactttttgttgcaaactatttcaaaagacaattatatgaagaaaataagctctatttgctgattttggtaatgatttcaacataaatgattattgctttattaaaaaatattatagaccctaaaaatgacatcaagacccacagacagtatatgaaaaactgttatctatagttcataacaagtaagaagggtccatagttagctagaggctgatcatcttttcagaaatggcaaatttgagaccagagtccagagttgctcagtatgtgacatccttaggctccgatgaagtccttcattacccaaatctgagctctgaagtctaactcatgttctttccttttcctctaaaagcagggttccttgattaagatgatcattgcagggaacctaagaatatggatccacatcttttgttctttattctaagctcagcaaaagtttgcttgtaagaatagctgttgcctaaatcagtagagttgcatttctctttcatttcttttctttttttttttaacttttattttaggtttgggggtacacgtacttacaactgtattaattgagacccacgaggcaagagaagtaagtaaatctggaagatacatggcaaaactgctgtaccttttacttgcagtaaagttagaaataggagccaatcacttcaatttgatatattccattaaggagtgcagtttgagtattttactggcccctttttcgttatttagaatttttacttttttttttttataaagccattaggtaaagggtttgtattaatattttcagtcttcatttgtatgagtttttatttttactattttcaacagaaacttttggcaagatatcaatatattgcttcaaaatgttaaattataactgagataacctgtttcaatgaaattatgcttctagttcttaatacaggttgaacatccctaatccaaaaacctgaaatctgaaatgtgtcaaaatccaaaactttttgagcatggacatgatgctcaaaggagatgcccatggcagcatttcagattttggattgtcagaattagaaatgctcagtgggtaaatacttggcaaatattccaaaagctgaaaaaaatcttaaatctaaaacatccctggtcacaggcagtttggataagggatgagcatcctgtagtacatctttaaattaaggagaataaaataaaaattataaattaatttaagtaaaatgttttatgaaaaatacgaataaaataatgtagaaggattcagaaaattttcttacctctgaacggtagttactaactccttttctttctttttctggcatattaactgtgtctctttatcttgacactgctttttgatctcttcaagttttttttctgtatctatcaaagcctcttgtaaattcttatttttttcttccagaatctgcagctaaggagaaatgttttacagttcattacacatgaaatattaaatacgcttctattagaaactgttactgtgttggcaaggattaacagacttgtagctaaaaaaaaaaaaaaaaaagaatcacactgtattttatctagagtatttaattctccatctcttcctctgtgtgaaaggcacctagaagaacagaattacaaggaagagaatggggttagaaatttgtagaagaccgagaaaggttaatattctcattttaaatttattttacttttattgtaataaatatataactctatactgtcttaacaatttccaagtgtatgacaggttgaggttaagtacattcacattgttgtgcaactaatctccagaactcttcatcttgcataattgaaactctatatcaattaaacaactccccatctatctctccctccatttcctggtaaccaactttctactttctatctctgtgattgaattcttaaggtatctcattaagtggaatcatacagtatttgcctttttgtgactagcttatttcacttcacaaaatgtcctccaggttaatccatacgatagcatgtgtcagaatttctctccttgttaaggcgaacaggattccactgtatgtatataccacctttagtttatccatttatctggtcatggacacttgggctacttccaccttttggctattgtgaataatcacattataaacatgggtgtacaaacatctgttcaagacccttaactgccaccccagtggatgttaggtattttctgacatattttctaatacccattgccctctgttcctgctcatgcaacctcctgcagtccttaatttcctgcctgactttaatctctcttagtttttacaacttataaattaatgtaaaataaacagagaatgcaacataggtcttaaagtatgcagagtgacacttcatagattagattcttgagtgggggtaactttacccccagaagacatttggaaatatctgtttacattttgggtttgggataaacgagaaggagcactgctattggcacttagtgagtagagggcagatatgtggatgcagaagtacacccttcaaagatcaaggcacacccctgtaacaaaaaattatctgcctccaaatgtcaatagtgccgaggtcaagaatccctggcttagaacaactttgggaagagactgaagagtagatctagtggatttataaataaggtttcaagagagtggccctcacctcagttaggagaaagactctgaggtattgttaaggaaaaaaaaataaataaaagaaaaagtcagaggagttaattgaagtcataggtcaaggtataagaaaaatatatatatataaaggttaagaagaatgaagaaaatatctagaaagatagtcaacaaaaggtcttgtcgagccttggtgaatcctagagactgtgttggaaagcaccagaactgggggtgtgtgcatgcatgtgtatggggtagaggttggcagactggtttagaaactaacttctacagtagttaagagagttacaatacaggatcaataggaaggtaatcacttattaactgacaagaaagatctacttatgcatgcttagataaacaaagtttcttattagaattaagtccccaaaacagcaattaaacacatagatttaacttatagttagccaaatttctagagtcaagttaacatgttttcatgtcatttaaagataagcattttatttcatgttacctgtagactctgactctgtacatcatctagagttggaagatcagccagatacttttccaaggtctcaattcttctctgcttttctttgttttgttcagattccttctggcatttctttttcagactactgatgtatcgatctctagttttaagctaaaagcaaacaattatgaaccttcagtagttttcagtcattaaaagatataacaaaaccaacactttaatattagacaccattgaattcaccaacagtttcaggttatagcgaaggccactagcaactcaattaagatttaccttatttcattctaagatttacacttgccgggtgtggtggctcatgcctgtaatcccagcactttgggagactgagatgggctgatcatctgaggtcaggagcttgagaccagcctggccaatatggcaaaaccctgtctctactaaaaaaatacccaaaaaaattagctgggcgtggtggcacgtgcctgtagtcccagctacttgaaaggctgaggtatgagaatcgcttgaactggggtggctgaggttgcagtgagccgagattgtgccactgcactcctgcctgggtgatagagcgagactttgtctcaatttaaacaaacaaacaaaaaaagatttacacttaaaaaaatttatgtcactgaaatcaacagtttagggaatatttgcttttaccatggacggcatcctataaattgtcatcaaccagggggcagtaatgacatagtttttattgcctgcacatgtgcaaatttggtcaaggctgttcatatctttgtgatttcaatattgtcatatacatgtagaaactatgtgttgagtttaaatgatgtctaaaatgcctaaacaatgttaccttacaatttagtatggaacaatgttattgggtgcccagacaggcacagaaaaaaagcctttgaaatcagtgaagtattcatctctgaaggaatgactccgatttcttagtttttgcataactatacccaaatgctttatgggaactaagagaggaagatactacaagtaactaaaactattttgttacgttaacagacttgcagagaaattgcttatagtgtactaaacaatgcaactaaagctggaagaatacaccaaatacttaggggcagataatggactagtgaaaccaattcatacctcaagcaacactagtttaaggcactgtgtcataattgaatttgcagcttattttctttctaaaaaccacaaaataaaggtgtcttactattgatgtcattttaggattgataaagtatggtaaccgaacacttatgtcacacatggtgtgtacacacatgataatgattctagtaaatcccaatttatataggctgaaagtcagattttcatgtactttttaccccctactacatgaaatatatcatctataaatttcatatctcatagtcaaagctctttcatatttactcctatttaccttaaattaacaatcttccaaccatttaatcctcttcaaaacttacagggttctaaaatatttttacagtgttttcccatattcactgggaaaataactggcaataattagcagtaagatggattattctttcaaactttattaaagctaacacttgttcacagtctagtttctttcatgtattttctaatttttttcaggtctaatgtataacaatttttaaaacttcatgtggaaaaattattcatttcaccagtgacattaggatctacttatgacctctggtaaggagcaacactggtaagacaaacacatcctattatttattggggctttcttaggattaaaggtaaatgtgctggtgtgacagtttaccctgtgatctatcagaatagaaaaccttacatactgttggcactggtggtgaccatataatacaattccctttttacagatgaggcccaaagatctttagtgacttaacaagtcacaaaatcagaagtggaatttgaatctagatcatctgactgaaaatcaactttctttcagttctttgttatgactcattatcaggttcttattttagtaaccagctgtgcttggtccccatcaaccaagcctgctcttgccttagcaaatgaccctgtacattacagaggtaaacatgataaaccaacctatgtttacttaatgctctctaacttggactcaactgtctaaatgtcttcaatgtgacaaaatgatgcctcaaaaagcaatgactggaataggtctgtctgtgtgcaaagatgtcctacttttcttctttttcttttggttgtccaactctctttgctgtcatgtcaagcttgcttcccttgatcacaaattgctgccaacactctcctacgagacactgtctctgttatttgttggtcacatgttgatcatacatattcattgggtcttgggtttttttcagcctgctcacagatgacaagctctttgttttgttttttggtgtttcatttttttttaaaactgccaagttttgtgctgtcccatacaaacagaggttactgaagtctgaactgcattaattacctccagataaatgaggtgtcactaataaatcttctctattctattaatacaaggctaagtttttcttttcaaagaggtatgacgcaatactgatatcattcctagaaggtaataggaaggacatgttttataagaagttcacaaagttacttttctttattatctggcttttataagaaagaactcaaaggtaacattattattaccacattgttttttctgtcatagaatcagtctttgataaggattacagagtaaatgccaaaagaaacaatatgatccaatcttgtgtggacccaaagtgctgtttgttgatttgttatcaaggagcctgctcttcctaatctatgcactcccttgaagaactcaagtcatctccatgtgctctgacacaaactctgccctctacatctatcccctctcctcaaatttctctggtatgtacatttccattcttaattgcctcactcccacagaagctactcctcttcttttcggagagtaactctaccatatttgcatctgttaccaacccttcccgaacttgctccattatgcacccactctaacatctttgatctctctctctctcattgttttttccctagtctaccttactgctttctctcccatcctggcaaaaattacctgaaagaattcattcaacatgccaggcaccatgaatggtgctacatacgccacagagacacattcaaatacaatccccctgccttcaaggagcttagagagaaatataaaaaataatgattatacaaattgggttgagccctggaaaaaaagaataaaatgctataagcatatgaaaggaggagtagaagggaaaaatattaagctagatttgagcaaataaataggtgacttgaaagtgggagaaaaaaatagccaagtatttaccatgcaaaaaggccactctgtgtaaagatcctgataccagaaacaaagcctgagctgtctgagcaactgtaacacccagtgtatcaatacacagtttatcagaggaagattggcagaacctatggatatataattaggcaatgtgtctcaggccatgggaagaatttgatttatattttaaagacctggagagtagtgtcagcaagatggcagaaaagcaagtcttgaactctccttccccaaaccaacatgtgggttcaattaaaaaaatagtaaaacccccaacatggacaaattccctttttaagaaatccaaaaattagtcaagaagctattgtactctgggtgaatgcaaaatcagccacatggaagcaattaaggaaatgtaggacacctgtaatcctacccccaatacagcatatgatcagaaggaacctgttgggaaagaaaatagttggatcacacatccaacaccccaacttttctgggtgctgttcagaagactggcttctgccttgcctgtcttggaacactaataggaccatgacactcttgctgcctgggaccagtgagatcagaccggtgagatcagagatgatggtttaggctagcagtttccacagtccacagctccagctcagcactccagcaatgagtgaagaaactccagattcaagtttctccctgtgcagagaaagcaatggacagaacacccaacaatctgacttttcagaagtctggccaagggactggctgaaattctgcttgtctgagtactgataggacctagaatactcctgaagcctgaaggatgctaagaacaaaaaaaaaaattagttaaactagtacaaagatatgaaaagcccccctctctcgccagactgattagtgagggtcttctcctgtataaggctagtctctgaggagtggaagtgatagctattttatataatatacaagtatcaacttaaagagggaggaaaaattaacacacagggaaatatgtccaaaacaaacaaaataaatctcctgaaaccaaatctaataaaaccaagatacatgatttgcctgaaagagaattcaacatacccaacataaagatgctcaatgaggtcaggtaaacaatgcatgaacaaagtaaaatttcaacagagataggaaatactttaccaaacaaatcttggaactaaaaaatataataactgaaataaaaattcactagagagggtcaaaagcactctagatcaagcagaagaagaaataaacaaactcaaacacaggtatttggaaattatcaagtcagagtaacaaaaagaacaaggaataaaaaagtaaagaaagcttgagaaacttaaaaaacaccattaagcggacaaatatacacattgtaggagtcccaaaaaaggaagggggagaaagggaaagaaagcttattcaaagaaataatgactaaaaacttcccaaatatgtgtgtgtgggagggagaggcaggaggcatggggaatggacatccagatccaggggacccaatggaacccaaataagatgaccccaaagaaatatgtacaaagacacagttaaatcaaattgtcaaagtcaaaaagagaattctgaaagcatcacaagaaaaatgacctgtcacatgcaagagaactccaataagactatgagcagatttctcagaagaaattttgcagagaaagtgggatgataaacttgcactgcttgggcaatggggaatgggggtaattgtcaacccagaataatgtaagaagaagtgttcttcaaaaatgaatgggagtggctgggtgtagtggctcactcctgtaatcccagcactttggggggccaaggtgggtggatcacctcaggtcaggagtttgagaccagcctggccaacatggtgaaacctcgtctctactaaaaatacaaaattagctgggcatggtggcacgtgcctgtaatcccagctactcgggaggctgaagcaagagaatcacttgaacccaggaggcaaaagttgcagtgagccaagatcacaccattgcactccagcctgagtttgcaaaaagtgcaaagctctgtctcaaaaaaaaaaaaaaaaaatgagagataaagattttcccacacaaacaaaagctgtgatattatagttgattacctacccttgtactataaaaaatgtcaagaggaattcttcaagttgaaataaagggatgctaaacagtaatacaaaagcataagaaagtacagttgtcccttggtatatgaaagggattggctccaggacacctcatgtataaccaaatccacacatgctcaattcctgcatagaagacatacaaatagtgaacaggtatatgaaaagatgctcaacatcactaatcatcaggaaaatgcaaatcaaaaccatctcgtgcctgttaggctggccatcttttttcttgaaaaaagaaaataacaaatgatggcaaggatgtggagaaaggggaacccttgaacacttggtggaaatgtagaatgatacagctgctatgggaatctgtatggaggttcctcaaataactaaaaataaaacatgatcaagcaatcctacttctggatatttatccaaaagaattgaaatcaggatctctgagcaacatttgtactcccatgttcctagcagtattcacaataacccaagatgtggaaacaatctaaatatccagcaacaggtgaatgagcaacataaatgttatatacacacacacacacatatatacacatgcacacacacacatacgtgtgtgtatatatatacacacacacacgcacacacacacacaaaatggaatattattcaaactttgaaaagagaaatcccatcatttgtgacaagatggatggctctgggggatataatgctaagtgaaacaagccagtcacaaaaaggcaaatactacataattccacttatatgagataaatgaaacagagagtagactggtggttgtcagggactggggagcagggaagtgggagttactcttcgatgcatacaaagtttcaattacataaatgaataagtgctagagatctgctgtacaatatgcctatagttctgaattatacactcaaaaatttgttaaaagggtacatcttgtattaaatgttctttctacaacgaaaagagaaaatataatgggatggcataaattagttttaaccaaagaagtaaaatgactggatcctttgttgttaaaagttaagtcctttgcgctatcaagaatggatttgggaggatgtggagaaactggaattcccaacactagtagtgggagtattaaatggtacaatcacttgggtagtttcttgtaagttaaatatcgactgtacaaaccctatgatccagcaattcaactaccaggtatttatccaagataaatgaagacacacatagacaaaaaatcttgtacaagaacgttcacagcagccttattcataatttctccaaaatgctaaaaatccaaatatctatcaacaggagaatagatacactgtagtatatctttataatgaaaaacactactcagcaatagatagaaactgatacatgtagctataaaaataaatctcaaagacattgaataaaagaatatataccatgtaatttcattaatatgaagtccatgaaaagtcaaaattatactgataataatcaaaaagcacacacacaccacattttctttatcgattctttgcttaatgggcattcaggctggttccatatttttgcaattgcaaattgtgctgctataaacaagcatgtgcaagtgttttttatgtaatgacgtctattcctctggacagacacctagtagtgggactgctggatcaaatggtagctctacttttagttgtttaaggagtctccacgctgttctccacgctgttttccatagttgttgtactcgtttacattctcaccaatagtgtaaaatcattcccttctatttcataccaacatctatacacacacacacacacacacacacacacacacacacacacacatatgcatgcatatctagtgttcctgtctgtgtatttggtttttagcttcttattctgaatcaggggcttcagtttaataacttaagttgcatcattattaaagataggccagcttcatttaccaaccctttatgcccaacatgacaaaaaaaatgaaatcatagactcaataaggaaaaggagaacagttatttggtgtaggcaattaattttttaaagattttactatttgttagaaagatatacaagagcatttctatcctcaaagaaaatccttggatttctgcagacagcagagggcttctcaaaagttactacaaaattaatcacctccacataaatgtatacataacctggcatgacacctgacagggtaaatgacagacaaataattatatgctgaggaaatgttgttgacctaattcaactttattagaaaaacctactttttcctctagtttcttcttctcttcactaaataggcttagtctttgtttgagaaactcattaagctgtaaaacttctttctcagtagatgcaagcttttgctcaaattccccttgttgggaatgggaaactgattcctctgaaaatggtgtctggagtgaagtgttctcatattgtggctgttaggaaagaaaaaaaggaggtaagactttaaaagtttgtcttgaacaaatgtgaagaaattggaaatgaagtataatataaggagtacatataggctacatgaacagacacaccttgatttaaattccagctatcttgcttcctagttatgtaccataattaaagtaaattacttaccttctcaaaaccctggttttctcatctctaaaacagaaacaataaagcctactttgcagtgttttttgaagaaagataaagtatgtaaggtttccagcatataggagaaacttcatgaaagacagctattatttgattttaaaagtatacttcaacatgtaaatagtacagtatatacattaatcatataaaagtgaaagttctaagtaaataaataaaaactaaagaaaaatttcttcacagttaatcatttccagctaatactaaattcaatatgtattaatagaatgtttctctaactagaaagtaagatccatgaatcggggattcttgtccatctcaaagtgtccatcttatattccctattgcatagaaaaaaatggcacaaaataagtactcacaaaataattgttgaatgaataaatgtattattgcttctatgagcaaggctttgaaggaaattcttttcaaggggaagatattccctctcccccatgtaggattaaaatctggaagaggaaggcaggaaatacaaatattccttcaaacaaatcagcatgtggttaagtgctgtaaaaagatatcaacaaagtactgtaaaagcaaagaaagaggttatttttccatttatttaaaagatatttacaaagcacatacgttaggcattgtgctaggtgctggggattctacagttaataaaatcagatcccaccagtttaatgtgtcatacacaaaaagaccaaaaaaagacaatgaaactaagtgctaagatagttacatgtgcagtagctaagggagggtgttacagaagtaaatttgaactaggccttgaagaactgatactttcccaaaaggtaagcatgcaactcaaccattacagaaatagcatttatcatgtccaggctatttcaaagatggcagactcaccctttacaaactcaaattttaatcagagacatgagaagcctttagatgattgtaatatagaacagaatgaatatggtagccaaataaaggccatgttaagtacaaagtattgggagaaagtaggatacatgaagacattgagcgaatgaggaaaaaggcttttctggagaggtggcttttgagacagattttgaaaaacagattctggcaagaatggaaaaaggaacaggcattctagaaagaacatttttaaaaaggttaaaaagtagatacagagagttatcatgtcatgtttataggttacaagtgggcagaataaaagggaaaacttacaaatctaggttgcagccttcctgtagaattccaagaattgtgaacttggctttgtaaatctctatattccccagcattcaatctagtgtctagactctgagcaagtctgatgaaagggaagagatgagaggaaaaagacaagagagtgctagaagaaataggacaaagctagattcagtgaacaagatgcactgagaatgaatatggatgttatcatttaaagaaattattctaactaatttagctgaaaagaaacaaggagctgatatagagcatggagaacagaatgaagaaactggaagcagggtgaaaggatttagagaaaatgattatttaaagatgtaaatggaaaataaatgttaaagataaccaaggtttaagattttgtctaactaatacggaagattatcttctgggcagaagtaaatataaagaagaacagtaggttatatagaaaaataggttatacttaagcagatatacttaatataattagagcctatgattattatttcatttgaatatacaagtacagatggacaccaggcagaaagatagatatggaactcaggaagatggctaggctatgaaactataaaaagctaatacagacttccagtttctagcccagcgtgtaaagatatcagaagtcgccactcagtcctaaaaaaaataaaataaaaagctgaaaaaactgaaatatcaacaagtcttctaaagtctgtgagagaaatgaggttacagggcaaactgctgcctccaaaactggaaaaaaaggataggtagaaacagaggttcataacctaataaagcaaaaacccattagtagaagagccagggtgggaaaatctgtaactaatgaattgctagagacttggagtagataaatctgagagttaaaaattccacggggacccaatcatacaggaggtttccatatgtctgtgagttttacctccaggagtgttctacaagatcttcagtgagtatcagagaaaaatcccctcctgtttctggcagggggaggggaaaaggaaccatttaaaatatgccagagcattctgttcttaaaaatgcctgccgtcaggagaaactattttaccagagcctaaactgctggggttttatcagagcttaacgtagttggggtaaagggaataacccaactccagccaactccagccttccacatagaggagggttaatacacaaatcaagctcctttggccttccctgtggaaataccaactccatcgccctcctgccatcctgtcccgcctaagggtggggaaagaaaaaatcttagaaaactgaagttcacaatccagaggaacaaattcaccaaaagactgagacctaaacacaggactatagaatacttccccttccctgcacactttaccactgcattactaaagctctatttaccacacttattaaaccttggacatcatgtctactttcaacaaaaattacaagacacgcaaaaaggcaaaaaacgcagtttgaagagaccacaaagcatcagacacagagtcagatatggcaagaatgtcagaattatcagaccagggatttttgacaactaggattagtaagattatgatagaaaatgtagacagtatacaagaacatacagataacgtaagtgtagagataaaaattctagaaaagaataaaaaagaaatgctaaagattgagaacactaacagaaataaagaatgtccttgagggactcattagcagagtagacctggctgaggaaacaattcctgaacttgggatatgatgacagaaacttccaatactgaaaaagagaaaaaaaaaaaaccttaaaaaaacaacatgccttgtttcacatgaggcttctgacttggactttcgggttaatgctggaatgagttaaggctttaggggactgttgggaaggcatgattgtgttttaaaatgtgagaacatgaaatttgggaggtgctggggtggaatgacacggtttggttgtgtccccacccaaatctcaacttgaattgtagttccaataatccctatatgttgagggactcagtgggaggtaattgaatcatgggggcgattacccccatgctaccgttctcgtgatagcgggtgagttctcttgagatctgatggtcttacaaagggcttttccctctttgctcagcacttcttccttctatcatatgaagaaggatgtgtttgcttccccttccaccatgaatttaaatttcctgaggcctccccagtcacgcggaactgtaagtcaattaaacctctttcctttataaattatccagtctcaggcagttctttatagcagcatcagaacagactaatacaaagccctttactgttggtgaagaggtgatcctgcctgctgccaagcacatttgtcatgaactcttaggagacgctgcagttcaaaaggtgacatgtgttcatctttcatctttcagccatcacaacaaaatgaactgatgaaacagcagaggatattgaggcacagttgttaaagaggatgaatgagtcactgtggtatgcaatccaggttgaaaagtctatcaatgttaacaaggcaacaaggcttgcttttgtgtgatatattttcagaaggatgtgcaagaggatatgtcatacgcacttttattgccaaccaacaccacagctgcagaattattcaagtctttgaatgattacatatcagaaaaatggaattggtcattttgtgtcagtatacgcacagacagagaggcttccataactggatgtccttctggcttcacaacttgggtcagatggtcacttctgcatgtgactccacacattgtgtcacccatagagaaatgctggctagctgaaaaatgtcacctgaatttagcaacattttgcaggatatccttaaaattatcaaccacattaagtacatgcccttaacccacatctgatggtgcagctctgtgaggagatggacgcagggcacacacgtcatctcttatacacagaagtgattgctttgtgttattttattttatattttttattttattttattttattttattttattttattttatgaggctggagtgcaatggcacgatctcggctcctgcaacctccacccccggggttcaagcaattctcctgtctcagcctcctgagtagctgggattacaggcatgcgccaccaagcccggctaatttttgtacttttagtggagattgggtttcaccatgttggtcaggctggtctcgaactcctgacctcgtgatccacccacctcggcctcccaaagtgctgggattacaggcgtgagccactgtgcccggccagaagtgattgctttctaaaggtagattactggccagagtttttgagttacaagagccactccagagatttcttttagaaaaacagtcaccactggcaacacatttcagtgacacagaatggctcacaaaacttgcttacttatgtaacatattcaacctgctcaatgaagtcaatctgttgtcacttcaagggagaatgacaacggtgttcaagtcaacagataaaagtggctgcattcaaagccaaactagtattatgagggcaatgcataaacattgggatttctgacatgtttcaaacattagcagaaatcttgaaacagactgagccagggccttctttctcccagctggtacatggatcacctatctcagctttttaaagaatctgagcattaattcccaaccataaaaaaacccgaactgggaagaaatggatagcgacccacttgtaaattgccaggtgaatcaactttgtccacactagaagagaatcaactgcttgagactgcaaatgacagtggtcttaaaagtatgtttgagacaacttcaagtctccatacattttggattagagtcaaggcagaatatcctgagattgccacaaaagcactgaaaagcctgcttccatttccaacatcatatctttgtgaagcagggttttctgcaatgatagcgaccaaaatgagattacagagtagactggacataatcaacaaactttgggtgtcactgactcccaacactcccagatgagaccgtctagttgtggaaaacaagctccgggctcccactgattctacattatggtgagttgtacaattatttcattatatattaaaatgtaattataatagaaatgaggtatactataaatgttatgtgcttgaatcatcccaaaccacaccccctccccaggtctgtggagaaattgtcttcctcaaaaccagaccctggtgccaaaaaggttagggacttctgctatacactctgaagttatccttcaagagcgaaagagaaagacttccacagacaaaaattgaaggatttttgtggccagtatatctgctttgcaagaaatgttaaaagccttcagagagaagggaaatgacacaggtcagaaactcacatctagacaaagaaagcaagagcatcggaaaaggaataagtgaaggtaaaaatttttaaagctttattattcttaattgatctaacaagtgacattttaattacagcaacaatgtaatcatttatgtatgtttctgtgtatgtgtgcatgtatgtatacatatgcttatgaataagtgaaatgactgataacaatgatacaaggatgagaaggaagatggaggaattagaagtattttgctattatatggtacttatcataaggtacacttcattaccttcaggtggtgtagggttacttgacagcagacttggattagttataaatgtaaatgaaaactatagggcaaccactaaagaatgtaaaaagagaagtgtaataaagtagaaagagaaaaattgattaatataaaatgctcaattaaaatgactgggaaatggttggctcatgcctgtaatcccagtactttgagaggctgaggcaggaggatcacttaaggtcaggggttcgagaccagcctaggcaacatagtgagacccccatatctacaaaaaataaaaataaataaatacaaatgataaaagacaaagtgtggaacactacaaaaaaatctacagctaagcatcaaaatacatcaaacaaaaactgacagaactacaaagagaaacagattaatctactatcgcagttggagattttaacaactgtatcagaaatggacaaatctagcagcttgggaggccaaggcaggtggatggcttgagcccaggagtttgagaccaccctaggaaacatagtgagacccaatctgttaaaaaaaaaaaaaaaaatagagagagagaaaggaaaggaaaaagggaggaaagggaggaaagggagggagggagggaaggagggaaacagaaaagaaaagaaatggacagtttcaacaggcagaaaatcagtaagggtgtaatttatctcaacagccccatcaatcaattaactgtaactgacatctgtagactactcatccaaaaatggcatcacacattcatctcaagctcacctggaacattcaccaaagcggacaacattttgggccataagatacaccttaaaaagataaaaaatcatccaatgtctgctgtcagaccatagtggaattaaactagaaatcaaaaacagaaagacagctgggaaatcccaaaatacctggagattaaacaacacacttctacataatacataggttaaaaaggaaatctcaagagaaatttaaaaatgtcaactaaatgaaaaggaaaatacaacctatcaaaatttgtggtatccagtgaaagcagtacttagaaatttatagcattgaatgcatatattagataagaaaaaaaggatctaaaataaatcatctaagcctccacctaggaaatcagaaaaagtagagaatatcaactagaaaaagtaaatctgaaataaacaaaagaaactaaaagttcaatgtttgaaaattaattaaggtactccatcaccaacaggctaaaaaagacaaatcatgattatgtcaaatccacgaaatgcacttgacaaaatctaacacccattcatgattaaaaactcttggccaggcacggtggctcatgcctgtaatcccagcactttgggaggctgaggcgggtggatcacaaggtcaggagtttgagaccagcctggccaatagggtgaaaccccgtctctactaaaaatacaaaaattagccaggcatggtggcagccacctgtagtcctagctactcgggaggctgaggcaggagaatcacttgagcccaggaaacggaggtttcagtgagcccagatcgcatcactgcactccagcctgggggacagagtgagactctgtctcaaaaaaaacaaaaaacaaaacaaacaaaaaaacaactctcagcaaactagtaatagaggaagcttcttcaatttaataaagaacatatacaaaatacaagtatagctaacattatatttatagtggtgagaaacttgaagcttcgccaccaagatcaaaaagcatgcacgaatgtcccctctcactactgcttttcaacatcatactggaagtgctaactaatgcaataagacaaaaagagtacataaaaggtatactgattggaaaggaaggaagaaataaaaccatcattgttcacagataacatgatcatcttttataaaatgtcaaaaagaatccatacaaaaaaactcctggctaggtgcagtggctcatgactgttatcccagcaccttggaaggccaaggcaggaggatcacttgagcccagaagttgaagaccagcctaggcaacatagtgagaccttgcctctactaaagtatttttttttttaattagccaggcatggtgacacacacctgtactcccagccactcaggaggctgaggcagaaggattgcttgagcccaggagttggaggctgtagtgagctactgctgggagccaaaaatgccaaagggaccgtgaccaactcagcattccactggtggctatatgatcaaacagcaaactatttatcatgaacgcaggacgtgggcaaactcacactgcacctgctgctaaaaggtttcctgaggaccatcactccctggcgctgggctccttgaagttatctactgggaaatctagcacctattgttcgaaggatgcagtctcacaagcctgctgtgaaccaaacaggctgactgataattactcaacaatcaccctctctttctcgttatctcttttacctaatacattcagagggctgaaaaagctcaaggaccctgtccactagaggcaaggtgcccccgaccccttcttccaattatactcttttgtctttgtcttttattcccacgttcaccccctttgttcagtctcccaaggtccatgcaggctacaagtactgccccaaacagcaacaaaatcgggtgctcaacaagctacaattgcacatatgattgtgcaactgcatgccagcctaagcaacagagcaataccctgtctcaaacaaacaaacatcttgaagggacatctgttctacttcttcttgtttggataaacagcttgtgagaggcttctcaggaggcaagtctaatctcataggggcatgacactggaagtctttttctgcctcattctccacatggtcttgatctcgcttatttttgtcctcttcaattctgctttctccccttttcttcccccagaactggcttctctcctttctttctctttttccactttctgtccttgtgtttgtcatgattgtttttgtctttgaagaggctggagcagtgctccaaactgcccgtggagagctcagtaactgctttccctcctactttgaggaccagcttcaagggcttttccacatactctttgtagaggtgcttctctgacttgtgctccttgcccatgtctgaccaggccctggtgcccacctcccatgccaggcccaggccttggggtgccacttctggtccaggccaggcgaggtggaggacaggagcagggcctaccaaaccccgcacgccaatgcagggggttagcatgtgtgccaggtggcacaaggcccctcttgagaagacagcccatgagacctagctggggcctgagaacatgaatcaactgatgagacagctgcagagaaaagatccaagtgctcttttcgttttctgtgattttattgctcctggctactccatcatcattaaacacccaatggatctcagcaacatgaaagaagagatcaagaacagtgaagaactaacggataacttcaaaccaatatgtactaatgccatgatttacaacaaaccagagaccacttattataaagctgcaaagaagctgttacactcagagatgaaaatttttagccaggaaaaaattcagagcctgaagcagaccacagacttcatggctaacttgaaaaaacttgaaagcagaaagacagaacagacatctcacagagtggggaggatggaggctgctggctgagagagagagagagagagagaggactctggagatgccgaagcacaagccttcaagagtcccagcaaagaaaataaaaagaaagacaaagatatgcttttaagtttaaaagcagtaatttagagagacagtaggagcagcttgactgcatcatgaaggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcagcaaggataattcagatttaatctatgcaatctatgggggaagactgatcttccaagcaatttcagcaaccatgagtttctggccccatgccaagattacccatatgttaagacagatagtttgctggatgttttaacaaaaggaggggattccagggccctataagagttggagatatcacctgacgatgaaggccatactaggacacttgacacagcaaaacaaatggagattacacaagtagagccagcaggacatttggactctaatactcaagataggctcatggcactgaaagcagtaacaaactttggcgctccggttgaagtttttgactcttgaagaagctgaagtattccagaagaaacctgatgagaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtatggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatgttggttctttccaatttgatctatagattcaacacaatcccaaccaaaatcctagcttattacttagtagattcaatgaactgattctaagtttatatgaagaggcaaaagacccagaatatccatcacaatactaaaggaaaagaacaaagttggagtactgacactacccaacttcaagacttataataaggctacagtaatcaaaacaatgtggtattagtgataaaatataaaattaatcaatacaacaaaatagagagtccagaaataggacacataaatatagtcaactgatctttaacaaaggagcaaatgcaatacaggggaaaaaacagccctttcaacaaatggtgctgaacaattggacatccacatgcaaagaaaaaaaaaagaaactagacacagaccttatattttttacaaaaattaattcaaaatggatcacagacctaaaacacaaaactataaaactccaaaaaaaaaaaaaaaggtagaaaatctagatgaacttggctatggcaatgactttttagatataacatcaatgctgaatccatgaaaggatgaactgataagctggacttcattaaaattaaaaactttttccctccaaaaaacaatggcaggagaatgagaaaacaagccacagaccaggagaaatatttgtaaaagatgcatctgatctaaaaacaaacaaacaaaaaaaacctgttatccaaaatgtacaaataataggccgggcgcggtagctcacacttctaatcacagcactttgggtggccgaggcaggcggatcacttgaggccagtagttcgagattggcctggccaacctaatgaaaccctgtctctcactaaaaatacaaaaattagctgggtgtggtggtttatgcctgtagtcccagctacttaggaggctgaggcaggaaaatcgcttgaacccagtatgcggaggttgcagtgagccgaaaccgcatcactgcactccagcctcggcaacagagggagactctgtctcaaaaaaagaaaaaaaaaaatcatacctacataatgaagcttacatttaaaaaaaaataataatactaggtctacagaacttctagacagctgaatatgtggaagttccctcctgaagggtggcacccctggagatggcatgggatctccacattccttatctcataccttcccctatgcatctcttcaatctggctgttcatctgtatcttttctaatatcctttataacaaatgggttaagtgtaagtaaaaagcttctgagtttcagcaagttaatcaaacccagggagggagttatgtgaactctgatttatagccagttggtaagaagcatttgggacttgaaattggcatctgaagtggagggcagtcttgtggtagtgagtcctcagtctgtgggttctgacgctatctctacacatacagtgtcaggattaaattagaagacagacacccagatggtgtctgctgaagaatatgcagaactgactgcctggtgtgtagggaaacaaataccatacatgtggtgcagaagtactgtgctgagtggagagtagagtgggaaaaatgcatctttggtttttcctatatcactacagcggctttactcataattgccaaaacttggaaattatcaagatgcccttcagtaggtgaaggctgtgcatgtgtggggatatggaggatatgggaaatcttggtacttcccatttaattttgtagtcagcctaaaactgctctaaaaaataaaattcataaattttcaaaaagttatcacaggtggggccaggcgcggtggctcacacctgtaatcccagcactttggcgggactaaggcaggcagatcatgaagtcaggagttcaagaccagcctggccaacatgttgaaaccccgtctctaataaaaatacaaaaattagctgtgtgtggtgacacgcgcctgtaatcccagctactcaggaggctgaggcaggagaattgcttgaacccaggaggcggaggttgcagtgagccaagatcacgtcactgtactcaaaaaaaaaaaaaaaaaaaaaaaaaaaaagttaacacagatgcttctactataatacaaatatatgcattcctggaaaaccactggaaaatcatgcactaaactgtgatatacccagaaagcggaacattattcagtaataaagaaaaatgaactatcaagccatgaaaagatatagaggaaacttaaatgcatactactaagtgaaagaagccagtttaaaaagaaatggtttgaatagtatgtactatatgattccaattacataacattctgggaaaggcaaaactatagagaccataacaagttcagtggttgctaggggtccaatgggttgaacaggcagagcacagaaaatttctagggcagtgaaactactctgcatgatacgataatggtggatacatgtcattactaatttgtcaaaacccttagattgcacaacaccaggagtgatcctaatataaactattggtttttgagtgttaatggtgtgtcaatataggttcactaattataaataatgtaccctaaggtacaaaacattgatagtgggggaggttgagcacgtgtgaagatatggaggatatgggagatcttggtacttcccattcaattttgtagtaaatgtaaaactgctctaaaaagtaaagttaataaatttttaaaaagttaacacaggtgcttctactataatgcaatatagacattcctggaaaatcatgcactaaaaataatagggcgtatggaacgaataggattaaaaacactcaattcaaactgatgcaattttaactagtgcactaacaaaaacagtgactcaggagataacttggacagtctgaacaggtggtcacagtgatattttaaaaccacatacacacacagtcaaaatgctggcggtactttaattagaggtctggtgagtgttcagatgatataggtggactctgtgatatagggcttgccgtgcaggtggagtaggagggagcataacctggcgtgaactgaaagtctataaagaaggaagtgcacttctcaaggaagagcacccaaagggcaggtactcttttacaattttcttatgtaagttggaaaaagcttctgctaatgtagtaggtaaccctaagccttttgctttgctggccaaatattttaattttattcaccatattctaactccccttgcctggggagttggtgggggaaagcacttatgaaccaatctagaaaactaagcagacatcattctcctatttaccaattgtgtatgagcaaatttgcaccatagaaatgtgttttgtagcaagacaagctgtagttgaaactctatgtgaacttaatcatatagaaaaacaaaaatctgaggtcagatgttttaatttctacatttagtaacatcttttcaacctttatctgccttctctgacttttatacaacggttccctttctatggaaaaacacttgcttgctttcctttctagaacaactccctcaggctccttcacaagttgtgctcttctgctaccttctaaaatgctgctgtttcctgtttctagttctggatcccattttcctctcattgcacaaatcctcccttggaatacctgatcatgcccaaggctttaataaccacccacctagactgacaacacctaaatctcttatctctggctcagacctgcacccacaaatattaccctcattcttcactcaaccccaaatttacaatgtgtaagtttaactcactatttttctcctctaaacagatccttaacatagtaatctctataaaccaatcaattgttgctgtatgaaattaggcaatcattctctcaccacattaaatatgtcattaaatctggcccattttaccatggcttggtcatacagatgtttaatcaacagtcttcttctcattctgaccactacagataaaattcaaatgttcacataacttttggactattgagacagcttcctgactggtttccctgcctccaataacatctaccttaaatccaatctctattatgccatcagagtaaccaaactaggatactttggaggtgaaagatggcactattaataaatttataagcacagcaggcataaactgggccagccctaagcaaacctttacacctcaggtcattgatatcactcggcccttgcttacctcttcaaccacatatctaccactacctttctctcacattacatttcatccacacagaataatttgtagttttccaaatgcattatatttctcatcattcctttaagcttctccatatgccatacactatgcctcaaaacactattccttcacccccttcacctggctcaattcatttagttcatcaggttctcaaactagattatcacttcctacaggaagcctggccaggcttttggaagattagcttctatgttcatagctggggttcccacagcacttcatacataaaccctgtgcgaatcaacacactgcaactatctcttgtctgtgttctccattagactacacattccttgagggcaaaaccagcttcattcacatttctattgctacagcataaatggaaccttatccatagttaagataaacaatttttaaggaaatggataaatatattttttggtatactctctctgtagggtttaagttccataaaggcagaaaccattctttgcttttgtgttcccagaatttaacacattagatgtttaatgttttgttgaggaggctcatttgcaaaggtgggattcattttattaaatgttcattagtacagacttggtggtggaaacaaaccaattgaagaaaaaatagaaaaaaatgatataaatggaaagaaaaagaataaaatggaaagaaaagaaatgatgcaacaatgaaacttaataatagtaactattatttggttgatctttccaaggtacacatatatacagaaagaagagacctctttcttctccaatttaagtaaagaaaaagggtccttcatatttggtttattccacaaagtcctgttaaccacagatggaaatttaggtataaatggaaatacaaactattccttggctctaccaatctaccattagaactatccagaaagtttggattttagaataaagacatggttctcattctctacctatgagactgagtgatatctacttctaaggtcatcttaattgtaaggttagtcaaatttttaataagaaaatagaagttacttattaagagtatgttttccatctataaattcatttaaaaatgttacttttattttactgacttatttactctagaatacacattaatttcaataattattattaaaagcataattttctttgtctagtgtctatagaattaggatgaatatgttatggatcagaaaaatgtacctatacaaaatgctatgcataaaaaattacatcattcaaagatccaaagttaaaaaaatccttcgctaaagaaatattttattactctatctgctgtttcttctaaccctcaccattttattggctctctgtatctatccattgatagaagtttatcttatatatttatcatacccatttagtattaagattttccttgtattctcttttacaaattgctctcatcttttaaaatcagatttctcaataatatttcaattcctcacatacttcaaaatcctactaatatttttaacaaccccttttacatatccttccaaatactaatatttttatttgtccttgcacgctggcttggagagccctctactggcctgatgctgtgtcaaaagaacatttgcttcatccttcagatacctattttttacatgctttcgataatatgataattatataattaaagcctttattccgaatgacagaatgttaaagagaaattgaacaattctactaaaatgctgttaccaaagcaagatacactacttccatagtatagaaataccattttcaaataactgtacattattctcagtactcattataaagccttgctatcatgtgacagaagtccaagatgagaccaaattataacatgatgtattcataactaaagtataaaaggcaagttggagtctctatgttaaatgcctctggcctcaagaaaatctgatagttattttctcatcaatatttcctgattttaatataccaatgtctctagtatttataaatatcacatttgaagatatgatgaaggaaacaattccacttaacttaaaatctaggaataaaggccgtaatgaagagaacaacaataacaacatccacaaatagaagtatataccaccacaaagttatcaggcctcactttagatcccaataagtacgccaacagtctttttctttgggaaataaaccaatataaagtttatataaaaataaacatgcaaacaagttttaaaggaagctctttttaaaactgagtaataattaaggaaagtagccattccagtcatataaattttgttaacgggcctcatagactctatatctgtgttccaattagactatactctccttatgggcaaaattaacctcatttacatttctattcatatggcgtagacactgtcttacctacagtgaatacaaataaatttagaaggaatagacaaacttgttttcctatatggtctctccctctgtaagttttgagatccatgaaagcaggaactatttttcacttttgtgacatcagaatttaacacagtggatgttatgtcactgtttggttaaataggctcatttgtaaaggtgagattcatttataaaatactcattagaatcagacctcattgtagaaaaaattacatagaggaaaaggaaataataatataaacaaaatattgagacaaaattggaaaatttattttcaaattaaattatagacaaaaagctaatttcctttatatatacagggctccaaaaaacaataagcaaaaacctacaacctaacataaaaaatgatcaaaggatatgaaaagaaatgtgaatgggcccttaaatttataaaaagaaatataacatcactcttaagagaaatacatattaaaaccatatgaccataaggagataaatctcccctttcttttatatagacctactagaagggcaaaaatccaagtttaataacacactctgttagcatggctgggagttggggagtgggacggtgagagttcttatacactgctctcctaaagagcaatttgacagtatcagtaaaaatcacaaactcaatacctagaaatttcacttctggaaatgtaacttacaagaatatctgcatatgagcaaaacagtatttataaaaggttattctttacagcatcatttacaataaccctaaactgaaaacaactcaaattttgatgagtagggggcaggtagaataaattatgctatctccataaaacagaagatcgtgtaactgcaaaagcaagggaaaggggtgttatctaggtaatgatagagaaataatcactgtgtgttatataattgtatataacatttaaaaaaaagcaaggtgccagataatgtacatattcttatatttttttaaatgcagaagaaggataaaacacacttatatctgcttgtgatatgcatcaactctggaagggatacaccagaaactgacaacagtagttcctgtatgtgtgtggagaggggtgtgcaatctggacagatggaaggctgtagttggacactctttgccacacatataaataaatataaatcatgtgaatacattattaagttgatttaaaatgtccttatattacaaggtaagtatattattaacacaagctttactactaaaacagctacaaaatcctctgtaatcttacctgcaaactagccacataagaatcctcacaatttacataatgtcctaacatggcatgttgagcccgtaattcattatcccttatcctctcatgcaggtgggtaatttgttgcttctgcctgcaaaacataaattaaggtcacattatgagttataattttctaatagttagaagaaccttaaggagcttattcctcttagattcctttaatattcctcttagattctaacagtcacaccttgctttcttcaacaactcatagcttgctttaagcaagttatttaatttctgtaaatatgtatgcttagaaattttaaaactgttttgtgccaggcatgatgctaagagctttgtatgcagtatctctcatcttcaaaaatttattaactctcatgatgaagttttgaaggagagagcttttaaagaataataaagatagtatgagtaaacaaatagcttgatgttttccaaaattacttacaaagtaacttttggaacaagtaagttgtatgtttcaggttgcatcaaaagaccttgttctactcaggatgatttctaaaatttgctaacctttaagaaaatccacatataaaacattaaataggagataagtcaggagagattcgtcatataacacttttcaaataatttaaagctttacaagaaagaaaaaaaaaaaaacccttccttttccagccaaggtgcagtagcaggcagggactagttttgccctcatgcctgaaacaattttttaaaaaagacaaaatataggaagtgaagactctcaaggcattgggccaccaggcaattaagaacagtaatctcttagagataggtaactaatgaggtgggccctatgactgactgcacttcctgctgagagagttttcaagccccagcacaggaatggtggtctccctgaattgaagacacaaagctgagaatctggagaaaccaaggcagctgtagttagttcacagtactcgataacccttgggcactcggttgaatactaattaatacaggcatgaggaagctaccgacggtgtgtgtagagtggaagggcaaccaaaaaaaatattacagggaacagtgcttcagggtgccttggaattactggctattcccaactgccagaataaaaagcttcatgattcccagggcatcagcaattctcaactggggacagttttgaaaccagttaacatttagcaacatccagagacattttcaattttcacaactggggcagaatgttactggcatctagtgagcagaagccagagatgctactaaatgtctacaatgaacaggatagccaccctcaatagtgaattatctgatccaaaaaaaatcaacagtgctgaggctgagaaacccagggtttgtaagatgagtcttgtctcagtggggaaaaaataacccttgataaaacagctctaatgccacctaacaaaacttaaaagcaagtacaaaaactgcttcctagaataaagttcaggaatacaaaaatgtaatatcaaaaacaagttaaaattcataatgcctggcatcaaaaaattattgggagtacaaaaaaagcagaaaaaatgtaactcataataataagaaaatccaatcaactgaaagtgagctagaactgacagagatgttaaaatagacaaggatagtaaatcagttattataactattcatatgcttaagttagaagaatgaacgaacatgttaagaggagacatacatgacaaacaacacactgaatggtgattaaaacattagacattacagcacaaaagtacagtaaatttaaaaacagcaatagaaactatctaaaaagaaacactagagaaaaaaggacaaagaaataaaacaaaaaagctcatagtatcagtgagccgcgagattataagaggccaaatacatgtacaattggaatctctaaagaggaggtaagaaggtggcagggggtgggagtaggggacagaaaaaaaatatttgtgtataacaggccaaaattttaccaaatctgatgagaactatacacccataggttcaggaagcccagtgaaccccaaataaaagtaacatgaagaaatctaagacaaggtacatctaaatcaaatagattacagtgataaaatcttaatagcaaccagagggaaaaaagataaatccattcaaggagacaaagatgaagaggatggcaaatttctcaactgaaataatgcaatcaataagacaatgaagtactttaagtactaaaatttaaaagctctcaacctaaaatttttgacatgagaaaaaatttgaaaacaacacaaaaagcatacaaaaaaaacctgttaacctataatacttcacccacagaaaatatttttttaaaggttaaataaagatcttttttggaaacttaaaagctgaaagaattgatcaccccagacttcaactacaaaaaaaatgataaaggaacaccttgaggtaaaagaacaatataccagatgaaaacctgaatttacacaaaagaaagaagaataccagaaatgataaacacatgggcaaataaatacataagatatttttcttattatttaaatctcattaaaagatcataaattgtttgaggcaaaaaaaaatttatatccacgttgtataacctttgtagatgtagaatgtatgacaaaacagctcaaaggctagaagagaaaaaaatggaactatgctttataagattcttacattatacataaaatagtatagtattacttgaagatagactgctatactttaaaatatattataaactctaaagcaatcattataacaatagaggtatagctaacatgccaataaagagataacaggaattgtaaaaaaatattcaactaattcaagagaaggcaaaggggaacaaagatcagatgggacaataagaaaacaaatagcaatgccaggcacagtggctcacatctgtaatcctagcactttgggaggctgaggcaggtggatcacttgaggtccggagttcaagaccagcctggccagcatggtgaaaccccatctccactaaaaatacaaaaattagctggtcatggtgatgcatgcctgtagtcccagctacctgggaggctgaggcaggagaatggcttgaacctgggaggcagaggttgcagtgagctgagatcgtgccattgcacttcagcctgggagacagagcaagacactgtctcaaaaaaaaaaaaaaaaaaagaaaacaaataccaatataggagatttaaacttgaccatatcaataatcacaacatgtaaatggtttagatactcccaaacaaaaggcagacattggcagaatggataaaaagtaggacctaactatatactatctacaagaaagaaaaccattctgaacataaggacacaaacaggttaaaagtaaaaagaggaaaacctgtgctaaaaataatcaaaagagagccagagtaactatattaatattagtagaagcagattttttttttttctattttagagacagggtgtcactctgtcactcaggctggaaggcagcggtgtgattagagctcactacagccttgaactcttgggctcaagccatcttcctgtctcagccttccaaatagctgggactatatataggatccactgtgcccggctaagtttttttttttttaattttgtgaaggtgaaatctcactatgttgcccaggctggtctcaaactcctggcttcaagtgatcttcccgcctcaacttcttggtgttggaattacagatgtgcgccaacttgccaggccaaaacagattgttagagcagagaatattgccagggacaaaaattataacttaataataataaaaagatcaattcattaagacgtcatgacatttgggcctaagagcacagtgtctaaatacatgaagcaaaaaaactgataaaacagaaaagaaacagatacatccacaattgtaattggatattttgacacctggatctcaataattgacattaatagaacaagtagacagaaaatcaagagaatataaaagacaaaaacactatcaactgatttgtactaaaaggaatttctagaatactccccacaaaagacaaaagcagcagaatacacaccctcttcaaggatacatgaaacacttattaaaacagatgatcttctgagccatgaaacaagcaccaacaaacttaaaagaattcaattcatatagaatatattcttggaccacagtgaaattaaatcagaaaacaattacagacagaattctagaaaatcctgaagtatttggaaacaatgtaacataattgtaaataactttagggtcaaagaagaaatcagaagataaactaagtattttgaggtgaacaaaaatgaaaaccaaacaaattaaaatttgtaagatattgataaagaagaacttagaaatttattttttattttattatactttaagctctggggtacatgtgcagaacgtgcaggtttgctacataggtatacacctgtcatggtggtttgctgcacccacatcatctacattaggtatttctccgaatgctatccctccccaagacccccacccccagataggccctggtgtgtgatattcctctccctgtgtcagtgtgttctcattgttcaactcccacttatgagtgagaacatgtggtgtctggttttctgttcctgtgttagtttgctgagaatgatggtttccagcttcatccatgtccctgcaaatgacatgaactcatccgtttttatggctgggcatagtattccatggtgtatatgtgccacattttcttcacccagttgtatcattgatgggtatttgggttggttccaaatctttgctattgtgaatagtgctgcgataaacatacatgtgcatctgtctttataggagaatgatttataatcctttgggtatatacccagtaatgggattgctgggtcaaatggtatgtctggttctagatccttgaggaattgccacactgtcttccacaatggttgaactaatttacactcccaccaacagtgtaaaagtgtttctatctctccacatcctctccagcatctgttgtttcctgactttttaaggatcaccattctaactggtgtgagatggtatctcattgtggttttgatttgcatttctctaatgatcagtgatgatgagctttttttcacgtttgttggccatataaatgtcttcatttgagaagtgcctgttcatatccttcacccactttttgatgtggttgtttttttcttataaatttgtttaagttattgtagattctggatatcagccctttgtcagatggatacattgcaaaaatgttctcccattctgtaggttgcctgttcactctgatgatagtttcttttgctgtgcagaagctctttagtttaattagatcccacttgtcaattttggcttctgttgccactgcttttggtgttttagacatgaagcctttgcccatgcctatgtcctgaatggtactgcctaggttttcttctagggtttttatggttttaggtcttacgcttaagtttttaatccatctttagttaatttttgtttaaggtgtaaggaaggggttcagtttcagttttctgcatatggctagccagttttcccaacaccattcattaaatagggaatcctttccccattgcttgttttcatcaggtttgtcaaagatcagatggttgcaggtgtatgatgttatttctgaggcctctgttctgttccattcgtctatctgtcttcgtacaagtaccattctgttttggttactgcagcgttttagtatagtttgaagtcaagtagcgtgatgcctccagctttgttctttttgcttaggattgtcttggctatctagactcttttttggttccatatgaaatttaaagtagttttttctaattctgtgaagaaagtcaatggcagcttgatggggatagtattgaatctataaattactttgggaagcataaccattttcacaatattgattatccctatccatgagcatggaatgtttttccatttatttgtgtcctttcttattgccttgagcagtggtttgtagtgctccttgaagaggtccttcatatcccttttaagttctattcctagatattttattctctttgtagcaattgtgaatgagttcactcatgatttgcctctctgtttgtctgttattggtgtataggattgtgatttttgcacattgattttgtatcctgagactttgctaaagttgcttatcggctcaaggagattttgggctgagacgacgcaggtttctaaatatacaatcatgtcatctgcaaacagagacaatttgacttcctctcttcctatctgaatacttttatttctttctcttgcctgatggccctggccagaacttccaatgctatgttgaagaggagtgtgagagagggcatccttgtcttgtgccagttttcaaagggaatgcctccagattttgcccattcattatgatattggcggtgggtttgtcataaatagctcttattactttgagatacactgcatcaatacctagtttattgagtttttagcatgaaggggtgtcgaattttatcgaaggccttttctgcatctattaagataatcgtgttgtttttgtcattggttttatgtgatggattacatttattgatatgcgtatgttgaaccagccttgcatcccagggatgacgccgacttgtttgtggtaggtaagctttttgatgtgctgctggattcggttttccagtattttattgaggatttttgcatcgatgttcatcagcaatattggcctgaaattttctttttttgttgtgtctctgccaggttttgtcatcaggatcatgctggcctcataaaatgagttagggaggattccctctttttctactgtttgaaatagtttcagaaggaatgataccagctcctctttgtacctctgttagaatttggctgtgaatctgtctggtcttggactttttttggctggtgggctattaattactgcctcaatttcagaacttgttattgatccattcagggatttgacttcttcctggtttagacctgggagagtgtacgtgtccaggaatttatccatttcttctagattttctagtttatttgcgtaaaggtgtttataatattctctgatagtagtttgtaattctgtgggatcagtggtgatatcccctttatcattttttatcacatctatttgattcttctctcttttcttctttattagtctggatagcagtctatctattttgttgatcttttcaaaaaaccacctcctggattcattaatattttgaagagttttccaggtctctatctccttcagttctgctctgatcttaataatttcttgtcttctgctagcttttgaatttgttcgctcttgcctctctagttcttttagttgcgatgttagagtgtcaattttagatctttcctgctttctcttgtgggcatttagtgccagaaatttccctctaaacactgctttaaatgtgtctcagagattccggtacattgtgtctttgttctcattggtttcaaagaacatctttatttctgccttaatttcattatttacccagtagtcattcaggagcaggttgttcagtttccatgcagtcgtgtggttttgagtgagtttcttaatcctgagttctaatttgattgcactgtggtccgagagactaaatgcctataccagaaaaaaagaaagctctcaaattatctcagcctccactttaagaagttagggggaaaaaaagggccaggtgtggtggctcatgcctgtaatcccagcactttgggaggccgaggcgggcagatcacgaggtcagaagttcgagaccagcctggtcaacatggtgaaaccctgtctctactaaaaatacagaaattagctgggtgtggtcgcgggctactggggaagctgaggcagaagaactgcatgaacccgggaggcggaggttgcagtgagccaagatcgcgccaccgcactccagtctgggtgacagagcaaaactctgtgtgtgtgtgtgtgtgtgtgtgtgtgtgtgtgtgtgtgtggcgggggggggttgtgaaactccgtgtgcgtgtgtgtggcgggggggttgtgaaactccgtgtacgtgtgtgtgtgtgtgtgtgtgtgtgtgtgtgtgtgtgtgtgtggcggggggggggtgtgaaactccgtctcaaaaaaacaagttagaaaaagaagaacaaatgaaacccaaagtaataaatagccctatgtatattacagaaattgggtttttcgttgacctttcaatacagaaagatcaggagggtcaggagtcttcactgaagaattctgctgaaagtttaggaaataaaaaatactagttgtacacaaggtaccccaaaaaccagtgaataattcccaactctatgaggccagcatgaccaatatctaaaccagataaatacattacaagaaaagaaaaatacagaccaatatctcttataaatataaatgtaaaaattcttaacaaatggaatccaaagatagataaaaaggaaaatacatcataaccaagcgggtatatcccaggaataacatggtaggttttacatctgaaaattcatcagctacctagaatagaagtagtttccacaatctaaaaaaggcaactacgaaaaacagctaacatcacacttaatggtgaaaggctgaagactttcacctaaaacaaactagggacaagagaaggaaaaggatgtttactctcactgcttctattcatcactgtattggaggctctatttacttcagtagaaggcaagaaaaggaaataaaaagactctatactgaaaaagtaaatccacctttaatcacagacaacatgatcgtttatgtaaacaatcctattgaatctacaaaaaaatacctacttaaactaataagtgagattagattgcaggatacaaaaccaattttatttctatatatttaagaacgttttgaaaatatgcattttttaatcgacataattgtcatatttgtggggtataatgtgatatttagatacatgtatataatgtatagtgattaaattagagcaattagcatatccatcatctcaacctttatcatttctttgtgctgttaacattcaaattactctcttctagctatttgaaaaaaatataattattgtttattatagttaccctatagtgcaacagaacactagaacttctatctagctgcaactttctattccttaaccaacctctctgtattcgctacttcccccagccttcccgcctccagtaaccactatcccaaactccacttttacgagctaaactttcaaaaaacttcatttttgcttaagtggtgagactccttcacccagtcagttaaggagatcgaaatgcaaaaggtcaagcactactcaatcacctaaatggttatagtggcaaatgtttttctgaattgttcctgaagttaatctatacactttttctcatgagatggggagcatttaggaacagtttctatagcagttatttttcccattttctctgctttaacctaataatccagtctcctcctatgaaagttatacgcagtgtgaaaaaaaacacattttttctcatgtaattttggataatatattttcagaagtaatatacaacatataatttttacttaagtgatttgaaaggtatcgctgaccacaccatatcccaaactaaaaagttcggcaggtttactttcaattccatccaattggacaccaaatcccatgaagtctggctctgaaatagcctctacatgtgccatcaacattttaaaggccattactctcatctgcttcttcaaaaacagaaatgttatatatttgattccaatttaagtactatatatgttatagaaatttgtatatacaaacatttttacttttaaatgacagttatgctgctttagaaacaaaagctgcttagtttctcttctgttttatacaatatcaaatgcactgattatcaaaaactttataataaactcataaagaaaccaaagattatttaagatactgggtaggttatttactaaaatgcctccattattacccttcctatattactaatgcctcctgtcaacgtgattttgctgtttccactggccagaagtgaagtccactactggtctagtgactaacagaatataatggaagtgatgttgagccagttctgagtctaagcttcaagagacttcgtatgcttcattctttcttagaatcccacccagccaccactcgaacaaacccaggctagcctcctgcaggatgacagaacatgtggagtaagacaagccatcctgccgtggcccatcctatgccacccagcccccacctgctaccacagacgcataaataagcctagctaaagaattagccaaatgagcaacttgagttattttgaattattccttagtctgattctacaatatataaaattgagaaatatatattttattatattatgtcaataattttctgcattttctattaacttatatccaatggaatggtattcaaaaaaaaataacatcaactgatttccattgtttgagggagggcaaatccatgtaagtaaaactgaactttagtccattttttaaaagtattaatttcaggccgggcatggtggctcacacctgtaatcccagcacttggggaggcagagactggtggatcacctgaggtcgggagttcgagaccagcctgaccaacatagagaaaccccgtctctactaaaaatacaaaattagccgggcgtgacggcgcatggctgtaatcccagctacttgggaggctgaggcaggagaatcacttgaacccagaaggtggaggttgtggtgagccgagatcatgccattgcactccagcctgggcaacaagagcgaatattaatttcaattatataaaattgcacctatattaaattataggtattaaaaatacacatccaactgggcctgtacttattcgtatataacattcacttgtaccagaaacaactaatatttttaagtagctttttcctaaaatcaattaaaactatcttccacaatccttcatttatcaagtatggaagtatcaagttttaaggcatatactaataccaggctcttttcaaaatgttgggaataggctgggcatggtgactcatgtttgtaatcctagcactttgagagaccgaggcaggtggatcacttgaggccaggagttcaagacaatactggccaacacggcaaaaccctgtccctactaaaaaatacaaactttagccaggtatggtggtgcacagctgtaatcccagctactcaggaggctgacgcacaagaatcacttgagcctgggaggtgaaggttacagtgagctgagatggcaccactgcactccagcctgggcgacagactgagactcccaaaaaaaaaaaaaaattgggggaatatagtggagaacaagaaaatgcagatatctgtggtctagtttatattccagtagatcttcattaacaatgctaaatttctaagcaaaatcttgtgaaatttcaactattaaatgcgtttaaaggttgaaattagaattttaaggctaaaacacctactgcgttatcctatgcaagcatatgaaaataagtaattacgagcactggttaagaaaaaaagcctcctggaattgcttcccaattatcatgatatacaacatatttaattatcccaaaagcatacataaatgatgtagaatatacgttaaagaaaatataatgatgtaacatgaaggtttactgctcacaatactcaggagactgtctattaagtataaataattttttttcagagcttaggtactcaaacccttaaacattttagaacgtcccccaaaactgccataattcttaactataagtcatttcattttacacattcgtcatttttgtagtttctgtggcttcagacctagcatacattaaaggaaatgactgctttaaattagctttccaactggatagttctcaagggttaaaacacgaagacattatcttgtagctctaatagctgattagcattgcagctaacccgctacacgtacagaaaagacagaatggagcttccaaataatgaaataattcactaaaatgaataggagggatgacagaaatcagacagataaaccatcagttctaacagtacttctttaaaggattgggattgaggaggggcagagatgtgacatcaatgaatctgtaaggttctagatcttaaattctatgtagtggacataaagttaattgtttcattaatctaaatttctgtaggcctgaaatatttaataatttaaaatagactcaccgatcgattacaatttctttctgccttagaagtccttcttttattttcaacattgattcccacttactgaaatcctgatagccaggtgaataactttgacgagatgatccagtcaaaacctgcagaaacatgtttacacaattagtatactaaaatatttaaagaaaatatttatatattatcatattttcccaaagatttatattaaaaaaaaagaactccctctttgattttttaatactttcggaaatcacactatgaatacaacataacttggacaatttcaaggaagttctaaaggaaatgtatacatctaatgaagaattaatgacaacagaacgtttatcctggcaaattataaaactatataagatcttggccaggcgcggtggctcacgcctgtaatcccagcactttgggaggccgaggtcaggagatcaccaccatcctggctaatacggtgaaaccccatctctactaaaaatacaaaaaattagccaggcgtggtggcaggcgcctgtagtcccagctactcgggaggctgaggcagaagaatggcgtgaacccgggaggcggagcttgcagtgagccgagatcacgccactgcactctagcctgggtgacagagcaagactctgtctaaacaaacaaacaaacaaacaaaaccatataagatcttattcccattaccttgtggaagtggaagtggaagttttctggaaatgagattaatcattaagggagtaatacaatgtaggaatgtgccatggcttaactagacaaacattagcaggagattttccacaagaaaataaaagcagtatctgtagtattcagacttcaagttgacatgcatcacatcatcatttagttacattagaatttcaaaatcacaaatattttcactcagtagtgagacaaccaaatgcctaggcagataaaaaggggtccttggagaatctctgacccactccacaagtgtgcagatgcttctgtgcagatgaggaaacctgcccagggctcatgtgggcatgcccatagctgactggagcccagcatgcgttctgggggaaatgggtggagccatggggaattcctgccttatgcgggggaggagcctgctctcttcagctcacctggtgacctggaaatcaatctgtgaggtggaggacctgttagcagggctctatcttgctttgatgattgtttgtttgtctgtttcttttttccttttcacccaataaattcctttccaatcacccttcaaggtgtctgcatgcctaatcctccctggtcgtgtgacaagaacccaatttttttctacaacagtagtaagtatatccatagaaaatggaaaatatataaccatctactaagtagataatttggatgaaatatatcacttagaaaaaattgcttagaatgtaagaaaggtttcagatatttaaataaaccaacggtagaaactaacatggcagatatccttatatttcttccgttgaaaaagcagcaaacatttaaaaatattggtgttataggtttgactgtattccttaaaaagataagttgaagtcctaacctcttgtaacttcagaaagtgatcttatttggaaatagggtctttgcagatgagtcaagctaagatgagctccttaaggtaaggcctaattcaatgtttggtgtccctaaagaaaggggaaattttggacctacgtacacaaggaagactatgtgaagagacacagagacaatgccatgtgaatatcaaagtagagattggaatgacacatctacaagacaaggaaagccaaagaccaaaagctaggagagaggcatgggacaaattctgcttcacagtcatccaaaggaaccaactctgccaacaccttgatttctaactttcaacttccagaactgtgagacaatttctggtgtttaagctagctcatttgtgatactctgttatatcatctctaggaacctagtataactggtaaatcaaataggaacacagttctttggcaagccaaaagatgtataaacaccacaaagcaacttcaagagaattcaaatgtgtagtgatatttttatcctttactttccaaaaatgctattaataagaccttcaaaataaaccagtaattgcataacatcaaccagtcacagattaactctttgagatgactgtcaagtaatattaggatgggatgtttcatgcaggagacaggataggatgaacagactaaggatagagatcagttgaaaagaaggcacatacttttgtcagatgggaagatatttcaaaagtgacacatagtgttacaggggcaggttagacatctgcctctgaatttcattctctcccttgcctaatatacaataagggctgatattcagccagtatgcatcagtacagataatgttagctgttagaatactgaagtagtttcactgtggttggtaactaactgctgtttacaccactgtgcggactgtctctttcactgtccaggccactctccagaatgccccatgatccaacaaataacacagttactccccagcacaagtgaccttcaggaccccgctccatccataaataggcatcctttctgattagctagttcttgtacaagtcagtcccgcaaaatcttcccagttaaacactacctacaatcttatttatacttaattggcagagctaacattcaaacccaggcagcccaacaaaggagcacctgatcttaaggaccacattattccactgcttctactattgagacaggtttgcagcagaactggtttcacaagatacaggtcacaaagacctggcttataaaataggatggggtaaaaaagctggccaaaacttgccaaaaccaagacagccatgaaagcgacctctggtcatctttacttctcattatatgctaatcataatacattagaatactaaagtaaactcccaccagtgccataacatagtttacaaaggccatggcaaaatccttaagtcaccctatatggtctgaaaggtgaaggagaattctgggaattccttgccactttcctggaaaattcatgaataatccacctcttgtttagcatatgatcaagaaacagccataaaaatagccaaccagcaaccctcagggctgctctgcctgtggcgcagccactgtttcattcctttactttttcttttttttttttttttttttttttttaattgagacgcagtctcactcttgttgcccaggctggagtgcgatggcgcgatagagctcaccgcaacctctgcctcctgggttcaagcgattctcctgcctcgccctcctgagtagctggctgtagaaccatgcccagctaattttgtatttttagtagagacggaggtttctccatgttggtcaggctggtcttaaactcccaacttcaggtgatctgcccgattcggcttcccaaagtgctgggattacaggcatgagccaccgcgtccggctctactttcttaacaaacgtgctttccctgtactgtcggctcgctgttttccttcccgcacaaagccaagaacccatgtggcctcccaggctgaaccctagttttggggttttccctgtggcactatggcctaattaggtgttccaaatttcatcataaggactagaaaactgttttgaaagtaactgttctcagactgtgagaaaaaatttaacactataaacaatattattaacagaaactctctacttaatgaaactccgcattacctactgattatcaatttaatgggtaagtcatttgataaaatctcttttgtcaaactgtggctcaaacaggaaatttattaaagctagtaaaagctaaacaaaagagcattatcactaattccaaaactcaaagtaggatttggaaatgcttaaaatgatgtggtgaattattaaatctgctataatttataatactaatatttcatttacttgggagattaaaaataaatatctatttttatttacctactgagttatacattatttaaatcctaataacagttgacatgtactttaagtattggtttttgtatattatattattttgtatattattagcatgcctaacaaaaatcttctaggctagattaaggatttatggtctcctcttccaaagatctaaaataggtagattctctatttccaatgaccacacaccagcagtcatccacaccatattatttgaagctatatttcaccttatacatcttgtgcctatttcagtaagacaagtacctaggcaacagatgatgatcttctcaagaagacattaacactattttactcttcacaagtcatctgctaaaaaaaatttcccatggctgacaattaccttaagaaagtggcttttcttttctttttctttttttttttttaacgtttcttggcatcaagaaaaagattaaacagaaggaacaactaggcataaagagaaacagcaactgacaacactatttgctttcatagcactttgaaccattggcaggatggactgctaaagtacttgccaaatacttccataaatatacacaaaacaaaatatgagaatgtattattctgtgttgtaactcccttgatctaaaccctttagaaataaacaaaaattgagagctctgaaactgggaaaacaggaataaagaaaaaggattcctttccctgtaattaagatacaatatatttaaaatttaccaaaccagcagcagtcttccttatgatagtcttccttactaaacttaaaccctgattcataaaatagttaatagagagaacaaaacctgacatcctaccaaacgctgtaggttgacttaaaagtaattttttaaatccatgtgtatctacctacctctaaacatgacagttacggagacattttaccttctaaggagaatggcttttataatgaagccagcatctatactacattaaatgaagttatagaatggaatttgaagtacctagcaaaattcaagaataaaaaaatcatattgtgaagtctcaaacagcaaggcaactatacctttatgattttgcattctctataaacaactgatacactactaaaggcatacagaaaaggaacaactaatgaaaatgtattttcattataattgacagtctaggttccagtcttgacagagctaaaagaaaatctgatagaaataacacagaatcattttgcactaaatgtggaaataaatcaggtatctaccccggaaccatttatcttttgaaagtcctaaacaaaggtggaatagtgataagggaattagatgtgttcaaattgattcttcctcacatttccacattacaatcttacagagaagttattcaaaaactgtcaatttaatgtgtctgcaaatgttaaaggttttctgcctttatttataagacaaaattatcttctcttacacatttgatgagtgtttttatatgtatcacataggctaacaacttataaaatcttactagtatcagccaggcatggtggcttgtgcctgtaatcccagcactttgggaggccaaggtgggtggatcacaaggtcaggagatcgagaccatcctggctaacactgtgaaaccccatctctactaaaaatacaaaaaaattagctgtgcatggtggtgggcatctgtagtcccagctactcgggaggctaaggcaggagaatggcgtgaacctgggaggcggaccttgcagtgagccgagatcgcaccactgcactacagcctgggcgacagagcgagactctgtctccaaaaaaaaaaaaaaaaaaaaaaaaaaaattcttactagtatcaattatctattaagtttcaagtattatgcccaaaagcagtgaggagaaaaagccctttccctctgactatgatgccatagcaactttgagtatacataaatatctacttttaaagttctagatggcactgtcttagctttagtacattaatatatgattgtggaaaaggaggaaagccaagcgcaattgccttaaaaccttcagactaaaagttattgaaaatgaagcacaatataaatgttaatgttttcttttgttttattatagaccaggagctactgtggcttgcaaactatgttcttgcacaatactggctaacatgaaaaaatagatgcagagtgacagtatcactcttggatgtaataaaatccaggccaaaaaaaatcattaaataaaaataaagttttataaaactttataaggtaaaagataaaagttaccacgaagataaaataatcacaaatgtttacacatttaatagcatatctcatatgagaaaaaactattaagaataaatggagacataaacccacaatcatattaccaactttagcacacctctaagaaagacaccatgtaaagtggggatccagttcactcttttttttcacagcctgcaaactaaaaccggaattaatattttcaaatggttgaaaaaaatcaaaagaaaaatattttgtgcaacgaactaggcattgaaggaacatacttaaaaataataagagccatgtatggaaaaaaaaaaaaaacacagccaagatcatactgaatgggcaaaagctggaagcattccccttgaaatccagagtaagacaaggatgctctctcacaccactcctattcaacatattactggaagtcctagccagagcaatcaggcaagagagagaaataaaaggcatacaaataggaagagagaagtcaaactatttctatttgcagactttatgattctatacctagaaaaccccatagtttctctccaaaagttatttgatctgataaacttcagcaaagtctcagaatacaaaatcaatgaacaaaaatcagtagcattcatatatgccaacaacttccaattaaagaacacagtcccattgacaatagccacaaaaaagaataaaatacctaagaatacaactaactagggaagtaaaagagctctacaacaagaattacaaaacactgctgaaagaaatgagatgattccaaaaaaaaaaaaggaaaaacaacccatgctctggataagaaaaatcaatattgttaaaatgttcatactgccaaaagcaatttacagattcaatgttattcctatcaaactaccaatgacattccttacagaagtagaaaaaacttgtaaaattcatatggatccaaaaaacagcctgaatagcctaggcaattctaagcaaaaagaataaagttggaggtataacgttacccaacttcagactatgcaacaaagctacaataaccaaagcagcatggtactggtacagaaacagacacacagaccaatgaaacaaaatagagagctcagaaataataccattcacccacaaccacctgattttcatcaacgtcaacaaaaacaatcaaaagagaaaggaaaggactccctgttcaataaacaatgctggaataactggctagccatacacagaaggctgaaattgcaccccttccttatactatatacaaaaaatcaactcaagatgaattaaagacttaattatgaaacctaaaactataaaaaccctggagaataacctaggaaataccattgtggacacaggccttggcaaagatttcatgatgaagactccaaaagcaatcacaacaaaaccaaaagttgacaaatgggacctaattaaacaaaagagcttctgcacagcaaaagaaactatcaacagaataaacaaacaccctacagaataggagaagatatttgcaaactatgcatccagtaaaggtctaatatccacaatctataaggaacttaaacaaatttacaagcaaaaaacaaccccattaaaaagaaggaaaaagacatgaacagacacatctcaaaagacaacatacatgcggccagcaagcatatgaaaaaacattcaatatcactaatcattagagaaatgcaaatcaaaaccatgagataccatctcataccagtcagaatggttattactaaaaagaaaaaaaaatcagaggttggcgaggttgcagagaaaagggaacacttatacagtgttggcaggataaattagttcagctactgtgaaaagcaatttgatgatttcccaaaaactcaaagcagaattaccatttgacatggcaatcccattattgggtatatacccaaaggaatataaatcattctaccggagacacatgcacaacatgttcatcgcagcactattcacaatagcaaagatatggaatcaacctaaatgcccatcaacagtagactggataaagaaaatgtggtactatgtatatacatagtgtatatactatgtaatactacatagccataaaagaataatatgtcctttgaagcaacatggatggagtaggccattatcctaagagaactaacataggaacagaaaacaaaataccacgttttcacttaaaagtgggagctaaacatcgaatacacatggatacaaagaaaggaacaacagataccagggcctacttgatgaggggggcgggtggaaggatggtgagggtaaaaaaacaactacctattaggtgctatgcttgctgcctggatgacaaatcatttgtacactaaaccccagtgacatgcaatttaaccatgtaacaaacctggttatgtacccctgaaccccaaataaaggttggaataaaaaagtttgagagcaaaaagtaaataaaactgtactgtgttttataccataacaataaatctaaagatttagatgaaatggatcactttctaagaaaatatcaattaccaaaattaactcttgagatagagtatctgaatcatcatagaaaggattgggggaaaagtaagtctactcctaaaatgaagtactgattttttggatggtttctacctaaatctaaagaaaatataaaacagtagaagaagaaaaattttgagaaaggtaatagggctaggcttgaaaaataatgaagcatgttataaattgacagtatttaaaacaataatacatcttaaagcaaatacagaattcaaattaatacaatactatcattttgggggatcactgagattaaacaacacacttctaaataatacacaggtttaactgactgaaaatgaaaatatcaaaattttaaggaagcaggtaaagcagtactgagaaggaaatttacagcactaagcagttatattagaaaaagggaaaaagctctcaacctaagcttccatctttagaaactagaatataagcccaaagcaagcagatggaagacaagaaggctgagaacaaaaatcaatagagtttaaaacagaaaaaaacagaaaaatctattcagaaagataagctagttcattgagacaatcaataaaatttataaaccattacctagactgagaaagaaaaaaagaagaggcaagttattagggagtaaaatagatatcactacagaccatcagacattaaaaagataaggtaattactaggaacaattctacacacaccaattcaataacttgaattagaccaacttcttaaaaaacacaaacttacccaaattcattcaatatgaaataatctgaatgtcctataaactattagagtaattgaatttataattttttaaaagctcccaaaaaaatctctaggtccaaattgttacactgtaggattctaccaaatgtttaaagaattaacaccaatcctccacgaactcagaggcggaaaaaaaatgaattatttcccaactcattttatgagttcaacaatgctctgataacaaaaccagacaagacagtaggaaaaaagaaaatgacaaaccaacatccatcatgaacatagatacaaaaaactttaacaaaatcaaaccaaatccaatccagacatagagctatacatagataatacgtttggcatacggttttcccaggaatgcaagttaagtttagcatttaaaaatcaatgcaagctgggcgcagtggctcacacctgtaatcctagcacttttggaggccgaggcaggtggatctcttgaggccagcagttcaagaccaacctggccaacatggtgaaaccccgtctctactaaaaattcaaaaattagccaggcgtggtggctcatgcctataatcccagctactcgggaggctgaggcaggagaatggcttgaacccaggaggcggaggttacagtgagctgagatctgagatcacacgattgcactcccgcctggagaacagagtgagactccgtctcaaaacaaaacaaaaaaatcaatgcaatttaccacattaatagaccaattaaaaacctactagaaccaataagtgactttaacaagattatacaattcagggtcaattttttttaaaaaaccaattatatttctatatattaacaacaaaagggcaattaaaaatgtattatcatttacatcaaaaacattaaaagcttagaaataaaaatgtaataaattatgtgtaagatctgtacactgaaaactataaaatatcactaaaaaaactggccaggtgcggtggctcacacctgtaatcccagcactttgggaggccgaagtgggcggatcatctgaggtaaggagttcgagaccagcctgtcaaacatggcaaaaccctgtctctactaaaaatacagaaattagctgggcgtggtggcacatgcctgtaatcccagctactcaggaggctgaggcaggagaatcgcttgaacccaggtggcagaggttgtattattgacataaggatagacagaccaatgaaacagaataaagatccacaaatctaatgatgcatagagtaaactgattttttaacaaaggggaaaggtaattaaatgggaaattgaatttggtatttataaataccaaataaaggccaggtgcagtcagtcatgcctgtaatcccagcattttgagaggcctaggcaagtggatcccttgaggccaggagtttgagaccagcctagccaacacggtgaaaccccacctctactaaaaatataaaaattagccaggtgtggtggtgcacacctgtaatcccagctacttgggacgctgaggcacaagaatggcttgaacctgggaggcagaagttgcagtgaacaactgcagttacagttgagccactgcactccagcctgggcgacagtacagactgttttctctaaataaataaataataaaaataaatactcaaataaaactaaaaacacgtccacatagaaccataggcaaatgtttactcataatcatccgaaactaaaaacaacccatgggtctgtaagataaacggataaaaacggtactacatccacaaaacacagtactattcagcacacacaggcacacacacaaatttataacatgcaacaacatggatgaatctcaacagcagcatgaaaagtgaaagaaaccacactcaaaggctatcaactatctgattctatacatagggcttctgcaaaaggcaaaacaataagaatcagatcagtggttgccaagcggggtagaggactaactacaaaggggcaaaaggtagctttctggagtgatggaaatgtcgcacacttctcttgtagtaaaatgatcctcatataatcgcagtttcactttctctggtttcagttacccacagtcaaccgttgcctgaaaatattaataatggaaaattctagaaataaagaaaattcacaaattataaattgtactccattctaagtagtgtgatgaaatcccacaccattttgtttcctctcacccaggaggtgaatcatccatttctccagctcatccacactgtatatgctatccacccactggcgtgtagtgccatcttggttaaaggaccaactctcagtatcgcagtatttgtgttccagtaatccttattttacttaataatggccccaaagtgcaagagtagtgatgctctcatattgttataattattctattttattattagctattgttaatttcttactatgcctaaattataaattaaatcttatagatttaatttattaaaggactactgtatacattcttcaaaactcaaattatagcattttatgtaaatttaatctttaaaaatcttaaaagttgcatgtaaattatacttcaattatcatattaaaatttgatttttctaaaattgtaggtaaatgtttacatatctcccactcaacaacagtagaagcaaaaagaacttatcataataaaattgaaacaacccaaatgtgttaacaaaggaatagataattaatggtggtagaagtatacactagaatactatatagcaataaaacagaactactattatacaaaacaacatagattaaattcagagacattatgctaaacaaaagaatgctagcacagaccatacataatcaataatggtaagtcagaacagtagagatgggtaggatataaggtgtcaccataaagactgagaagagtcacaagctaaacctactgggcattagaaattttgtatcctgacctgagtggtgattataaggggagatgtatgtgggtgtgtattggaatggagctattattaaagattaatattcctatgtactttactgtatgttagacatcaacaaaaaatataatacaggaaatacttatactttatttcactttctaccttagaagaagtattgaagggaaataaaggcctcatctgctagaagagaatccttaagtcccaaagatgcactatagatgacagaatgcactgtcgtggctgtaagttcctatctcatcatcactttggtgcaactccacatctgcaactagccatgagataagagaaaaggccagatgacatatataccctacaccaagaatgcatggatgaagaatgaagttgataacaacctacaagctggttcttaggcgctgtcagaactctaggagaacaaagaagccttctattaaggcagaagacaatcctgcttcctaatatagaaaagaggaaaggattttatattcaaataacttctcccctatatccctttagtaacacattttttcccaagtagttagaaaacaagaatttttattcagtaaagtcataactggctttgagaagcataccattgcatggcagttatatattactagtaaaatatacatcttgacaatatcccagaaaaccgaggtacttgttttgatagaaaaacatgtatcaaaattcacatattgataaatcataaaattactgttgctatgctgttctacttagaatttcaaagtaatctatcatgtttctacatcactgtaaccaatataagtaatctagaacatgttaatttaagcatataatttataacttattaatgacaaaactttgacatgaacatgcaatgtaaaaggtagttataaaccttgtaactatgtgagttaatttgaagaaacaaagtatgccatcaaagtaacatttcaaaatgtgtaaaggtgaaacagagacatttttacaggtaaacattttatatatatatttagtagctgccaaactcagggagcactgggaaggcctcatttagatgttttacctaaaaatgcatatgacacactgttctctaccctaatgtaggcatgtagaccctaaccatatagatttatagacccagaaaatatacataggtacctcttcttggaaatggcagattccactctcaaaattgagtaaggatagcaggcatctacaacaatcccaaacacatgctacttagatgagatccggatactatgaaaagttgccaaaatatgtcacttaatggccaaacatgctcctaataaaagtttactgtagtgcagctgaaaatagttcaaaattctttggcctggacaaatactgttaaatttagataatccagtgctaccacacttgactggaatacaacctctgcaattcttcaagtttgttatctctccttcacttgcctttgtctctgagcttattcatcactcacaacatgtcacgtaacacagtaaatcttcctctgtttcctggaatagtctatctgaagagatactctacaagtgttttctggtaagagtcataccttaactaaaaagtaaataaattcacaaagctcagtaatgaagatgaaaataatacaaataacataaaatttaaagaatctttattcaccaagagaaggaaaatatgaattatgttattactaaaagaactgtgcacttaatataaaatctacgtcttaactaagcccatgtaattatttatggagtgcattattacgtatttctctaacaacaacaaaaaaaccattctatcagtcaccccttcctattatactgaagtctgcatcttgaccctcaaagtttatattatagaagaaactgtttttaataatctaattatttcttcaatgtgtttttgttactaactctgtaagctttttgacatcctaatatgatttactgaaataacaattcaagtaaattgagttacttgaaaggtaaaagaccctgaaaaaatgataaaaagaaactgatgatataaatatatatataaaaaacatcttaagaatgcatatgcatgaagataaagggaactcaaagtatttctgatttccaacatgctaaacaactaaattactattatctcttttcttttggagggagaaaaatttttcctcttaaaaatcaatccagtttatatatcatcggttagtattatcatgtctttaaaaaattccaacaaagaaatgagccatgcatgcaacatgatctcattacaatcatagtacaaaagtgaagagaagaaatggtttatccaagacagacagtaacttactttctttaagcaaatcaattagaagattaggtaaaacaaatgaagcttaagtattcaaattaaggttaatcatggactttacttataaaacaaatagaatgtaatgttttccaagcattttgttgctataatttactttttaaatttttagatgaaatataaacagaatttaatgaatcaatcccttgtaattaacaaaccagacaataaaaatggaaaaaaaattaatgatataattgacaatttatgaaacaggtatctatgaaactgaaataaaagaagtttatcaaaatgaagtacttaatacaatatggctctattttggatcttgcccaaggttatgaatagcaaatttactacactatataaccagcttctactaaaacaaagctatagtacaggtgctaacattttaatttattttaaaaatcagactaacaacatatatttaatcaagtctttatcatattttactctcaagggataaaaatatttgatagtcatgcactgcataataatgttcctgtaaatgctgcacccttaagattatacctcattcttactatatcttttctatagatatatttaggtacacagtaacactgtgttacaaattgtttacagtatttagtacaataacattctgtacaggtttgtagcttaggagcaaataccatatagcctaggcgtgtagttgttagtcggctataccatctaggtttgtgtaagtacactctacgatgtttacacaataaagaaattgcctcatttctcagaatgtattcctgtcattaagtgacaaatatgttaagggaccaaagcactgcctacattatcttgaaatgtagcaatgaatttttctaaaaggatataaaagaaactattttttacttttttttgttaaattttattttaagttccgggatacatgtgaaggacatgcaggtttcttacataggtaaacctgtgccatggtggtttgctgcacctatcaacccatcacctaggtattaagccccgcatgcattaggtatttatcatgatgctctccctccccccaaaaaaagaaactactaaagggagctatcttgaggggagagggagcatgcttttactttctatcaattgggatttatctgacttttcctaccatttacatattacttttttcttttctatctgtgcagttatgggtcactaatgttttcttcttttatatgttaaaaatatcatttttaaaatggtctcaggagtcaacaataatctcatggtgaaactgttgagtggagttcagacagctccctgtatatgtataggtcataaaacaggaacaagttgattgctgatgccgatgtctttttttttttttttaaatctccagagtccagttcatcactggcctatagtacacaattaacaaaaagaggatgagtagctagaacaccctagggatatttatcagccttgaaaaaaatccaaaagtatttccaacagcaaaaacaggtactgtaattagcatactgtaatagtaattatggcagtggttcctttcctgtatcatgataagttgggtcttattcatttgtgccctgatactcagcacagcacctgacaatgtttattaactactgactgatatgaaaatttggagatttctacagaaggttaccattttgttagcaatgatatgtgttaacagtaagaaatatctacacttaaaagattatagctcaaagatcagtatgcaaacctatgtttgattaaaaatcatgctttctggccgggcacagtggctcacacctgtaatcccagcactttgggaggccaaggcgggcacatcacgaggtcaagagatgtagaccatcctggccaacatggtgaaactccgtctctatactaaaaatacaaaaattagctgggtgtggtgatgcacacctgtagtcccagctactagggaggctgaggcaggagaatcgcttgaacctgggaggcgaagcttgcagtgaaccaagatcacgccactgcactccagcctggcaacagagcgagaccccatcttaaataaataaataaataaataaataaataaataaataaataatgctttctgacccttgcggtctagcctcatttcagtcagacctagggaaacttcaactaatctgcacaactaattttagtttgctattaatatagagataaatttgaaagacagtcttcaatggccatacttcgttctattttggaagtgtgaagtttcaggagcatgttttcattgtctaacattcattatacggactcatacttatccaaatattgaattttgggttatgttactttttcaagttagctaagggaaaaaaaatcaatgtattaatactggagtcaacaatcaacttttcagatatccatagtaccctcaattaagcaataagcccattgagaaaagaatacattaacggggcagccttacaaatgactttgccaaaggcatcctcttgatcctaatgttggtcctggagcccactcatcacctttgaccaactgaagggcaaattaaatcagcagatgatgagatgttcatgcccttttgctatgctatgcaagcttttaatttggagatgagttaaggatgaagtatggctttcctgaaatatagcaaaaccatgtataactctcagtagcgtaattaagttgccagtaaaaagttacaatgcttacatatcaggaagttgggtttatttccactggaacatttttacatcttttgctttataaagtaaatatgaattccacatatcaaaatctattttcataaccttctcaagaatgtatctgctgaaaaatcaaggttcagttctaattttactctacaaacttaaagagggctaactgtgtaactgaagcatagaagccattatgttttagaggttctccacctgaagcaatcaagaacctatcttaaatgttgatattatcaaagtctttaaataaaagctcagatctacattaaggtaggattacctccctcatccttagagcaggagcactgatcaaaaagccacttgatcttaactaaaagtgcaatttctttagttgcttagttggtacagtcatgtcactcaggatgtttactaattcagagtttaattctcaccccaaaaatgtataattttagctcattttctcaaagaagtttctctaattataaggaaatgtaactgaccaaatcttgaaaattattacatttcaaaaacaaatcaaattcatttacaagcctgatcagccttacatgaactaatgtttaggaataacaagtttacagaaccaagagaaaaaagagaatttaacagatttatttacatagatggaatcacagtgttgttttttaaggtttataatggcaaaaattatatcccctgatattcaataagaaaattcacaaattatggtgtattatatgccaaactcacatttacatagtaaaaataagacattaaaatttgtaacatatatttttaataaacagcacacaaaaatgcccaagcatatttaaaattattctccaatgaacaggtaatgttttagggttttttagagtttttaaaagcttaacatgcctgaagataaggactttttttttaagtgcattccttacctaatagagtgcctgacaaccagtaaaccagtagtttaaagaaatgaattaagaactggcttcttgtgaaatttacatgtttaacaaaattagctaaaattaatagctactttcaaaataaccacatttttcaagctagtttagtataatcagaacatttgggcttcaaagagactttagaaattaattcgatctgccttccatttatttacgagaaaactacagtacagaaagattcattttctgaaaatcatagagtaaggtagagagaggacaaaaaaatgagaatgacagttccaattcaactcctcattaatattccttgaccaaccttcaaccactccaaaaatctcttatattatggttacacaaaactatggaatgccattgttttggactgagacttaatagcccacgccaaaccacaatgcagtcactctggtttgttttgggctgagtcttaacagaccagaccaaacaagaatggagccactcctgctaggagccacataaccaaactgaacttcaacatcaccaagttttcccaaaaaaaaaaaaaaaaaaaaaaacaggatattcacagcaaccaatcagaaagggcccagtttacctgaattagcatgataaagaagtctgttttaaccttataaggaaagtaacttacaataaccaattcactttttgttccttctttctttagcctctttctgcctagaaagcccacctcctccacttagctcatctgatggcctatttttatagagacactgcccaattcatgaatcattaatcaaagccaattaattaaactcaatttgttgaaattgttttttgatgttacacacacgtcaaagtgtgaacaagttaaagaattaagtgcaagaaaaatctcaacttttcagaggcaatcattagggacaaagaaaattagtttatctaagtttctgagggcctttattctctcttctttcaacttatcctttttaagagttcacttgtaatagaaaaataatattctaaatatccattaagtataaaaatatcttattgagccttctaagggataaacagtgtgtagagcttaaaaaaatcaatcagtctctattcatgaagtttatggcaaggaaaataaatagacctatataatataaaaagtcccccaccaacttcagatttatctgacttttctgaattataagagatattcacttattacttgtataattagaaattaagaacaagcaaaacagggcttctccccacctacttctgaataatgaaggagttctataagaacaagacagtaaggaaaataattcggatagaagaaataacatataatggcagagttgtcaaatcgttatggtaggcatacatggcaatggacagatcaggaacgatgttttatgtaattctgtaaagagtgggtttttcatctcgaaagagaaatcaataaaaagttctcagcatgtgaatgacaatcaaatgtgcacttggatatcagagtaaaaactgagtaggaaagagtcacaacgaagggtagaaaaactagttaataaacgtctatgaaagttaagaggagagttggtcaggctatgagaacaaagacatatttcacaatctgcatttggtttctaagtgaatggggagtctggcagaagacagaaaaggtatgagcctccaatttcaattttgtatcaaaatcagtgatagtgccaccacaaagtttgcgaatgcgaggagctcaaagggctgagatatcaaccacaaagataagaaatttaatatgtctggagaaatactacaatcattaaattgaaatagaaccttcttaacaatgtaacagcatcatgatcgggaccctatagaattttgaagcaagtatttggagacctaagggttggtttttgttgttaaatttgttttgtgatgtatgtgtttccctttgttatttttggctttggttctgtccgtttcctttgtacaaaacatgcacttctcttagaagtcatactgcttattattacacgtgctcatttgactctcaattgggaatttctttttctcctggtgttatcttgcactagtggttaccttctaaatgttaaattttcatttccatattatttgtatactgataaaccataatttccttgaagccacgtagcatgctatagcatttctatcacttagaatgtttaataactttccaaaatttatgtagacctatatgagtccttttcttaatccatctggcctctcttaatgtcaatgctcttctccacccctcatcaagatgaggaaagagaatttgcccagaattcagatatttatgaaaaaataaaatgtttgggtctccaggttatctggcaaatcaagtgaaaagtgaacctacctcccccaaatgacccctaagctttataggttactttatcactgggttatatcaacagccccccaactccagttgatgagtaaatcttattttcttttccctattgccctatggagagaatttccatcctctcaatctcagaccactaattcttattcgcagttttgcttagatgttttttgaaccagtccttccctacgtagctttaaaatttaaggcagtaattatcaaaccctcaagtaccctcaagagataggtaaaatcttcttcctgggtgtctaggagatctaatctaaaaaaagctccttatctttgatgtattgtgaacattacaaaaattgattcaaagcttgcattttactgtatctctgtctaaatattaaaatgctttaatttagtcatcacttatattaacttctggtcaaaaatttccaaaaaccgattctattttgaagcttcttcgccctccggatacaccactacagactggagtttaaatgctcaatgtaaaagattactacatacatcacagtgcccttcacaaaacgttagtaatatagctgggcgcggtggctcacgcctgtaatcccagcactttgggaggccgaggtgggcagatcacgaggtcaggagtttgagaccagcctgggcaatatggtgaaaccccatctctactaaaaatacaaaagttagctgggcgtggtggcacacgcctgtagtctcagctacttgggaggctgaggcaggagaatcgcttgaacccgagagggagaggttgcagtgagctgagatcgcaccattcactcggggctgagtaacagagtgagactccgcacccccttccaaaaaaaattagtaatacttttgaggaacacatttaaaatgctacaaaactatataaaaacaaaagtaaagacatgaactcatgattcagttgaaactgaatactaaatttcatttagagcttagtaaaaataaatttgtaattattttcccatccaagttcaaagacactttacccttaagaatccaccttctaaaggaaaaaagaaaataagtgctaacactaaatgaacactgttgcaggatctctgataatcactatgtacacttcatgtcattaaaccatcacaaatactattccacagattaggctgcttaggaaagttatttgtataaagccatgtgaccaaaaatacattcaaactatagtgtaactccaaatgaagactgtgacaaagcacctcaaaaaaattttctagcctctagctgaggaatcattgaggaacactctactgataacactataactcattaatactcctattaaacaactttctgtttgggcaattaaaaacaatgttcagttaaaactaaaatctaatacttcctagagttccacatgagatcatcaccatcatcgtcatcttcactagctaacccaaaggaacaaggtaaacacaaaaactccccactcttgtaccaatctaaaaagtaaatttttgaatccattttccaactgtgtcacacacagttgttagtatccttctaaggtgtgtatatgcctatgtatactttttaagtaaacttataaacatgtggtaactagggcatattttattctgtctacggcagcttcttggtttatccaactaagtattactaattctattttcttagaatgagaagttctcagaacaatgatctatcacctaaatttcaaatgaatgtgtaactggtagacaaacttaaagcagactttctaaaactattaacagtgctcaagaatgcatctatttacatcttaaaaatttctcagttactatatgctactctaatgaaagctatattcaaattataattttttcccacagcatgccaacagattaggaattataaacagacagatctggatttgaatcctgtctattctttagcagctggttatctctgacaaattactgtaaacctcgttaggcttctcggttttgtattatcaatcatcattggtaactgatagtactgagagatcctcattatgtaaggattgaaagaaaaatggttgtagcactgagaaaagtatcaaacattattctgcaatttccttaacttgggttttacttttaagttgtaaattttcccttggcaatgttcacaggatatctttgctaaaatattatttttcagttagttttaagctgactctttaaatatcaaatgatttgctctagagatggattttctttctttggaagaagccaagatcatttccatttaagggcatgtaagcagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcatttttatagtaattttcaggaaagcaactgctagattaaatgaggcacatcctttcaaaaacattacaaaacttaaatttcaacacatcaaacctataaagcctcattaactgagatgtaactgatttggaatctgtaattatttcttttttgccataaagttgcccttaatactgcatcagtttattaaaaatttggtaagattgtgtaataatttaatgcaattgtttttaaaaaatcttaaatacttaaagtagcatattgctattttgggggtgttgtatgtatcagtttaaatataagtattactattcacaaatatattgttaaactgctaattgaagaaaacacaaatgaattaaatacatttattagttctttaactgtaagataaaaataattttttaaaacaaaaagcaattagcctgattttctcatactccttctcccatacacacaagaacaagaacaaaataagaaaacaggtataaaattttattgtgtaaaaatatttcactttcactaaaagctaacattatgaagacacgtattaaagcaacagcagcaagaattcaatgaaagttgttttgcttatacctgtgtttatttttctcataattaaaattcctgcagtaactattttagctcttcaacatcttcaccattaatattcaattatctctaagcctgaagatgcatgaatctttaacaaaagctttccaccacctcaagtttacttatttttttcatttatctaccatatactgttttaaattaaaaacaaaagatgaagcacaaagtgttaatgacttttccatacctaaagtaagaagttctaaagtttggttgtgataagactgagactgtggctaaccaatcgaaacttcagaattcctatgtgacatcataagacctccctagaacactttttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactcagtggggctgctctataatacacttacaattgatactaacgataaaacgctctaattatagttttaattttataggggtttttttggtgactttccccaaataaaacaaaatcaagacgcccaagtccagacacacaagagggcagacgtatataagataacaaattgctactacatagcgattatttatcttttgattatttttgagacttctggcaaagtaggactataataaattttcagaaaagatctgctcttctgctaagtaacagcacacttcaaaatgtccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatttcatgttagacaaaaaacaagtcattttactttaactcattttatcaattttttttttttaaatcaagagacagggtgttactctgtcatgcaggctggaatgcagtcacatgatcattgcacactgcagccttgaactcttggggtgcaaaggattctccaaccttggttcccaagtagctggcactacaggggcacatcaccatatatggctaattctttttattttttgtagagatggggtctcattgcccaggctggtcccaaactcctatcctcaagctatccaccccccatcagcctcccaaagtgttgggattacaggggtgagctaccatgcttggtccaaattttttgtttatacaagggaaaatctccagtaaaatatgtataggtgccaataccataactgttcaaacacccttatgactaaataggcacaaaatttcatctttttaatgactgccacctgaagttcagaaacatcctagggaaaaaaggataaacaacttcatcaataaagaggctactattatttcactactgtctgggagatccatcgtgggcttacaggaatccaaatggatactgccgttacgtgtagaagtgtttatcctccatcccttccaccctaccttccccaagaaaaggaactcaagggggccatggaaagggaaggagtcttcccaaaaagaccagactgtttttcctcctctgtcatagtccctatagagtcaggcagcttaggggttgcagggggtgggtagcataagtgtgatgtactaccgaggaaagagtcaaagactagcagtaggcattacacatggagccttctgtcataaaccatctgagggcataatggcttcttttcattcacaaaggaaaatgattcagagtactacactcctgcactcttgatgatttagcagaaaaccatggaaatcaaggaacaacacacacataagaatgtgtgtctggctcaataattattctggactaagtcctaggaagagcaaaccttcaatgttacaaattaacctggggagtggggagctgtgagaatcaaatgagataaaatactgtgaaagctacagaattctataacatataaatctaaggttttattagattatgactttcagccaaattccttttcttagttgtaaaaatattgttttttcatggtgagtgtttaggagttgtgcttgcaaatcacaatttatcagacggcctggtccttattaaggttcttctctttatgtaaaaattagactaaaagaaaatcagtgtttctatgatttttatcttttttcctttttagagacggggtctggccatgttgcccaggctagtctcaaactcctggactcaggcaattctcctgccttggcctcccaaattgctgggattacaggcgtgcgctacagtgcctggccagaagtcaatgtttcaaagaggcttttaagaaacaactatgatgaaagcttttaaaataaagataatactacttggaggctccaagaaggtatttaacaacttttttctgtagttttctaaggaggaaattagaagggaagcagtcatttaatgattacaacttagtttgtctagttttctttacctgaattcatctttctactccaaaacttaaaagcgctataaagagaccatcccaaataaagttaatcaagaagtagggctttccagggtatatgcaaattttgctctttagttgccttctctctctactatgcactagaaagaagatttaaaaacaaatttatctcaacagtgtgtccccaacctccctaccctcctctgcattgctttgaggctaagaaaaacaccttgtttaaaccagagatttgtccaagcagaataaaaagcatgaatcagtatttactccttgaaatttgcccaattatctctatcacacctactctagtttggaatagcatactcagccccactggacagctccaattctgtgtaaagacaccagctggagaaacaactgcctggatctctgttttcctataatgacaaacatttgaaaactaaaacttgacagtatttgaaaaattaggtttcctatttttcatcacttgaatggataaatcacaaatttctaattcaatcataatgattcttctgttttgattgtgttgtttaaatacataatcaaaattataagaactgtatctaaaataagaataaaggtacatgcgacatgttaagggttctcctatgaatgtagtatgttagggttctatgttttgagatcatactcatatttgtgaggttcctggacaagtgatttccttatcctttcatagcctatgttcatttattctatttgtttttattagtagtagtaatgaataccaattttacatttttactctagggaaaatttgcaattttttatagaattaatttgtttcagaaaattctgatgataaaaaacagatgacaggacttatatcagaaaattagtttccttgttaaaacaagctacagaaaattgtcttggaatagaaacattcccagattaagaaatttacacatttacatgctattccctagaccaactgggggctgtatactatttttctttatatatgatatcatcataaagcactttctataagctgattaatgaatgccttgacacataattttttttaaaaaaaagtacatctgatttataaacctaaataacatcatgtatcaccaaaactttacaaatgactgtagttccaccttctcattgtacagatgaagaaactgaggcccagagaaattaagtgaaaaagtcatccacgttctaaatctaacagaaccagacacaaaatctaagaccttgtatagccaagttgatgctctttctattatacctatgctagcttttttgtttctgtttccaagtttatttagattgagtatgttttgctttatttttatgcccatttaacaaatgaaaaggaaagaacaagctaggtacaaggttttcagattttcatgttaattagtctcaaatgctttgcaagtttatcaacaacacttttcggtttgtaacatttctgcctattaacttgcagggaaaaggaaatgcaaaacaatctgtgaacacttgttatatgcttactgtaagtgtgctactgtactcataacatccactggagggaagcaaacactagattttgcaccttacctgcattggtgtttcacttccttgtcgaaagtcttcaatttgctgctgttgccaaggagctaaactgtaagaatcctctgtatttctaccttccaaaggatttgtccgcagctgctctgtaagccacatctgagtccttacggaaggctgaatgggaactccacctactgcctgttgaccaagcattaaatattttggaggttcaaaagcctctgagcttgtcataatgggcttgctttcaggtaaggcactatatgtcatgtctacaggctgtctcctaagagtagaggaagaggctctaaagtcctccttgctacagctctcaaatttatacttgcagtccagagttgatgaccgttttttatttatttccttgtcctctaacctaagcatctccatactatcatgtaaacagctaggcccaattgtcctcagttgtgatgttaaagccttagccttccctatcttctccaaaccattccttgactcttctctgcatacagtgccaccctggccacagttatccggggcagtgagtttggataaagatgaccatttccgaagtggccggaagtccttcatgtctagggaagagtcctgctcccccctactgtggtttcccaatgtttgcatgaggcttgtactccattttgagccatctggtgtcaatgattccctaagtttggaaattgaagcgctggaattagacggcatcacatgggcagtaggaagagtaatcaatgattgactaggcttaaaagataatgtgccacttgaagttgaatgatctggaaagaaaaaagatggtcaaattagttacaattaacagacaaaagagaatgaggtaaaatgcaatatgccaaaagaaatatctgaacatggtttcatagcacaagcttttttttttgagacgtagttttagcttgttgcctaggctggagtgcagtggcaagatctcggctcaccgcaatctctgcctcctgggttcaagtgactctcctgcctcagcctcccgagtagcagggattccaggcgcctgccagcacgcccgactaattttttgtatttttagtagagacggggctttgccatgttgggcaggctggtctcgaactcctgacttaaggtgatctgcctgcctcagcctcccaaagtgctgggattacaggcatgagccactgtgcccagcccagcacaagcttttcaaaaagacgtcctcaaaatgagtaaattattattatccttttatctgaaacaagtcaacatagtttcagattggattttctaaatatggatacctaatagagtatatggcctttcaccatctactgtacttacaggtgaaaagtgatttaaaataggtttatatttaccctaattaaagtattgtacctttaaaaggaaaaatccaactccttactgagaggtgttattcataatccagcaatgaagtctcagacacaactttgtcagaaaaatggtatttttcagtgtctttcctgaactgtgaaaatctatgccagatctaaacattttagaacctccccaaactctaattcaaatgagaaatatgagtaaaggtgctcctgcaataatgaaaaatagtcccaaagggttcacttccagtctcatttaatggcatatatatatgtgtgtacatatatgtatgaatatatatgtatgtgtgtgtgtgtgtgtgtgtgtgtgtgtgtgtgtgtgtgtatatatatatatatatatatatatatatatatatatatccatattcaccccaagctagaaccttagagtctacttttattcctttctctctatatttattaaatccccaagttgtacatttttacctccaaaatagttgagtttctattactttaggtcaggccctcacatcatactcttctatacaaatgaatagttttagcagactaaatgaaaggctgaaagataaataatggcttaaatactcaataaatttaccatcaagtgccatgttatcatcatatatatcaaattaaaaccaaagactataattttgtaatcaagggatatctagaaagggggtagcaatttaaattggtgtgtggggaggaagtaagcgatggagacctttgcaatttattctgtatctccccacactgtttgactcttataccagaagatacttattacttgtattctcttacattgtcttatggaaaaagttatgttgataaagttgtaagaaaattcagattaaaacgagccaggtagactattcaaaaaataaaattccagtgggtctttgcacagaatgtgttaacttggacatgaaaagggaaaaacattacaaatgaaggaatataaacagaagtattgtagtggatagttatcatattcaagactgcctatcagcttctgaagaaacttcctgcatttaggaaaattctcacattactgactccaaccctcccaaaatatatttcagacctcaaaatcccagtacaccctgaaactatgatgcagacattcagaggcagcagcacaagattgcagttttggaagtaagtcacatgataaaatggactcggtgtggagctaccatttttgggtgatacaggcaacagcagaggcatcacctttccacaacagcagtgacagacgtggccccgtagtggctgcagaatcaaaattcctatcccagaactggcagcagctagacagcttagtggtggaagactgacagttctcatatatgatttgaggcatattacttggaagcttatccttaagcctggctctccagccttcctaaaaattctgtgaagcaccaaatatatttaagtaaatttcctatgtgctcaaccagccagtaaacaacttctgctgactgaaaacactgaatcgtccaatcatgaagccaaaagaatgtggctgtataacaagaaaaataaatccatgtatctacagtatggagttaaagtgccaagaaaagttgtcaaggtaactcttgataggtaaaggtgaagcagaattatacacatcttcaaacgctctgctaagtaaagagcctggccttcattcagcatgaaatgtggtatcactgagcttccaaacaaaggagtgaatgatatgatcaaaaaaattgtacttaagatgactgattattctgacagcagagttgccaatggattaaagcaaaacaactggcaaacacagtgattaacagactattctggtaatcaggagaacaagaaaataaaggggaatatgctactgagggttggttctaaatagaaacaggacagacgtccccaaaagtttatggaatatttgtattcacatattatagcattatatatattttacatatatttgtattaatattactaaaggagtagttatactaaaatcatcatagcctctaaaagatatctttaaattaaaaaaaataaaaaattagtcttgtatcaagttgcaggtaaaaatacagaccaaaggttaagtataacagttttaatttcaaaactattatatagagtaaaatatagggctgggggcagtggctcacacctgtaattccagcaatttgggaggccaaggcaggcggattacttgaggtcaggagttcaagaccaccttcaccaacaataatgaaactccatctctactaaaaatacaaaacttagccaggtgtggtggcaggcgcctgtaatcccagctacacaagaggctgtggcaggagaatggcttgaacctgtgaggcggaggctgcagtaagcagagattgtgccactgtactccagcctgggtgacaaggctagactctgtctcaaaaaaaaaaaaaaaaaaaaaaaaaaaggagtaaaatatacagccttttcatggcacatgtatacatatgtaacaaacctgcacgttgtgcatatgtaccctagaacttaaagtataataaaaatatatattcaaaaaaataaataaataaaaataaaaaaataaaaaacatacagcctttttagattcaaattctggctctatcactcagtagttatgcatgctcaaacatgttatttaatagttagttacctcctccatacaatggagatgacaacagtgagaattaaatcaaaacacataaaatacacagaagaattcctggcagaaagcaaaatgttagttattatgatgtcattaaaaagctacaagtaaatattaatttcaatgtaacagacaaaggctaaatacccatacatataaagagcttcaacaaatcaacaaaaaaaaaacctagcaactcaattttaaaataggccaaaaaaattcaataagtaaataaacaagaaacacaactagagaatatatattttttaaaaatcctcaaacgcactaatagtaaagatacattctctatcatattcagaaaactattaaaggctgcaaatatactacagtaatgggaacacaaactgttatagtctttgaaagaagggaggcaatttgtacatatcactgtttaaaatatgaatacacatatgtgaacatacatatctagatatgtagatgcgtgcatatctatatataaatacatatacattcattagcagagaaaagatccgaaagaatacacacaaaacttaataaacaaaggtaacctctacatagtggaaagggggcaaaaggagaaaaatacttccacattttactttatacaatgtcttattttaattgcttccaaggaatataacttgaccatatggtcaaacttctgcaaaggtattttgttgttctgtgacctcaaaagagtttaaaatacttctaaagtatgaataataaataggtaattgtctcactttccatatcacagcggaatcctctaagacccagtttggctgcttcttgtatccagtaatgggctactttccaatctgcctttactaactcagtactttccaaatgcaaagaaaaatcagcaatgagtgaaaaatcaatttcacatcagactagtgtttattccctaaatctgaaagcagctgatatatgctgtccatagactatgatactgaatatagaatttattcctaaaattcccttattacaaattctcaaatcttggcataaaaaaagttgcctgagagctggtgccctactccaagagattatgatccagtaagagtagagaagggcctaggaaataccacttctaaataagtgattttgctgcttcatttactataacatcattccatatgggtctgattccagttctgaaggctttaagcttaaatatcccaagttcaaccataaccagtatctgagttctagtgtaaaatctgattaactgtgacattcagaattcattactgtcaaaactaaggatcaaagcttagtctactgacatacatatgcacacacacacacatgcacacacaacatatgaataaatgaaaaaagaattatttgaaagaattaaatatttagtatttataagagaattaaatataagaattaaaatttttaaattaaatatttaagaatatatgaacaaagaatattttcccccagtatgaatatctaggtgggaaaagggtcattattataccttagaaatgagtctagaaaatgttaactttaacaatttcaacacttaaaaatgttattttaccctgaggaaacacagttaattagaggtagatataatgcaattcctaatgtgcttgattaggctacctaattgtagccacaaatcccaaatgcaagttattactatctatcccacatctaagtcacaacagtgatatctgaaaccaacagagggtagtccttttaaaaacaagaatgtggcttatagcattgacagtaggcatagatgagctaatggtttcagacagatttaagttttaaaggccagaatataagaaagggacgctgatatagtctgataatgcaagtgagttgtatttaagacagcatatttctcaattccaaacaaaatcccaatcttctgtttcgctatcatgttattctcatctggtattaaatgaaaacattgattctatcttctcttatatacagggatggtatctctctctctctctctgtctgctctatccttctgatagtaataaggaattaaatgcaaaaaaagaccactcccaccctccagatctacattaaagaataaatcatcagtcttcacagtttaaaaaataatcagtaaactatataaccctgtatcaaaacactgatttaaaataacattttcatacttatcagtcaacataaaatattataacaaatattttattttttaaataaaattgttaaccctaaccacaaaggcaataattttgttttgttttgttttcttggagacagttttgctcttgttgcccaggctggagtgcaagggaacaatctcagctcaccacaacctctgcctcccaggttcaagcgattctcctgcctcagcctcctgagtagctgggattacaggcaagcaccaccacacctggctaactttgtatttttagtagagacggggtttctccatgttggtcaggctggtctcgaactcccaacctcatgtgatctgcccgccttgccctcccaaagtgctgggattacaggcggaagccaccactcctggcccaggtaataatttttatacaacacaatgagttttttttcccttcctgctaacgccatgatcatatcatgttacataggaaaaaaaaaacatgttatgccacatgtaacccattctttaaaaaaaaaaaaaaaaaaaaaaggtgtattcctagcactttgggaagccaaagttgccaggtgacgaggtcaagatatcaagaccatcctggccaacatcgtgaaaccccgtctctacttagaaaaaaacaaaaaacaaacacaaaaaaattagcagggtgtcctggtgggcgcctgtagtcccagctacttgggaggctgaggcaggagattcacttgaacccgggaggcagaggttgcagtgagctgagattgcgccattgcactccagtctggagacagagcgagactctgtctcaaataaataaataaacaaataaataaatatttcaaagtattctctatatttttaggtaaatatattttaatattctaaaccacacactgctaggagtggggctatataaagtaattcatctaaagagtctcctaggaatgtatcatgtacaaggcattatgctaggtagaaaagacaatacaaacatattaatctcaataaaaatatgaggccgggtgcggtggctcacgcctgtaatcccagcaatttgggaggccgaggcgggcagatcacctgaggtcaggagttagagaccagcctggctaacatggtaaaacccatttctactaaaaatacaaaaaattagccgggcgcagtggtgcacgcctctaataccagctactcgggaggctgaggcaggagaatcacttgaacccaggaggcagaggttgcagtgagctaagactgtgccattgcactccagcttgggtaacaagagtgatactccgtctccaaaaaaaataataataataatatgaatcaggccttcccctaagggcttacatttcacagctgcagagcaggactaaagctcatgaagaaactgcaaaacatcagacaatgagaagtggtgagccatggagaaagggcaaactattaataaaacaactatcaatgatagccaacttctcaacagcaataatggaatccagaacacaatggactaatatcttcaaagggttgggtaaataactgacatccaaaaattgtttttgcagggaaactaaactgtctttccagatagaaaaatatattttcagctaagcaaaaacagaatttggagactcactgaaagaactgctaaagttccttgagtttatttcagaataatgaataatgaattctgagttgaaaaaaggaagagcaaagagacaaatggtaaacttgtgattaaatctaaaaaacagtaacaatgcatacaacaataaaaacaatatctaacatgtggttaaaagtaaaaatatatatacttagcaaccatgacatataactcacaacaggggtgactggtattccaacgttttatagtcctcatatttaccagtagagaataaagattctgattaccattatagatagatgggtatatattataccattatagatgggtatatattataatttctatattaaaaaccagaagatacgtagagatggtgtgactggatagccacaggcaaaagaataaagttagacccctatttcatagcacccatgaatattaattcaaatgaatcaataggcctaaatgtaacagctaaaactataaaactcttagaagaaactaaataaaattcataaaagaaatcttcatgaccttgtacactgtctcttagcaaccattaataacaaactaagaaatttattcttatatgcttacataaagcaagatgaaaagctggtgttaaggacaataagttcttcttcaaagctcccttggtctcttgctttgtacacagcccttcctgctcaatctgtaatgagcatgtgttcctcagcgtaatctgtaactagcaaacctcttactctgtaaacaactctttgtcagcccagacatgtccagacatgccttgaacttgttctgtaggcaactcttcccaccttagcaacaatctcctcctcccctcctctcttagcaaattgcatgttcaccatagttagaaaagtttaagtcttagccagtcaggttagtttagatggtttggtccgaccccagccaatggggaaataacacagaaacaggaactgcattagggataaaaacccttctctcctttgttcaatgtgctcttgcgatcgttactgacgcaggcaccacccttctgcagaagtaaattgccttgctgagaaaacgttttgcctgagtgctggttcttctttgtagcactgagcaaagaattacccatctgggatatcattctcctccgggaaagggtctccaatcacctctcataaggagacatgtcctgctgcctcactgcggtggcctcaggggtaaggaatcagaacccacccagtgtgaagaataaacctggactctcggcaacacaggaagaaaaagcctacagtacagataccacggcgacaaggtaactctgtgcacagaccaaagtaggaaaagccagggggcagcaggagtacttccttggtggtggggacatcctggaggttgaaagtgtgtgaatgagacatacaattaagtgcgaagcgagtgtggagtccagatccatggttccatggtcacctgatatgccttagggtagctttcctgtcgagggtttataccaacctaaattcctgcgagggaagtgaccagagaaggaagaagtgaaagcaaaggagtgcaagaaacctccagttggttggggggcgggggcagtggtgagcctctagggaaaaggtgcaagaaatctctagtaaacagaggttgagccccatacacacacaagaaactcgagttgagccgtagagaaagggtgcaagaaatttctattaggagaggttgagctccactgactcaggaaaactcaggaagcacctaaaacttccaggatgggaaataccccagacaaggcagggaatcaaaaggaaaagacagacaatataattccctctgatagctctctaggtctcatgttaaaatattggagagaaaatgaaagcaccaaacataaaaagaagcaacaaataataaaatattgttgctttatttaaaccaaagaacctactctcaaacattcagttttctggccaaggtttgaatccagttaggactggatttgtcaacttttaatagaatatgtcaatgacaaaagtcctgtttcccaggaggaaataaactatgccctgtgttggcggcaagtgcctgtcatcctatatcccctaaaaactacaggagacaagccagaaactacttaccctttagatcaccttcccccgccaaacacctctaacttccctccccacttcaagcaaatgcagaaaaaattaggagctgaagaaaacacagaaggaaagtgtgtattaccagatggaagggaaatgttgtctaaacctcttgagagaaatactgtctcagcttcatcaaggaactcattggggtcctcaagctatatgtgatgcagtccttagagtctatgggtacataggaatacaaaccctcgctaagcaagtagtggatagttgcatagtgtgcagaaaaactaatgagtaaaccctaaaaaaaaaacctcccgggggaagaaatccagggttaaggccatgccaaagcatccaagttgactatactgaaatgcccccaacaggccgcctcaagtatttactagtaatagtagaccaccttacccactgggtagaagctctccccttcccaaggacaacagccagtaatgtagtcaaagccctgttagaacatatcatacccaggcactagaaataaaatgggaatattatactccctggcatctgtcctcatcagggaaagtagaaaaaaaaatgaaccaaaatctaaaaaatcacctaaccaaattaattctggaaacctggttaccatggacaagatgccttcctattgccttaccaagaatccaaactgcccccctcaaaaagaccttagcctgtctgtctctttcctccctcaggactcaaggcctcctagcgagattacatccttgtcaaaggttggaaagagggaaagctcaaacccacctgggaaggaccttacctggtactcctaacaactgaaatagcactccggaaagccgaaaaagggtgaacccaccacacaagtgaagaaggccccacctctggcaaagtcatggaccatcactccaggaccaacagcctcaaaactaacattcaaacgggtttgtctttttcttctccccttagctactcaaggatatcttactgttaatgtaactatgcttgtctagtcttaccttgtggagatctccaaagtcaaagacagttagcttgtacagaaaagtacttctgcccctctgtggaaagagttaatactcctgtgtcttgcatatggggggaatcctcagaggaagagttaggcaattgggggttatggtctcagtgggcagttttagggcactgccctaaaaccatacctacacttcaccaaaggggccaccccttctgactgtcaatctaatcattgcaatccagtacttatccattgtaaaaattaaagatctaaagcaaaccatagccattgaaacacggtaccaagatgcaaatgcctggctggaatagattaaatattccatctgcacgctaaacaaaagcgattgttacgcttgtgcgacaggtaggccagaaacccaaactgtcccctttccacttgattgatcctctgatcaaccgggcatgaactgtatggtagccctcttccaaaatcccacagcctggggcagtaaggcatgtcaaaccctcttgctgctattcctagaagtgaaaagccctgcaggtcggcccctgagggctatccaaccccgtactacaaatatcaatttcacctcgtgtctctcacggcaaggggaaaatttggcattccttgggagtctaatgggatgcagtgaatctaagccttttcaacagctaaccaatcagtctgcccttgttcatccccaagcagatgtatggtggtattgcagtggaccactattggatactctgccaagtaactggagcggcacttgcgctctaatccaattggcaatccctttcactctggcatttcatcaactaagcaaaaaggacaatcgtgaaaaaagaagtaccccccacgggtcctttgaccctcacatttatatagatgccatcagagttccacaaggggtgccaaatgaatttaaagcccaaaatcaaatcgctgcaggatttgaatctgtattgttctcgtgggtaactataaagaaaaatgtaaactggataaattacatttaccataatcaacagcagtttgtcagttatactaggaatgccattaaaggaacagctgaacaattaagttctaccagccagatggcctgggaaaacagaatagccctgaacaaaatattagctgaaaaaggtggggtctgtgtcataattggggcccaatgcttacagagccttaacaccctagcaaatgaattagccaaaaattctaaaatagaattctagaattcttctctagtctcacggaaaaatggtttagaaaatggaagggactcataacctttactccccttgcaattattataggtgtactcattcttgtaggttgctgcatcataccttgtattcgtggattagtgcaaaggcttatagaaaaagccttcaccaaaacccctcatgattctcccctgccctactcacataagttcgtactcctaaatgaccaagaggaacaacaaatctaaaatatgttaaagaaatttgaaggggaagaactataaaatcaagagagggaaactgttaaggacagtaagttcctcttcaaagttcccttggtctcttgctctgtacacagcccttcctgcttgatctgtaacgagcacttgttcctcagcttaatctgtaactagcaaacctcttactccgtaaacatctctgtcacacccagacatgtccaaacaccccttaaacttattctgtaggcaactcttcccaccttagcaacagacagtctctccctcccctcctctcttagcaaactgcgtgttcaccatatttagaaaggtttaagtcttagccaattgggttaatttagattgtttggtccaaccctagccaatggggaaaggacacagaaacaggaactgtgttaggaataaaaaccctttggccgggagcggtggctcacgcctgtaatcccagcactttgggaggctgaggcgggcggatcacgaggtcaggagattgagaccatcccagccaacatggtgaaacttgtctctactaaaaatacaaaaattagctgggcgtggtggtgggcgcctgtaatcccagctactcaggaggctgaggcaggagaatgacttgaacccaggaggcggacgttgccatgagccgagaccgcgccactgcactccagcctggtgaccgggcaagactccatctcaaaaaaaataaataaataaaaatcctctcttttgttcggtgtgctctcgcgagcgtgactgatgcaggcagcacccttctgtagaagtaaattgccttgctgagaaaactttttgcctgagtgctagttcttctttgcggcaccgagcacttgtttctaacactggttttttgtttgagtttttttgagacaaagtctcactctgtcacccaggctggtgtgcaatggtgtgatcttggctcactgtagccccaacctcccaagctctagaaatactcccatctcagccccccaagtagctgggactacaggcatgtgccacaacacccagctaatatttgtatttattgtagagacattgtttcaccatgataccaaggctggtcttgaactcttaggctcaagcaatctgcctgccttggcttcccatagtgttgggattacaggtgtgagccaccacgcctggctgaaaagctgtttttaaaaatcaaaaaacaaaaaaacaggcattctgatctctagccagattactgccaatttaaaggacaatttgatgtatggttcaaagaggtcaacaattcaaaataaaatattttccaatttggtcaaggggtggggacgggcgggaagctggtcagaaaaaaaaaaaaacagtgactttttacatttaccaaaaaaaattagaatttttttcttgcctgccttttaaaatttcattcaactctactattttctggacatctcacactagtttcaacttaagattaagtctcatcaggcagttgacctgtagagagctgtaagtgttacttctctcctacaaaaatttttacaaatcaaactatcatgggatgtaagttttgaaaacacaaagtttcttagaaataaaactattactttatgataggacagataataaatgataatctggtccttaatctacctgcactgtttggagagatatggagtcaataatctccctatgttataggagttattaagaaattattttaggcagatagagaagacaaggggtccttggcaagtttcttttcttttaaggcagctccagatacatttcttgcatagcagaaaaatggcctgaagggcgggccagcaagctttgatatgcaaatgccagccattagaaactgggtccactcaatatggcaattcccaccttcttcttgtcactacaagtgcctagcatcatggccacccccacatatccccacgtgtgtagaacatcatggtgccctgcatttgcatattaaaaggctagggtgggaggaccagatttttgtgggctacatgaatgacatacctggtcaacccaatcccctggactctatgcaaatcagacaccagctcctccagcctcctaatataaatggctgttttctgctgcactcagggttccctctctcagcttggagccccctccctctgtctctgtatgggggagccccttccttctttcttgccgatttattaaactctctccgctccttaaaaccactccacgtatatccatgtcgtcgtatttaaactggcgtgagaaaaggaccctggtattcccctccagtcatcagagtcgtatcattttggtgcactggccgggaatccgaggtacaacattcactgaagtggtgattatacaagcgagcttaaaatctgttctatcattctgaggtgctcttggcctctattttaaaatcaaatcaaatcaatcaaaaggcatctatctgtctgctggttagctacacttatcgttggctgctgttctaaagactcagatgtgaggcttgctggtgagaacatggagaaccccccaatacccacaggtgattgggaatgttggccgtatttcgaatcagcttcctttcatggggagacctcgccgttgcgcaaggctgggaaaagttctgaggcaactgagcatctctgggcagggcacaccctggtgtgactcaaagacctctggaccagacccagcctccaacagcccatttcaggtgctggcagagaatcctcagctatccggtcatgaaactttccttccttttctatctgtggtctcttactctgtgtgtatgtgtcaactgtgtgggaatttagtaaccgggagtttaactcaagaatgccattgcaatctcctgaacagagggttcctccgggacagtgagcctctctctctcagccccttggtctggagagcacacggcatttccaggtctctctaccgcttgtctgaggagcacacagtatttctaagccaacagtgccacctagaggaaacagaaatcctctacatgaggcactttttttaatgctaacactgcagcttccttttgcactgctagaaatcaggctctaagcctcttccaggaatgggaaaattctgctttcaacagttagaaattaaatgtcttccatagccaaattttagtctcaatattgtcccatcagcaggaaaacagccatttggttcctacatttctttaagtcacctattctgtctccaacagagacagtacttaattagtaaggggattttaagtctggaagttaactgaaaccatttttctaagggtaaatgctttagcatgggccataatagcaggatatagagttcaatctagcataacccctccattaaaggggccttccccaattacacagttttccctgagatccatttttttttagggaggtacacaggtcacacaagtctaggaggtcaaagggaaataacaagcagaggactgggactacttgggtaagtgtgactaggcctcaaaagtctagtttctctggtgccatggcttggagggtcacacctacagccacaggcggcacatttaactgggtgccgggacccaggaaccagggagggagactagttagaggaatgccccctactgttttcttctccaccctgagtcatacaccaaaaggaaggagactaaaaggacacttttattctcacttctctttctagatggccaacagatcgtcttcagcatgcactcctctggaatgtattttaaagcactgggactccttcaaccctgagactttgaaaaaaaagtgactcatattctattgcacaagagcatagccttcttactatcttggggacagataaacctggcccgctgcggggagccttgattttaatattatccaacagttagatcttttctccaaacagaagggcaaatggactgagatcccctatgtacagactttctttgccctgtgaaacagcccagacctttacaagttctgtacaattgacccagttcttttagcggccacagggaatcgttccccagagctaaagcaggttccagaggagcaatctgaaacagctattgaatgtcccaatccttccagtccccctccaatcatactatcagctcctccagctccactatctccagtatatcctactctccccgcttcattcttacctctgcaggaaatggctgataggaatggtgccatgagggttcaagtttccttctcattacaggaccttaagcaaataaacagagacttggcccaattttctgatgactccgataagtatatagaaattttccaaaatttaactcaggtgtttgatctcacatagagggatgttatgttgctgctaagtcagaccctcactggggctgaaaagccagcagttccacaggcagcagaaaaatatggatataagcaacatgcctcctgtagcagaccaaggagaaaaagaggagacaaggaaggtaaggaagaagtggaaactccattcccactaggaagggaagcagttccagcggacaaccctgattggaaccccaataacgcaggaaatgaatggaaaaggaagcacttcttaaggtctatgttagagggcctatggaagaccagggccaaacctctcgattactctaaactatctatgatagaccagatgagaatcccacagcctttatggaaaggctaagagaggcactaataaaacacacctctttatcatgattcagtcgagggacagctaatcctgaaggacaagtttattacacagtcagctcccgatattggaaagaaactacagaaacaagctataggaccagatagcaccctagagaacctcctgagaatagccacttcagtcatttacaatacagatcaggaggaggcccaagaaaaggaaaggaaatataagtgaagaacagaggctctagtagcagcattgcacgcttgtaaagtccaggatccctgaggtgcatctgctagctgttatcaatgtggcaagtcagggcattttaagagggaatgcccaggcagcaagacgaagccaccttgaccctgtccagcctgtggcggagaccactggagatggatctgcccccagaggcagaggtcgctgggttcagaaccagtctcatagatggtccagcaggactgacgggtcccgaggcttaaacccccggctccagcgactcagactgccattacagcacaggaaccctgagtgattctggaaattgaaggaaggaaggtagatctccttctggatactgaagccagtctcttgctcctcctctctaattcaggcctcccctcttcccagagcacaaccataaggggtgtatcacgaaaaactctaacccaatatttttctcaaccccttttgcagatggggagacttactatttaaacatgcctttttaatcacgcctgaaagtcccactcctttattaggtagatatattctagcttgcatgggggcctgcagcatctttacagccccaggacaaactctatctccccctgatggaagctaacattaatgtggaagtgtgggcaacttaaggaagaataggttgagctataaccactacgccagtccagatctatcttaaggatcccacttcttttcctaaccagagatattatccctaaggccagtggctaggaaagggctagaagccattattaataacctaaagatgcagggcctcctcaaaccctgtaatagcccctgcaacaccccaatattaggagcacagaaacccaatggggaatgaagcctggttcaggaccttcgcctcattaatgaagctgtagttccaatccatccagtggtccctaatccctataccctgttaactcaaatacctgagggaactaaatggtttacagtcctagatttaaaggatgcctttttctgtacaccgttacatcctgactgtcaataccggtttgccttcaaatattcctccagccagacgcccagttaacactgacggtgctgcctcagggattttgaaatagtcctcatctgtttggacaggcactgtcacaagacctctctgagttctctcaaccttaagttaaggtcttgcagtatgttgatgatattctgctatgtgccccaactgaggatgcttttcaggaaggcactgaagctcttctcaatatgttagctaacagagaatataaagtttcaaaacccaaggcccagctctgcaaaacctcagtgaagtacacctaggcttagtgctgtctgaggggaccagagcattagggaaggagggagttgagaatatttcttcctttcccctccccaaaaccctcaagcaactcagaggattttggggcattacaggattttgtagactatggatacctgggtatggtgaaataggctgtccatgatataacctcataaaataaactcaaggaactaaaactcatcttttaacctgggaatctgaagctcaaaaggcctttgaccagctaaagcaagccttgcttaaggcaccaactttcacccttcctatagggaaggacttcaatctgtatgtatcagaaaagaagggaatggccctgggagtattaacacaggcccaaagaccaggccaacagccagtgggttgcctaagtaaggaacttgagttggtggctaaaggatggccagcatgcctccccgccattgcctcagtggctctgttggtcccagaagcctccaaattaactctggaaaatgatttaactatttatgccccacctaacgtggcaggactactgcacttttgggggagcctttggctaacagatagctgacttcttaaatatcaggccctgctgttaaagggttccaacatccaattaaagaattgttctcacctaaatccagccgccttccaccaggaggaaactggggaatctgagcatgactatgaacaaatcatagtacagacctatgcagccagggaagatctcaaggaaactcccctagagaacccagactggaccctcttgacagatgggagctcttttgtagaacaaggaatctgtaaggcaggatacacagtagtcactctacatgacatcactgaaagtgtgtcactccctccaggcacaagcgctcaattagctgagctaatcgctcttacagaagcaattgaattaagcaaaggaaaggtagctaacatttacacagactccaaatatgctttcctggttctccatgctcatgctgccatttggaacgaaaggcattttcttaccaccgatggatctcctataaatacctccaggaaattaacaggttattatcctcagtttttcttccatgagaaatagcagtgatgcattgtaggagacatcaaaagggaacagatgaggtagccaaaggaaacagattagctgatcaggcagctaagtcagcagcaaggaaggctcaagacaacacacttcaaacccctctaatctgggaaggctccatgagagaaattaaacctcagtactcccccacagaaataggatgggccacttctcgagggtatacatttcagccctcaggatggctacagtcacaagatggcaaactccccttgacggcctccagccaatggaaagtccttaaagtgcttcaccaagcttttcacttgggagaggataaaacttatcaatgtgcccagagattgttttcaggaaagaacttactaaaaacaatcaagcaagttgttcatgcttgtgaagtctgtcttaaaaataatcccctgaacaggcgactccttcctcctcaaacccaaagaacaaaaagatacccaagggaggagtggcaggtaaacttcacccacatgccaaagacaaagggcattcaatacctgctgtatgggtagataccttcactaactgggtagaagcatttccatgttgtacagaaaaagcctctgaggtaataaaagtattagttaatgaaataactccctgctttcatctatccaagtaccttcaaagtgacaatgggccctcatttaaggcagctgtcacacaagggatctcaaaagcactaggcatagaatatcatctccattgggcttagagaccctaatcctcaggaaaggtagagaaaactaatgatattaccaagagacacaccagaaaattgtcccaagaaactcaccttccttgggtcactcttcctcccacggccttactacgaataagagataccccttgaaaattaggtcttagcttttttgaaatgctgtatggacacactttccttaccaatgatttttctattagatcgggaaacctctgagctagttaagcatgtaacctctctggctcacttccaacaggaattagcacaattagcgaaaacccaatcccaggaaattggaccacctctatttaacccaggagatttggtactggtaaaggatcctcctctctctctcccttcctaagcccaacctaggaagggcctcacactgttcttcttccaactcccccaacaataaaaggtacaggaatcgaccgactcctggaaacatcacactcaagtcaaagcctggagagctgagggagcaacccccaacagcccagaggaacgtcctgaatagcaatgtgaagaaatggaagatcttaagctgaaaatcataaaagataagtaactatatgagaactaatcatcttattcagtctcacccctacctcaacaaatactttttgtcatttctacctctccttttgagccaaatatcagaacttctttttggtggaaattatttactactccaaccttgcaggaattgctatactcactctgctatttgcagtagaactatatactgtagcaccctcagggtggaatgtcagagagagaatctcaattactactgcattttgcttaattattaacctcacagcaggaataacagttactaacaggaagtaaacatgagcattttactatcactaaatctgttagaactctttattggacttagtaatacgtcgcaccatctagctcctacaatatctgccatggcccatttgtacagtaagactaattgttgggtctgtcctaagtggttcgctcagttcagtgacactaaggaaccttatagttacccggaactcaccatcttaggattccctttgttggctttacctttaacccttaaagacttatcaggcataaatgggacatggtatgggaacactttcaattgggtgactaactcttcccaggagaacactctgccccagcgccaaagaactttctcccaaagataagcttcacaccctcaggcttggaaaagttgatggagtaatagcaaatgcctccctctgctttaaaagtagtggggaagaaccatacttgggagtaacatcacacttgtaattgctgatagttcaaagatttgaggagagtgcaacaagggtgatatacaaggatagaagccctagtggggggctttcagaaactagtctccttctggttggaagtaccgatgggagtggcatgctctaagtaaccaacttgactataatgtaaaaaataacacatgggtctttccaaactcccccccacccatggaattccagacccttgtatgatgtttgctaacagtggcggcttactgatctgagggcgaactgaagacatctggactgacaccccttgccacaagaatcatctgagatattggccagggcatattacgtctctaatttttcaaaactccatttgtcaggtggacccttttcacttggcatgtcaaattccaaatgacatcgtaaatgactaccctaaatatggttatctttatcccaaggatgcctctattatatgtaaagaaaggaaagttctaagatatgagaaaaatctgccagtgtctctcacaagccacaacttagaaccatcccttcaaggaacagggctacattttctttgtggctcctggatacacttaatcctcccaaggcattagaagggaacttgtactatagctgcagtagttctcaacttattaaattctaccaagatgacagcatcatctggggacatccctaacttagcctcttttctagaaactgcactattctgaatacatcggacaaagggatctatcatttctatgccctcatatggagatttaactgaaagggcagcctggggagggcatgcacatgacaatctcatcttagaaaaagcatggatgggaaattctatagccagaggtatattctggtttatgggcatcccctctccttgaaagatcaatacttaatatctctattataatgcaatgaggatggaaggcaactgtatgggccatagaggcacaaccacaatctatagactctttagccttagtaggtagtagcacaaaatcgacaggccttagatgtccttacagctgaagtgggaggtacctgtgcacttttaaatgcaacatgctgcttctggattaaccctctagtagattaaggaaaatctacaggtacttaaagatcaaatcaaaattattgacaggctaagagaaaatgaaggcttcagccccaggtgactacaatccctctttaatgaattccagtcttctttatggaattggttagcccctttattaagctccctcttgcttacatgtcttacattaactcaatactataactcaatactatataacttgtataactcagtactataactagaattgtttcctatcgcctagaagcaatcaaattccaagtggtgttgcaaaccaaaccacacatggacatgccattcttccgaggatccttggatctaccccaggaggagccctagctgctgttccccattcaatgctccttttcagcaggaagtagccggaaagagtcatcacccaaaaccccctaacagcagttagggtgacatctcctccgggtagaatgttataggagttattaaaaaattatttggccactgccctcactgccgctgctgctgttgacctcgccagggctgcttcgtctccgaggtcagactgctcccaatgccatgaacggagacagcacctttgcaaagagacccagggatgatgctcagatatcagagaagaaacacaaggccttcaatgatattgccagatacttatctaataaagagtggggaaagctgaaaaactcagagaaaatcacctatgtgtatatgaagagaaactatgagaccatgactaaactaggtctctaggccaccctcccaactttcatgtacaataaatgggctgcagaattccaggggaatgattctgatatagactaaaactgcaggaatcaggatgaatatcctcagatggctttcggcatgctacaagggaactttccaaagatgatgcccaagaagccagcagaggaaggaaatgatttgaagggagtgccagaaacatctggctcacaaaacaatgggaaacagctgtgtcccctgggaaaagaaagtacctctgagaagactaacaagacatctagacccaagaaaagggggaacacgtctggacccacggactgcgagagagaaagtatctagtgatttatgaagagatcagaaaccctgaggaagatgacaaataactcccctcagggataggatgcaagcccatgatgagaagcagaaactggtgaccttctatgaacatgggcatggctgcgaacccctcatcatcaggtgtatagcaagtgaaagcaggagttcacgacagtgaaaagttgagcgtcatttttcttacagtgtgccaagagttagatattagcattttcattgtattttcttacagtgtgccatcctgttagatatttgcatttttgttgatgaatgagacatagttaatgcatatttctgtttgtgtatccatgcacctacctcagaaaacaagtattgtcaggtattctctgcatagaacagcactaccctcctctctccccagatgtgactattgaggccagttctgggtgtttcagattttttttctctgcatttacacacacacacacacacacacacatacacacgtggaataccactataaatatctccatctgcttttccccatcgctaatgagtcctggtcaagcccccctcactctgtttcctgttcaacatgcactccctgctgcaaactcccctcatctgattcccctgtgttggtcactgccagttaataaacatttacaaacttaaaaaaacagataggacaaggggtccttggcaaggtttttttcttttaaagcagctccagaaactttattgcctagcagaaaaacagcttgaggggctgagccggcaagctttgatatgcaaataccagccatcagaaactgggtccactcaatacagcgattcctgcctcaacttcttgtcaccacaagtgcctagcatcatggacaccaccacatatccccatgtgtatagaacatcatagccccctgcatttgcatactcaaaggctagggtgggaggaccctttttttggcgggttaagtgaatgatatacctggtcaaaccaatcccctgggcctcaaatcagacactgcctcctccagcctcctaatataactggctcttttccacactcggagttccccctctcagcttggagcccccctccatctctgtacaggagagcctcttccttctttcttgcttattattatttgtgtatccatgcacctaccccagaaaacaagtattgtcaggtattctgtgcatagaacatcactaccctcctctctccccagatgtgactactgaggccagttctgggtgtttcttggtattaaactctctctgctccttaaaagcactccacatgtgtccgtgtcgttttatttaaaccggcgagacaaaggaccctggtgttcctccggtcatcggagccatatcacctacattcacgattgtgtgacaagagcccttccaggtccatgggttcttcacacatctctaaaatcaattcagttcagttcagctgggtaagggtccagcaatcacactctctctaccaggctgagaagcaaaatgatggcaaaaatgaatgaatgaatgatatatactgaaggtaaaactgaggtccataaagatacaaaaatatgcctccaacaattttaatttctgcaaacttactagagctgaggcaggagaacagggtctggaggcagggaacctaaggccaattcacgctgacttcctagaactaaattaagatgaaaaccccaacttttcacacccaagtaacaaaagtaccagaggctactactccctttgcaaaggccccctcccaccctgccttttctgtgtggcagatgaaaaactgaacgtacctctgattggtcccctcctgcaaccaatcaggctggtcatgggccaagtcttcatttgcatagaagtgtaattttgtaacttcacttcagcctctgacaggtcactttccacaaccaatcagacgtctgcatagggtgtaactttgtaacttcacttcagcctctgattggtcactttctgcaaccaatcagactgatcatgggacactacttcatttacatagggtgtacacgaagtaacaaaatgggaaacctctagagggtatttaaaccccagagaattctgtaaccagattcttgagctgcttgcttgagcccactcccaccctgttgagtgtgctttcattttcaataaatctatgcttttattgcttcattctttccttgctttgtgtattttgtccaattctttgttcaaagcaccaagaacctggacaccctccaccggtaacagagctataatgacattatacatcatgtttaagaatttatgattcaaatatttaattttcagcaataacataaattaacgagaatttagagataaggaacaaagttacttgatttacaaaagaatgtaaatcaaattgttttgaatactgccttgaaattacgatttcacaagcaaaaaagttctttgtataacctctgacctgctaccatctataaataaagaactaaagtacaaagaggttaaattacttgaccaagaacagagctcaaaataaaatcctagtatcctgtttctcaatctagtgttacctatattatcctacactatatctctcagggcttttctccctttggattctgccttccaaatacagacatctagcaccaatggttaaagaacagggcttggggctaaacaaacagactaagagaaactcgtctccaccacttgaaaagctatataaccctgaatacattaacatcctctaggtctttttttttttttttttttgatcagtaaaaaggagataattgtattttacctcaaaaggactccataataaaagaattttaaaataagttatatataatgtgtaacatattgcaaaattttatgagagatattttctgttaattttaaggctaattgaccaaataattcactgtcatatctggaagtgatgttatttgaatatccattatcagagtcctgaaagtttcaaagttgcaaaaacatagtattattcaccaatgaattgactgttaataaaaagcagaacaggctagaaaatggttgaaatatcacctaccttatatataaaatgggtttataattgtaccacattaaattttttaattaaatgaaaaatttatgcaaacctcttatcatgatcatgatgccctgtaaataaatagtaaatgctcaataaatgttggtatcattattaccaaaaggttaaaaaggagttctctatttgcttaaaaatagtaccaagggtatacgtggatgagcagaagtaatggctgaaataagattgtcatgtattataattgtataaatttggtgtgtacaaatataggttaccacttttgccttctttctactttggtgtatgtttgaaattttatggaaaaaaaagaaaaagatagtgagaacaagaagatattttacattaagatgagttgttttaaagaaaccattcagcaaagtaaactaatgaacaaatgaaacctaatcattgtaataaaatacataagcaaggaaaagagacagagcccctgggaagttttcatattgtccttcaaaattagtagttgcctacagctgggaaaatagagggtttgaaggataatggctaaaggggatataatttctttttggtgtaataaaaatgttctaaaattgacagtggtaatagatgtatgactctgtgaatatactaaaagtcattgaattgtacacttcaaacgggtgtatggtataagtccattactgtactgctataaatacctgaaaaagaatttaaaaaaaaaaaaagaaaagaaaagaaatatcgagcctgaggtttttataaaagaaagaggtttgattggaaggcaaagcaggagtaggtgtcttacatggcaggaggaagagagagaggagagaggtgctacacacttttaaacaacctgatcttgtgagaagtctatcacgagaaccgcactagggggatgatgctaaaccattcacgagaaactgcctccatgatgcaatcacctcccaccaggccctaccaacattggggaatacaatttgacatgagattggtggggggaggggcagcgcatcgcaataatgctgtttaaaaaaaaaaaaaaaagtatggtcttgatttcccaaatatctccgaaatcatctagttgtctttttcctgtctctttttatgaacaagtcaccaccagcttctacttcaacagcaagtggtctcctaccttccagttttgttttctgggatgtgatccatcctcaacacatcatccacaatgttcttttacttcccagcctttgaccaagctactctctcagcctagactactctcctcccaaaccccttttaccttgctggttcctactcacctttttgggcctcaacctaaacaacatttctgccaggagtcttttccctaatcccctggacttctgtatgtccctctgttgtctatccctaccaccctgtgtacttcgcctatcgtaacgctcctaactatttactgtcttctcctctagacttcatatatacaatgattaggggaaatgtctaattcatacccccagcacagtgcttaacatgcaacagacattcaattaatattggctaaacaaataaataatccaacaagtccttatctttataaggcttttgtttttacacaaaatgaagatagtgtaccaaatgataacttgtttcttcctttctgatatatatccacaggatgacctcaaaatttatagtattcaagagccctacgatttctcagtaaaaacaaccaactaatgaagatatgattaaattgaagttcatttttatcagcccctatttaaaataaaataggttaattagataagaaaattatctctaatacaaattagctgttgggaataatcaaaagaaaaaacttaacactatctgtacctttttaaaataaaatacataagtacacttaaaaatcagcccaaaacagacattaaaaactatatttaagaactcgccgggcacggtggctcacgcctgtaatcccagcactttgggaggccgaggctggtggatcacgaggtcaggagatcgagaccatggtgaaaccccatctctactaaaaatacaaaaaattagccgggtgtggtggcaggcgcctgtagtcccagctactcggtaggctgaggcaggagaatggcgtgaacccgggaggcggagcttgcagtgagccgagatcccgccactacactccagccagggcgacacagcgagattgtctcaaaaaaaaaaaaacaaacaaaacaaaacaaaaaaaaaaaacctcaaatttttgaaaaagataaatgaattgcctgagagcctgcctatcaggagccacatgatacaggagagaaagactgtcctgaggaaggttacgagccaagcctaagcaaaaagtaagtttcttttttttgcctcaaggtcctatactcccagtttcctcttacaatccctctgtcactcaactctggtcccacagcaagattatgctatgtacaacaagtgctgcatacttcaaaaacaacttcctcaaactaatatctgtggcaacagtagctatttaatggcctccaggtctcagcaaagaaatcctaggaaaacactggggatcagctatgtaccttatgttacaatttggtagcctggtagacacatctatcctcattgtcgtagatctatttccttccaacctggaatttgaaactccatgaacaaattacaacagctaaaaagtggtgctgctaatgttagtgtctcaatttagcattatttgaaatctcaaaataccctggctaaacgaaaattcctcaatggtaagtctagaataattttctgtactagaatcccttcgctgctgagattctcatgtaatcctctcctccatgtttatctccctgcaattctgccattcttggaacacagtaagtattcaataaatatatataagtgaataaatgaatgaaccttctaaaagctccaggttaaaaaggaagaggcaaccaccacctcaaatatctcctaaaagtaactaacagtgtcgtacatataatgcatgaagtataataagtgtgtaaattataaggtatatttgtcaactcccatgtagcatgtaaattgtgtcattatttaatatgtacactgaggtttttacaataatcagtcttttaagaatttaagtgcattcacacatttcacctaaaaattatcacaacaaaccaaattaatgcagcacttcatgccacagtctcaccaatcaagaagaaatgcttactccaagccaaatagtaatagtaataaagttgaaggcagctaactaaaatatgttgtagatacaatctaaaagtaaaattatatttgataatacacaaatttcatgtacattatttagaaattaatataattatgtgacatggtaattctcagctgggtgttgtaataaaaggagataaacacattttaggttattctaaaatgtttggaatttagctagcatagatttgtttaattttataaatgagaaaaaaatgaacatcttatagacctgtggttaatggatgaccccaaaaaattatataatcaaagaccaaaggataaaaaacatatctgcttgacacggatatgacataatctgatatatggcatgttttaaagttgctattatattataaatatcaacctattccttatgttctgatgcaggttattcccaatattcagtaatcttccacagtggttattttcctgagtgctttacaataaacagataagccatgaggcaaacccaacaatgaaaaacaatgtttatcaactacaagactcaggacttggtaagcacacttaccaaagaacagataaggtaaagaacaaatagctcccataaattaaaaatcatgaaaacttcagaaagacatgaattaaggaaggaaagcacacactaattggaaccaagcgttacatcaacacacatagcaggctttccttctaaatagtctttattatgcctgctaaaactacttatattcaggtaatatcttaatacaactgatttttttaaaaaaaaaacaagagtacctttccaggcaataataaatgcaaccagtatcattcattaccagcaccaatcactcaaaccacaattctaattcattttccacagaagtctcgatttcctgttatttattgtaagtcttccagcagtcttactattccttcttatttttatccaccattccttatgcctctttcctagaactatttgccctttgatatggtttggctgtgtccccacccaaatctcatcttgaattgtagttcccataatccccacatgtcgtgggagggacccagtgggaggtaatttcatcatgggggcggctgccccatgctgttctcatgatagcgagagagttctcatgagatctgatggcttcataaggaaatttttttccccctttgctcgaaacttctctctcctgacaccctgttaagaggtgctttcccccatgattctaagtttcctaaggcctccccagccatgtggaactctgagtccatttaacctcttttctttataaattacccagtcccaggcatttcttcatagcagcatgagaacagagtaatacacccttgatcttgaaactctgacactgctttatctatgtagaatagcttctaaataacagtacctactaatcatgccttaaactcaggattcttttccattagaatattctgtattctgactatataacataccagtgcaatcactcactgtttcatacattaataaaaaattgttggggaaaaagagtcaaagttcagcttggaggtaattgcaagaactaatgaaagtaacaaaaattttaacatatttacatcaacccaattcaaggaaaaagtgaaaatcatactctcccatctctgaaagattatagaaacttatatttaacatttgatgaattactcagtgagaaaaacaaggatatttgctactgctaactaaattagttttaaattaattcaaagaataaaaagaaaagacagttttctaaatagcaatagaaaaggtgagtataaaacaatgcacaacaggatcaaagggtttctggagacttatgaaaaagataacgactatagtcatctattcagtggtgtttttcagttcttcagctagccattgtcatgaaaaaggcagcataccagtctggataccgtgtggggcctagtctgagaacaggagagagttattttttaagctctcctcagccaaactgaggaaggctagttcctgactggacccaggttaataccgtaatactctattgaggttgaagtcagtgactataagaagattattgagttttgaagccaaagcttcaaaaaataaaagagtttgtctgtgaatctcaagtaaatttttgagaagtcatgacacaggaacacagttttaaaaagagtatgatttgcttacagcagctttacaataacactaagaaaatctcagagcatctgttcttcaacttctcaatcctcattccccacatcattcttccctcaaaaagttaattttaatgtttattaatgagaccaaacagctagaacacatttttaaaaagatctccacgcacttctgatttattctcaactcaactttgttcaattactgtccagcacttttttaatgattttctgtttaaccacgtagtgtgtatagagggtgctgtgggttgaattatgtcctccataaaaatacattaaaattttaacccctagaagctgtgaatgtgaccttatttggaaatagggtctttgcagatgtaatccgaggtaaaatgaggtcatgctggttcagggtgagccctaagtccacttactggtatccctatatggagagagaaaagatatgaagacagaaagctcagggaagaaggacatgtgaaggtgacaaagactggagttatggtgccacaagccaatgaataatatactaaggactgccagtaagcacccgaagctagaaaaggcaaggaagaattcttccctagacccttcagagggagcatggccctgccaacaccttcattttgaaccttatagtctccaaaactgtgagaaaaaatatttttgttgtttaagtcctctagtttgtggtaatttgttatagcagccctaggaaactaatacaggggagtagaggttaacagttctgaacctgctttatacacatatactggggactgagcaaacaagtaaatggatggtagatggtgggaggcttctaactgttggagagggaagttatagataagcaagggagaagggctaaaataaatcctgctgtctggattagagtcaaagacatcataaggaactcatgtttggctcaatactaatactgacgaataaacagataaataattctagatatatgtgtaattataggctaatatacatacctgcataacctagccctgtcctctgaaagggcctaaaagcaatgacaacccaataataacaagtatgtccagcacccagatcttggtttctgaataccactctccaataaaaagaaccagagctcattggtgaaatgattgattcaagggctaaggtaggactaagatgaacatggagcattttgtggtacccaaaagtaaggaagtgctcaaaaaacaaaaggatggcagggtggtgtccatgtcaaagtgtcaccagaacaaccctgaaagagttctcaatggcaaaatttgaacaacaaaatattattactaagtcataatcaaaaatataaaacaaattcacatagtctatactggcataaataaatgattgaataaataaataaatgagagagaagaggttactttcttacagaagaattccaaatcatatatataagtatttagtcctccaggatgtagaacttagtgcctctaactcctattttcagtgtgggcaggactcagtgacttgcttccaaaaaatagagtatgattttaaaaaataatagaaatggtaaaatactgttttatagaagagaaacctggcaaacatatcttaaacaagcgaccaaggtaaatatcactaatgatgtcgaattattattatgtacccctgatatgatatgatgaaaagaatattttcatatctgtagtattcttgccaaaaacttacaaccacagtctaatcatgagaaaaacgtaagacaaatctaatttgaaagacatctataaaatatttgactagttctcctcaaaactgttaaggttatgaaaaataggaagagaatgagaaaccgtcacagaccagaggagattaagaaaacattacaattaaatgtaatgtggtgtcctggataggaaccaggaacagaaaaggacattcatagaaaaactggtaaaattctaataaagtctatggttaaaaaataaatgtgtacatataggagtccacattgatataaataaacaattaaataaatggaagagaagtggaagtggcaaatatgtcttaaagaagaattccaaataataaattcacatattctccctcacaggagatggagttaaaccctccgttcttgacttgcctccaaagaacagaatatggaaagaagaaaatttgttactatacaatgcagagaacttgcaaacctagtactgcctgtccctgagccttcctgggggtgtgtgtgtgtgtgtgtgtgtgtgtgtgtgtgtgtgtgtgtgtgtgtgtgtgtgtgtgtgtgtgtgtgtaacgccatggagcaatctcagctcactgcaacctccgccttccaggttcaagcaattctcctgtctcagcccctctgctgtaggtgggactcaggcacttgccaccaggcccagctaatttttgtattttcagtagagacggggtttcaccatattggtcaggctggtctccaactcctgacctcaggtgatccacccaccttggcctcccaaagtgctgggattacacatgtgagccaccacacccagccctggggtttttttaatgatataaattaccagtcaagctaccaacctggtccttaatttctctggtgctggctgaaaattcagccccttggggtctgctaacaaactttcttacatattgatctgacaccatttctagaattttgtcattttctccctgccttcagagggttgtcttttttaaaaaaaaaaaaaatcttgagttttagtgggatgccataaaggaataaaattgaggcgtgtgttcaatttgccatcttaccctagaaatttgcttgaatttctttctaggttggtacatatatagctatctaattagttttaactggatataccgtggaataaccatttctccattggtaagcatataaagttgtttcttatttttcactaaacgatgttgcagtgaatattcttatacatattatctttgttcatctgtgtgcctgtgctgagttaagaacatatacactttatgtaagttattcatggttaagctatttagcctcttagtctcactttcctcatttgtgaaatgcagagaacagtgcctacctcatatggttattgtgaagatcaaatgagttaacatgtgtaaagtgcctaaaacatagtaacagctatataggttgttagttattgtcaaattgccctctgtaaaggctatcagttattacagagccgcatttcccacctttgctcaaaccctggttattacagtctactttttgagaaggaagggcaattttattggtaaagacagcatcagcacctcattgtctaaactgtcgcttcactgtgactgagtttgataatcttctttccaatgtttatcgatcaatttcccttttccccatgcttatgtatatcttttacttataaattatgaaatatttgaaatgatatacatgaatatctgttttggggtatcatccttatttatttgagctttttcttcccaaagtgaaagcaagtttattaagaaagtaaaggaataaaacaatggctactccacagacagtgtagtcctatgggctgctggttgcccatttttatggttaatttttgatgatatgctaaacagggggtggattattcatgcctcccccttttagaccatatagggtaacttcctgacgttgccatagcatttgtaaactgtcatgacgctggtgggagtgtcgcagtgaggacaaccagaggtaaatctcgtcgccattttggttttggtaggttttggccagctcctttactgcaacatgttttatcagcaaggtctttatgacctgtagtttgtactgacctcctatctcatcctgtgatgtagagtgccttaaccgtctgggaatgcagcccagtaggtttcagcctcattttacccagctcctgtttaagatggagttgctcaggttcacacgcctctaacatttcccccctcccttttataagagaacccttaatcctaatgattgcagagggatgaagatccatcttcttctgtaacttcttcaggctgaataggggcaatgatattcctgcctaagtatgagggtctcttgcactcagggtagagaggagctcagtcagaaagcaccagtatggtaaggtccattcataactctttaagtttcaacagaaggtaaatgtttaatttatgaaaatattcagtaagcttctcctatattcctacacaaagagtgtaacagcaatatattccacaagagtacagcaaaataagtaaagttattccaagtaaactaaactagaaggttttccatgaactggacaactgttgaaaccaagttgatatggggttgctagctgattgcaatgtgcccagaattagaatactgattcagatttttacattacccatcccacttgttctgagcaacagtcagagatcacctggttggttcacaggaattagttcacagggttagcctacgttgcagaaacaaacttaaaaacaattaatgagactagaatttaacaacaagtgtaccatagtttttgaaacatagtatttccctctccagtttctcatttttactaaagacaaattatggtaagaccgatatgctttataaaacttggcctgattatttgcataaagtgcagcaagaataattatttttgacataagctcttttttaaattggctttgatggaactctgttccatagatggaatttcagataagactttttttttttttggagatatagtctcgcacggtcacccaggctggagtgcaatggcacaatctcagctcactgcaacctccacctcccacgttcaaacgattctcctacctcaaccttctgagtagctgggattacaggtaccaaccaccaagtccaactaattttttgtatttttagtagagatagggtttcaccatgttggccaggctggtctcgaactcctgacctcatgatccacccaccttggcctcccaaagtgctgagattacaggtgtgagccaccacgccaggccccagataagactttttaaaagccaagcccagccttgggtttctaccctcaagtagctatgaattgggtaaattcctctcctcttggggtcccaagataacttggagctcctggacctgatatgaaagtgacactctttacttaccacaggtcagaaatcctgtttacagggactgtgtaggcaaggaatgaggccatttcctcaagggactttaattggctctgtaagtcaagtttaatttcttaaaggaaaacacaccattccagtcaaagccttggtaaaataaccaatttacccaattgtgtcctgttacaaaagaaaacagattcttactgcacctatgcaaataaccatattgccataagttaagaatactcgcaactagtttccaaattctggagaaatcaggtagagagaaataaatatgctccaaagtttgttcataggagtacactcaactgttaaaagctgtaaaaagctcaaaagaagttttcttgactctgaaaaacaaaggatcagcaacattttaagcaaagttaaaaagactaggcttcttcagtttagtccatgtcgttatcttctgttggatagttatgaacattttagctctgagagttctgaaagttttttcctttattctgatgtcataatctccaaagctatcagaaaacttgcacttaagaatacctgctagagttctatagttgattataaatcgccttctaaagaggactaaaacaagacaacaattgtctgtggatagtaaaaagttttaggccagcccctattaaagccacagtagataaggaaatttggttgattttgtggtacacagaattttacataacaattataaataacatacattaagtcgtattagaattataggagtttcccataactttggaacatattccaataacacatttatgcaaatatagtacaatgcaaacaaaacaccattttacatttgataatgcttcctgtatgacttttacaccaaataagccaaatttcacctttatattaatgttctattaatgttaaacccaattcttaataaaattttacaaatatgtctatccaatcttaatcggtttgaccataaggtaagattcttataaccctttacatttttttgtgaaagagcagattagtgctctaagaaaaacctgttgtgcttttattccaatgtttaatttacggaaaaactgagtaacacccctttaactttagtcaatatgttcacacacagaatctctctcaatttttttcacaccatccacaactgttcaaacttttagctttattctaacttaaaataattatttaactctttaggcaaaaaaatccacattcccgtgccttcttataatcttttaccaaaagtacattttattttccttacacaccttgcatatagaactgtttcttcaatagtctcaattacatgttacgatgttaacttttacgtttggtgaaaaccctggttagtaagcaattttaattgtgttactaggacacaccaggcagaactgcagataagaactgactctccagcatagctagggggcatggctaactccacatgtccccaggccttatctagaatctaatggctttacggtaggcaaattgaacagtttccaaagtcaaccagtttgaccttaaagcatttagcaaatctaatatctgaccttaatttagaccaaatgtctacattttcaagacattttattttacctataatttttaaaactgtctttatttccaaaagattactaaagtcacgtgaacaaaaaggcattaaagtttccatttttctgaaaaaatattaagtgcttatttttctaagccaatcaattagagctcttttatacataaacatacaacacatattaatacatagaagattccgcacgtgtaagatttttcattgccagtttcttaagtggattactggcttcagggtggagcccttggaggaaaagcgccaggaaagcatgcgtttctggggccaaataagcagctgaaggcaaagacagatccccaaaattaagggtgccattttatgctggttcctggatccccaaaaggagggaaatactacagaagacagtacagtgcttctactctgcatttcactgcaaggcaacccaaagccaatcagcccatttcgtcatcagcccatccttcatggaagtctcatctcccagtggggggtggggatgtttccttatcttccaggtggccaagagcatacttctccgatccaagtgtgcaaagagtcaagtgcccctccctaactactattagccatcccttaaagtatatttcctacctagttattacacaccaaagctctctcataatgcaaagtaatttctgatacccccaaaactcaaaactgtcagataacacaatgcaaaacagaacacagcctttgattttgagagggatccatgtgcttttaattcctggggtttcatgaggaaaagagggttttttccctaaacagggtctgtggcacttcctctgtttttcccaaggggtcttaggctaccagaagttatcttagggcctctcatgtgtgcattaagagtggaaagacagctgggcaccatggctcgggcctgtaatcccagcactttgagaggccgaggcgggcagatcacgaggtcaggagatcgaggccatcctggctaacacagtgaaatcccgtctctaccaaaaatacaaaaaaaattagccgggcatggtggcacacacctgtagtcccagctacttgggaggctgaggcaggagaatcgcttgaacccgggaggcagaggttgcggtgagccaagatcgcgccactgcactccagcctgggcaacagagcaagactctgtctcaaaaaaaaaaaaaaaaaagtggaaagccaaaaaacaaatggagaaaaataatttagtcgactgaaaagaaaaaacctttttccataaaaacaagttccaagaagagaaaaaaataaaggcctgttaaatatatctatagcttgtctatccatttttacgtaagctgacttttaaccatagtgctctttaaaaaaacaaatcctttcagatctcttattacctgactttagccttcccaaatgaccaatatttctagcttctgaactttatcaaaggtgctgagagaaaggaaaatttaagacagtccacggaggagaagagaatagacaagatcacacagatattaaaccacagaaatgacttacttcctagtggagaactgaaccaggactgccagtgtgaaagtgcaaaatgtcagctactgagctacatacagtaaggggtagtccccatttcctttcccagaacaagtctacagtagttaattttgagcttgcagaggcttttaactatttaatatgatttttagagctaactatgacatgaaccctaaaattcctgttccctggaaaggggagaccaaaagtactgccacgtggttacaaggtcaagctcccaaggacgtaaaacaaggtggagacttcatccagtatttgtgtttgtttcagagacctgcagccaaatttgttactgaccagcttgctggttattcttgaaaagcgggcttacaggtgttctaagcccgtgttttatcctgaagtacccctcaacacagaaaaacaaattcatagcacaaaatacaccagcttaagactagccttagaattcttttttgcattaatcaaaactttacagaggagataaacactgatttttttttttaaccattcagtcaaccgtttgcacagagagagagagaagcctgaaatctgactggtaagaaattcttactcttttgccggcatgccaggcttctgggttccctttccctgagcagccctagtgatccagcttgtggcaccatagccatgggggccaagctgcatcataaaggaaaattttttttttcgttctggccagagcaaagtccatgtgataaaaacagagacattagccactctgcttagcacccaatatcaaactggcaaggcttaaatttgtccccagatgggccccatcatctttaatccaaactccgacttaagagtttcaacacgtggtctctgggcaagatggtcaccctgagtaatagaaaagataggaaaggaaaagtagagaaggaaagtattgcctgtggcagggtggggaaggtgaacagcttagggaggccagagaaagacccacccattgcagcaacactgaaaagttcaggcggctgtttctcagtaccaaagagatcttttccagccagtctcatcagctctcatttccccttttagggaagaaaaacctccccatgtcctacgatcctgtacatgcctaatcctgccacccacagccatagcaaagagtgcaaggcagattaatccaaagagaatagcagttaacatccaatagtgacgagaggggactctaatcctcctaagttgggcctctaacccaaggtcagtcaagcatccttgccttttattaagaggggctccaacccactgtgtcttaggagagactctaactcccctaagttgggcctctaacccaatcccatcctttacccaggtaccccactacttacccaaagttgtccaatcagtgctgcatctatttcctttgggtcgggggtctcaatattgtcccttttgtggttcatgagaaagatgttactagaccccaccacttacccaaagttagcctttgggtcaggggtttctgcagtatagtcccttctatggtcgccagaaatatgttacaggaacgaggtcctgatccagaccccaagagagggttcctgtatctcgtgcaagaaagaagtcagggcgagtccacagtgcaaaatgaaagcaagtttattaagaaagtaaaggaataaaaggatggctgctccacagcctacaggagctctttaggcactagagatactatttcctggtcaattatattacaaatatttgcttccagtatgtgtcttttttattttgcatcttttgtcaatgttcaatttctttaaatttttattaaatgttttgtgacttaagaacatttctgctgggcacggtggctcacacctgtgatcccagcactttaggaggccgaggcaggcggatcacgaggtcaggagatcgagaccatcctggctaacacggtgaaaccccatctctactaaaaatacaaaaaattagccaggcgtggtggcgtacgcctgaagtcccagctactcgggaggctgaggcaggagaatggcatgaacccgggaggcagaggttgcagtgagcggagatcgcaccactgcactccagcctgggcgacagagcaagattccatctcaaaaaaaaaaaagaacatttctgacctaagaatataaaattaatctcttatctcctagatttttatgatttttaaaagaaatcaaaagctctttattccatctcaaatctgaggtagggatctactaccacatttttcaggcctaatacttccctgctgctttaaaatgctgtctttatatcatgtattaaatttccatatacgcatgtgttttaaaaaagtacttaagttaatatgcttgctacagaaatgtgttatacatataaacatgtatgtatgtatatgggggtatttttgccaaatagtggaacagaaattctaggtttttgttttattctctgatttgtttggctcatataccataaattggcagggattttattaattatgtgtgttctttccaacacagaaaaaaggcccccatagaagccttctttactcttaaatgcccatggagatcaaacctaatcctaggcttatcttaatggctaaatctccttggagaataaactaattctaggagcttcaggtggtgtgaattagactatgtgaatcatttcaaaataaaaattattttttaaagaaatccaatatatagatgtttttaggaaaagaaagcaaatcataaaacatgtatgggatgatcagtttatttaaaagcctgtgtgtatgtgactaaatgaacagcaaaaggtctggaagaacatagaacacattaataacactggggacctcttgaaaagcaagaattaaagaaggaaacgaaataaagggagacttctttttttgctccatataatttttcaaaataattgtatgtggagtcaaatttttcaaatccatgaataatatctgaaatatgaatttgcttttaaaacaatattcatctttatgctcttgtaaatgtgtatttattacctttataaatcagaaaaaataagaagaaatacataatagtagttgacattaaggacaagtttgacaatctctttttaagttctttttctcttcattttctttttcacttacacctatatgacaacaggacttctggttcaagatcactgcctgagtatacagacatatattccctccctttcaagacccagtgaaatgacaaaaagtaaagcatggaaaccacaccaatgaacaatatgggaccatcaagcaaaagagatcagaacaaaattcctgacaatagaaaacaaagggcgttaaatattgaagtagaatgtacactacaacctcagaaataccaggtacaaaaccaggattgaaaaaaaaacgtaggtggaaacagaaaccttaactgacagtctacatatccattgtttcattcaacaaaattgaacacccaggacataccagttcctgtcctatgatacaaacaataggcaaacccaaaataaagcagggggcacaaaattgtgagggtggcagtagaaatatcacttcagataagtcaggaaacatttctagggaaaaaaattgagaagagagacgcaaaaaaaaataagggagcaaggaaggagaacaagaatcatttcttaagcaatgataatgatgtaaactgtgctaagatatttaaaaatcatcgtattaaatcatcaccacacatagagttacctccaatttagagatttttttaaaaaatgaggctcaaagaagtcagaaattattcaaggttgtacagataactataataagtaataccaggttttaaatgcagctcaagctcttcaccaaattaataatactaattttatcttctgggaacctacacccatgctaacaaaagccaagtggggtacctagacttctaaacttgccaggctgtaataaagcaccctaaaactgccaccatagtagtatccaagaagcccaagtagggagatagggcctttactcctgtccagcaatatggtgacacctcttcccctcttccccttaggtggtatcagaggaggcctggtagagactgaggactttcaccatcactgagtagtaacaaggcaacccacactgtggtgtcaatggtgataacctgggaatcctggacttccatccctacccagcagtaacaaggtgctcttccttatccctcaggtatcagcaaaggcctcacaggaaattgggacttctatcaccacctggcaataaggagacagtgccccataactttcaactacaagacccaaagaaatccaccgaaaggcacatgataattgaatttctgaaaactgaagaaaaaaaatattgaaatcagccagaaaaaaaaatgacaacttatcaatgggggagggagggcacaaaacaattcaaatgacagcagatttgtcatcagaaatcatggcagccagaaagaagaagaaaaatattttcacgtgataaaagaaaagaagcatcagactagaaatgtgtatccagtaaaattgccctcaaagaatcaaggggaagtcaagacattctcagataaaagaaaactaagataatttgtcattggagatctaaaagaatgaagaatgactattggaggttctctaaacagaaaggaagcaataaaaaaagaaaccttggaacatacaaaggaagaaaaaacacaagaaacaaaattatgaataaataaaataggctttccttcttctcctgagtttcttaaattatgtttgacagttgttggaagtggttttaaatgtatgtagaggaaatatgtgaaactcttttatcataaatgagggacggtaaaggaatataaaaacaggtaagatttctctactccactcaaagtggtaaaaaaaatcagtaaactgtgatacatatgtatatataatataccaagagcaatgtatataaaaatacctaaagcaactactagaagaactatacaaagagagacactgaaaaacacagatgaatccaaatggaattctaaaaatgttcaagtaacccataggaaggcagataatgaaaacagaaatggagaacaaatacaaagacttaagtattaacatataaataattacattaaatgtaaatggtctaaatataccaattaaaagatagaaattggcacagcagattgatgagaaaccacgtcccaactatgccgttacaagtcatttacctcaaataataacatagataggttgtatgtaaaaggatataaaacatatgccatgtgaacattaatgaaaaaagcgtgttagctatattaacatcagataaagtaagctttggagaaaataaaattaccaaagacagagagggacattatataatgataaaagggccgacagaccaagaagtaatagcaattctaaatgtctacacaccaaacaatgtggctgcaatatataaagcaaaaacacagaaataaaaaaatacacaaatctataattatatttgtagactttcaaacactcctctttcaacaactgatagaaaaactagacagaaaatcatcaagtatacagaactcaacataaacaagatctaatcaacatttataggacactcccccactacaacagcagaatacacattctttccaagtacccacagaacatacatcaaatataccatacggtgggccctaaaacaaatgtcaacaaatttaaaggactgaaatcacatgaagagtttctggctacaatggaaaaaactagaaattaataacagaaagacagcaggaaaatctccaaacactttgaaactaaacaacacacttacagtcctgagaagcaaagaggaagtcataaggcaaataaaaaaaaaaaccacactgaactaaaatgaaaatataaaatatcaaaatttgtgggacacagctaaagcagttctgagaggaaaatttataatagcatattttaaaagtggcaaacggccaggtgcggtggctcacacctataatcccggcactttgtgaggccgaggcgggtggatcatgaggtcaggagatccagatcctggctaacatagtgaaaccctgtctctactaaaaatacaaaaaaaaaaaaaattagccaggcatggtgacgggtgcctgtagtcccagctactggggaggctgaggcaggagaatggtgtgaaccaggaggcggagctggcagtgagccgagactgcaccactgcactctagcctgggcgacagagtgagactctgtctcaaaaaaaaaaaaaagcgggggggggggggggggactctcaaatcagtaatctaatctgctaacaagaacctagaaaaaaagaagagttcaacagacccaaagcagaaaaaaaggaagcaacaaagagcagaaattgctgaaattgaaaacagaaaacaaatgagaaaattaatgtgatcaggagatggttctttgtagagatcagtaaaatcaacaaactgctaccaaaactgaaaaacaaggcaggaagacacaaattaacaataactgaaatgaggccaggtgtggtggctcacacctgtaatcccagcactttgggaggtcgaggcgggcggatcgcctgaagtcaggagtttgagaccagcctgaccaacatggagaaatcccctctactaaaaatacaaaaattagccaggagtggtgggcctgtaatcccagctactcaggaggctgaggcaagagaatcgcttaacccggcgggcagaggttgcagtgagccgagatcgcgccactgtactccagcctgggcaacaagagcaaaactccgtctcgaaaaaaagaaagaaaaacaataactgaaatgaaacaggagacatcaccacatagcctgcagacatctaacaaataataagagaatgttataaacaattctacacacataaacttgataatttaggtgaaatcaaccacttcctctaaaaaacaaatgcaacgcatccaatttgaaacagataatttgaattactttataactattaaggaaatcgaattcataattttaaaatttcaaaaattaaaaatctctgggcccactggccaggtgcagtggctcacgcctgtaatcctagtactttgtggggccaaggcgggtggatcacctgaggtcaggagttcaagaccagcctggtcaacatggcaaaatcctctctctactaaaactacaaagattagcccggcgtggtggcacacacctataatcccagctactcgggaggctgaggaaggagaatcgcttgaacccaggagttggaggttgtggtgacccgagatcgcaccactgcactccagcctgggcaacaagagcaaatctgtgtctcaaaaaaaaaaaaaaaattctgggcccagagtgtttcactgaaaattctaccaaatgtataaaaaagaatcagcaccattctatacaatctcttccaaaaaataagagagaacatttccccattcatttataaaggtattatagtattaaccctgatatccagagagtacctgagaaaaaaactacaggacaatattccttatcgatacacgaaaacaatccttaacaaactataaacaaaattcagcaatatataaaaagaattatataccatgaccaagtggcgcttattccagggataaaaagttcgttaaacattttttaaatcaagtaataaaatgcaccaccatatcaacaaactaaagaagaaaatcataaatcaattcattgaggaaaaaaaattgacaacatctaatacctattcatgataaaaaccctctgcaaactaggaataagaagtgccctcaaattgataaatggtatctacaaaaacctacagctaacagctatactactgctacttaatagtgaaaagactgaatgctatatctgtgtaatcagaaacaaggcaaggatatccacttctactactcataaacattgtgctagattcttctagtcactgcagtaagtcaagagaagaaaacaaaaggcacacaaatcagaaagaaaaaactccttatttatagacaatgtgattgtctacattcaaaattccaaggtatctaccaaaacaaactcttagaactaatgcgtgagttcagcaaggtaacaaatacaagataaatatacaaaaagcaaatgtggccgggcgcagtggctcacacctgtaatcccagcactttgggaggctgaggcaggtggatcacctgaggtcaggagttcaaggacagcctgaccaacatggagaaaccccgtctctattgaaaataaaaaaattagctggtggtggcacatgcctgtaatcccagctactcgggaggctgaggcaggagaattgcttggaccccggaggtggaggttgcagtgagccaagatcgtgccattgcactccagcctgggcaacaagaacaaaactccatcattcattcatagacagacagacagacagatagatagatagatagatagatagatagatagatagatagatttttttaaaagcaaatgtatttctatattataaatgtatttctaaacttatttctgtgttctatgtcttaaaacttgaaaatacaatataatttacaatcactccaaaaacataaaatattaagtgtaaatctaacaacatatgcatagaaaatattaaaaactatacaacgctgatgagcaaaataaaaaatctaaataaatgaagaacataccatgttcatagactggaaaactcaccaagaaaagatgttatttctccccaatctgatagctaaacaacaaaattcctatcaaattcctaggaagactttttttgtattcttttttgtgcaaacacaatttttaagagttttacttacagtagcttgattattctaagcttatttttctctttcttcctttttttaaccaaatacccagacttcaatattctaagcttatacagaaaggaaaagaaactagaagagctaaaacaatttgaaaaacaaaacagtacacataataactctacccaaaaagtaaatgggaaaaaaaaaaacctcagtctatgtctcacactgtgcaataaggattaattaactcagcaaaagtctgggtttcccacaccgtgcacgttccgagaaagatttggcccttgcccagctcctaggaagtaacctctaagcccttggaatgtccagcctagtaagaaagtctttctttacctgggggttttaggccactccatatagtctatgctaataatgtgattaatggtgggggccttggaccaaatggtatcagcttgagggctgcagacggaggtcatccatgagggcagtcaaccacacctacataccgacctaccaaaaaaccctggacaccagggctcagctgagcttacccagttttcaatattccacatgttctcatacatcactgctagaagaaacaaactgtgcacatgacttcgcagtgatagaacgactataaatttgggtctggtgtctcctggaccctgtcctttgcttctttttccatcactgatttaaatctgtatcctttagctgtaacaaaccatagccgtaagtataacaactttaagttctgtgattctttatgagaatcactgagtctaggagaagccttggggactcctaaacacacatatataaaaaattaactcaaaatggatcacaaatataataataaaatatttaagaaaaaaatgagaaaatatcttcaagatgtagaaccaggcaaagagttcttaaacttgacataaaaagcacaaaccataaagggaaaaaaccagtacagtgaatttcaaattttaaaacttgtgctctatgaggccagatgtggtgggtcatgcctgtaatcccaacacttagagaggcagaggctggaggatcacttgagcccaggagttcaagaccaacctggacaacataataggaccctgtccttacaaaaaacaaaaacaaaaacaaaagccaggaatggtggtacaagcctgtaaccaaagctacttgggaggctgaagcagaaggatcacttgagaccatgatagaaggatcacagtgagccatgatagcacaactgcacgccagcctgggtgacagagtgagactatcttcaaaacaatgaaaaaaaaaaaacagggagtatgggagggaacctgtgctctgtggccaggtatgacggtatgcaccactacactacagcctgggcaacactgcaggaccctgtctttaaaaaaaaaaaaaaaaaagtccaggtgcagtggctcatgcctgtaatcccagcactttgggaggctgaggcaggtggatcacaaggtcaggagttcgagaccagcctggccaacatggtgaaacgctgtctctagtaaaaatacaaaaattagccaggcgtggtggcgtgcacctgtaatcccagctactcaggaggctgaggcaggagaatcacttgaacccgggaggcggagcttgcagtgaaccatgatagtgccactgcactccagcctgggcaagagagcgagactctgtgtcaaaaaaaaaaaaaggctgaggtaggaggggatcacttgagcccaggagttcaagaccagcctgggcaatgtagcaagctccagtctctaaaaaataaaaataaaaaaaattttaaaaatagtaaaaccttgcgctttgcaggagatacaattaaaagtgagaggtgatgccagctgggcttcctgggtcgagtaggggcttggaaagctgtaaaactcactcatttcctgcatcagggattacttcggttctggataaataatattgaggtataatatatgcttaaaatattcctaacaccaggatttacttatatgttttcttccccaagaaagctataaacagcgagaattttaggtgtaagttttcctgtgtgccctcccccgaaaccagagttaaagaaaagattaactgcccatttttctgtgatcagtgggccttatctatcctcccaattccttgtaaacactgtttgtaagttctataagatcctgcttttttgctgtgcagctgcaaggccataaatcaggtaagcgtaagtcgcaatttcagtttttctcaaaatctaaagcatgtcacaaaataatttactgcctttgtttctcgctcctgtactggaacatacttcccgcctcacatatctcccgccttaaagagtttaaaaggcaatcacccgagctagcagtggcaacccattcgggaccccttccatgctgtggaagctttgtactttcgctctgctcaataaaacctacagctcattctctctcttggtccaagtatctgtcactcgccatggtcagccgccacaccaattctttggcgtggctaggcaaagaaccttgggtgttacatcttagtgagccagccaggagactccaggaagagcatcccaactgccacgcagtgagtaccctcggacctcttttgcttgctattctgtcccatccttccttagaattcggaggctaaacactgggcacctgtcagccagttaaaggcgattagcaagaccactggactaaaaacacgagtgtcagcctgggaaagggctctctgacaatccctgaccctttggagttgggagcactggtttgcccggaaccagttttaagtctttcactttctgtagtggtcccgaagtacacccgggagtgctcagcaaatgtcatggtctcccagatatccaggttgagaccatggccccaccagaggctcccacagcatgggttactaagcgtgagacagccacatcttctgactcctgcgtcctgggttcaaataactgccggttagatttctttcctcacctggtaagcaagattattcccactagacaggaccaagaatccctatttaggagacttaagtttttaaggtggtgttcagaagttccttgttgatggtgccctctggaatttaggcaggtgttgccatctgatggccactttgaaaggccagttccccaccatcgtgtatggtctcccacatcaggacaatttgaagacagatctgtaattttcatgtggatggtagaggccctaggacattttcttcattgttccccagatgaatttcctttttttggtgcctctcaagtataatctgtggtgtatgggtacggcccttagagcagttgaattgctttttcaaccattcaatcatggatattggaagaaagaaaatatagtcaattgagacacgggatactggtaccaccttaagatgggggcttactcctttgatggaaagtggggacaaaaggctagagtgcagcagttgttctctcagccctggcctagaggacatcaaccatcccctttgagcttactaagcctcctgtcactaattcagagattcctccttgaagggcagttttatggccaggcccacgtaaattgggccttgacatgcaagcatcagtggtgcccccgacccaggccttgccaccccagaacagataggacgcgttggcaaagggaccacaataaatccaacagtcctcatgccccatctagtggtcaatgggtgcacggcagagggcaaggatgatttccattctgccggtaagcgtggttaaatctggtaaatggaaggctcaaggacgatcatgcgctccgagcacaattggactggacccttgggggatgccctaaggggaagatgagtccctaagactaaccaggggtgcgggcatacctgtgtttaaaattccagttgggcaccacgccttcaaaactggacactcccttgagatgtatcctgaataactgggacaagttcgaccctgagaccttaaaaaagaagcgactgattgtcttctgtaccaatgcctggccacagtactccttacaaaatggagaaacttggccccctgagggaagtattaattataacaccattctacaactagatcttttctgtaaacgggaaggtaaatggagtgaaatcccttatgtacaggctttctttgcccttcgtgacaatactgctctatgccaagcctgcaagatttgcccaaatgacaaaaacccacaattgcctccatactcagggcctccttccttagccccactctcttccctcactgactctcctccatccagccccaccaaagtgttagaggcacaccgaaaagaaaacgtaaactccgcgaaccaggcgcccaaactaagtcccttacaagcagtaggaggagaatttaggcccacccatgtgcatgtctctttctcactctcagatttaaaacaaataaaggcagatacagggaaattctcggatgatcccaataactatatagatgtcttacaagggttaggacagtcctttgatctagcatggaggggcatcatgttgctccttgatcagaccttaagtcctactgaaaaggagggagctttagcggcagcccagcaatttagggatttatggtatctcagccaggtaaacagatcaaatggccccagaggagaaggaaaaattcccccacagggcaacaggaggtcaccgctgtagaccctcattgggatactgactcagatcatgaagattggagccgcaggcatttgctaacttgtatcttggaagggttaagaagaagtaggaagaagcctatgaactactcaatgctatccacaattacacagggaaaagaagaaaacccctcagcttttctagaaagggtatgggaggctctaagaaagtatacctccctaactccggattccctggaaggccaacttattctaaaggataaatttatcacccaatcagcggccaatattaggagaaaactccaaaagtctgccttaggcccagaacaaaatttggaggcattattaaacctggtgaccttggtgttctataaaatggaccgagaggaacaggccaaaagggaaaagcaagataagagaaagaccgcagccttggtcatggctctcagacaagcaaacattggaggttcagaaaggacaaaaaatggagcaggacaatcacctggtagggcttgtgatcactgtggtttgcaaagacactttaaaaaagattgtccaacaaaaaacaaactgcccccttgcccacgtccaatatgccaaggaaaccattggaaggcatgctgccccagatgatgaaggctctctgggccagaagcccccagccagatgattcagcaagaggactgagggtgcctggggcaagcgccagctcatatcaccctcacagagccccgggtaagctcaaccattaagaaccaggaaatcgatttcctcctggacaccagcacggtcttctcagtgttaatctcctgccctagacagttatcctcaagatccattaccatccaaggaatcctaggacagcctgtaaccaggtatttctcccacctcctcagctgcaactgggagaccttgctcttttcacgtctttcttatcatgcctgaaagtcccacacccttattaaggagggacatattatccaaagctggagctattaactacacgaatacgggggacaaattacccatttgttgtcccttacttgaggagggaatcgaccctgaagtctgggcaatggaaggacaattcggtagggcaaaaaatgcctgtccagttcaaattaggctaaaagaccccaccacttttccttatcaaaggcaatatcccctatggcctgaagctcataaaggaccagaggatattattaggcatttaaaagctcaaggcttagtgagaaaatgggacagtccctgcaacaccccaatcctacgagtacaaaaaccaaatggtcagtggagaccagtgcaagacctcagaatcatcaatgaggcagtaattcctttatatgctgctgtacccaacccctaagccccgctctctcagataccagaggaagcagaacggttcactgttctggacctcaaggatgccttctcctgcattccccagcacactgactcccagttcctctttgcctttgaggatcctacagaccacacatcccgactttcgtggatggtcctgccccaggggtttagggatagccctcatctgtttggtcaggcactggcccaagacctaggccaattctcaagtccaggcactctagtcctccaatacgcagatgacttactttgggctaccagtttggaagcctcacatcaacagactactctagatctcttgaattttctagctaatcgagggtacaaggtatttaagtcagaggcccagctctgccaacaacaaattaaatatctaggcttaaacctagccgaaagaactagggccctcagcaaagaacaaattgagcctatactggcttatcctcgccctaagacattgaaacagttgcagggattccttggaatcgccggcttttgccaactgtgaatccctggatacagtgagaaggccaagccactctatattctgataaaggagacccagagggcaaataactcatctagtagaatgggaatcagaggcggaaacagccttcaaaactttataacagaccctagtacatgctccagccctaagccttcccacgggacaaaatttatctttatatgtcacagagagaccaggaatagctcttggagttctaagtcagacccgtgggatagccctacaaccaggggcatacctaagtaaggaaactaatgtagtagcaaaaggctggcctcactgtttatgggtggttgcagcagcggccatcttagtatcagagactatcaaaataatacaaggaaaggatctcactgtctggactactcatgatgtaagtggcatattaaatgctaaaggaagtttgtggctctcagataaccacctactcaaataccaggcactaatccttgaaggatcagtgtttcaaatatgcacatgtgcagccctcaactctgccacttttctcccagaggatggggagccaattgagcataactgccaccaaattattgcccagacttatgccgcctgggaggatctcttagaagttcctttaactaaccctgaccttaacctgtatactgatagaagttcatttaggtacaaagggcaggctatgccatagttagcaatgcaacagtacttgagagtaagcctcttcccccagggaccagcacccagttagcagaactcgtggcacttacctgagccttagaactgggagaaggaaaaagaataaatgtgtatacagatagcagatatgcttatctagttctacatgcccatgctgcaatatggaaagagagggagtttataacctctcaggggacacccattaagtaccacaaggaaatcatgaaattactgcacgcagtgcagaaacccaagaaggcggcagtcttacactgccggggtcatcaaaaagatgaaggagaagcagcagaaggaaactgccgaggagatgctgaggccaaaactgctgctaagcaggacttccctttagaagtgcccatggaaggacccttagtatggagcaaccccctccaggaggttaagccccagtattccccaagcgaaacagaatggggactctcatgggggcatagttttctcccctcagggtggttagcgacagaagagggaaaggtgctcatacctgaagccagccagtggaaaatacttaagaccctccaacaaacctttcatacaggttttgaaagtacccgtaagatggccaaatccctatttacagggccaaaccttctccaaactatgcggcaggtagtcaaggcctgggagatgtgccaaagaaataatcccttggtccatcataaggcccctctgggggaacaaagaatagggcactatcctgtagaggactggcagttaaacttcacccacatgcctaagtcaagaggatttcaatacttgttggtctatgttgatacctttacaaagtgggtggaagccttcccctgcacaacagagaaggcccaagaagtagttaaaatcttacttcatgaaataattcctatattcggacttcccccaaagcttacagagcaacaatggtccagcttttaaagctacaataactcaaggaatttccaaggcactaggaatacaatatcaccttcactgtgcctggagaccacaatcctcagggaaagtcgaaaaggcaaatgaaacactaaagaggcatttgagaaagtatctcccatggccactctcttgcccatggccttgttaagaatccgaaattcccctggaaatttgatccaaaatcaaagggggctcagtccatatgaaatgctgtatggatggccttttctcacaaatgacctcctgctcaatcaggaaacggccaatttggtcaaagatataataacttctctagcaaagtatcaacaaaaccttaaaactttacccaaagggtatgacaggagaaaagggatagagctgttccaaccagaagatctagtagtggtcaagtccctcccctctaccttcccatctatggatcccttgtgggagggaccatactcagtaatcctctctatccccactgaggttaaggtggcaggagtggaatcctggattcaccacacccgagttaaaccttggacaccccttgaggaacttacaggactatcagctcaggagtctgaagatcagccagaccagccttgatacacctgtgacccacttgaggccctgcttctcctatttcggaaggaagcatcccaggctaaaaagactcctgcagttaatcctaaagaagaaaaactcatctctacctaatagaggataagcagaaagcctacatggatctttgacatctctccttgctctctttaatggagtccttatactgtttcatcatattaaacagtatactaaccataccctttgcagtaggattatatactgtagctcctgccaggacaaaaatcctgaccacatcaaccttttttctatcgtccttccttttaacaatttactccttcttccctcctcctttctactaccgctccacctacagagcaccatgactccctttataaggatctcctaagcttcttttaactctcctaagtattctttctgccacctcttcatccctccccaactgcacttgcttctctagtgcatactctcctccccttcccagaaacactgatgtagtctacttcgaaaggatattgtttaaaactaaatcagggtttactacccacacctatatgagaaaggaatgttatagtgctgcttctctctgctcccacaatggccatacatatcaccaaggacaaatgacccagtccaactgtcccgatgccctagggactacccaatgttggacatattacacccatgtgggtataactgatgagagaggtgtccaggataaagccaaaaacaacatgtccaacaagtaattaaaaacttgatccaaccatctaacactccaagtccatataagaaactagacctttccgggttacaaaagactcttgactctcattcccatctctagagtctatttaacaccacattcacaggaatgcaggaggcctctcctaacaatccaactaactactggatgtgtcttcccttgcgtttccaaccacatgtcccagtagtccctgtcccaggacattggaacctatccacctcagtcctaaacaccaccgggataattggctccccagtcaccaatctgccagccacacaggcctcaaatctcacatgtataaattttagcatgactcccaatagaaacatctcccaaagtcaatcctggataccagtgacctcaggtttcacctgtctaactccagacatctttttcatccgtgctaacatagcttattgatgtctaaagggcaccccaaaagagttatgctttctctcatttctagcacccccatgtccatttataccgaacaagagttggaaagtctccttataccccagtcccgccacgcccgagcgcctattctcccttttatggtaggagccagaatactgggtgggcttgggacaggaattggaggtataacctccttcacccaattctattataaaatatcacaagaattaaatgatgatatggaatgggttgccaattccctgatgaccctacaaagccagcttaattctctgactggggtggccctccaaaaacgaagggccctagacttactaacagctaaaagaagaagaacctgcctcttcttaggagaagaatgttgctactttgtcaaccagtcaggaattattgccgaaaaagtccaggagctaagggaatgaagagaacgtagaaagagtgaactccaactctcaggaccctggagtatatttaaccaatgagtaccttggcttctcccctttctaggccctgtaacagccatcttgctatcactcgccttcggtccctgtatttttaacctccttgtcaaatttatttcctctaggataaaggccatcaagctacaaatggccttacaaatggaacctcaaatgaatttaactcaagcttctaccgaggaccccaggatcagcccactggtctcttaactggcctagaaagttcccctctggaggacaatacaacagcagggccccatcgtcgcccctaaccagcaggaagtagctagagcagtcatcgcccagttcccaacagcagttggggtgtcctgtttagaggggggactgagaggtgatgccagctgagcttcctgggttgagtaggggcttggaaagctgtaaaactcactcatttcctgcatcaggacttacttcagttctggataaataatactgaggatatatgcttaaaatattcctaacaccaggatttgcttatatgttttcttcccaagaaagctataaacagcgagaattttagctgtaagttttcctgtatgccccactcctcccctgccaaaaccagagttaaagaaaagattaactgcccatttttctgtgatcagcggaccttatctatcctcccaattccttatgaacatagttcgttaagttctataagatcctctttttcttgctgtacagctccaaggccacaaaacgagtaagcataagtcgcaatttcagattttctcaaaatctaaggcatgtcacaaaataatttactgcctttgtttcttgctcctgtaacattcttcccgcctcacgtatctcccgccttaaagagtttaaaaggcaatcacccaagctagcagtggcaacccatttgggaccccttccacactgtagaagctttgtactttcactctgctcaataaaacctacagctcactctctctctcagtccaagtctctgtcactcgccgcagtcagcctccacaccaattctttggcgtggctaggcacagaaccttgggtgttacaaaaggataaaaagacaagatacagagtgcaagaaaatatttgcaaacaatgtatcaaacagagtagtatctaaaatatataaagaactctcaaactcaacagtaaagaagaaaacttctgggcacagtggctcatgcctgtaatcccagcagtttgagaggccaaggtgggtggatcacttgaggccaggagttcaagaacaacctggccaaaaggtgaaaccccatctctactaaaaatagaaaaattagccaggcatggtggtgggtgcctgtaatcccagctactcaggaggctgaggcaggagaatcacttgaacctgggaggcagaggttacagtgagacaaaatcccgccaccgcactcctgcctggacaacagagcaagactccatctcaaaaaaaaaaaaaaaaaaaaggaaacaatacaattaaaacacaggtaaaaggcatgaagagacatttcactgaagaaaaaagaaaacagacaagtgggaaaataagcatatgaaaaactggtcaacattacagtgattaagacctggttttcaggccagcatgtgagaagcctgaaagtcattatctaacaagtaaaaagctgaacaaagtgaaaaagcaacaactcttcttagatcccaaagagaactgaggtcacagtgcaaacagctgctcccaaaacagaagagagcaacatggcaaatgcatagaatacttattagagcttgaaacttgtgtgggacacagcacctaggtgggaaaacttgaattgtattaattgctggaggctgagtatgaagaagtctgagagttaaaaattccaaaacgaccccgtcatagggagactaccagacttttacgagttttacttccaggagtttgacctggttctcacagtaagtatcagagaaaaatcccctcatgactccagaaaagggaagataaaagggtccattttgaaatataccagaacattctattcttaataaggtctgccctcaggagaaactatttaaccagagcctaaactctttgtagttttaacagagcctaacttaccttggggaagagaaataaccaactccagtcaattctagtcttccgggtggttaaagggaaatacccaactaaagctccctgtagccatcctgtcccactcaagttagtaaaaacagaaaaaaactgagaagcatctgtgaagttacaacccaggggcaccggctcactaaaacactgaggccaaatcgtaggacacttcccctccccacacaccttaccaccacattactaaaggtctgctcaccagtttcttttacccagtatatcacgatcagctttcaaaaaataaaaataaaaagtacaaggcatactgtaagacaaaaaaaaaatagtttgaagaaatagagcaagcttcaggactagactcaaacacggcagggatattggaattactagaccaggaatttaaaacaactatgataaatagggtaaaggctttaattgaaaaagtagacatcttccaagaacagacggataatgtaagccgagggataaaaattccaagaatcaaaaagaaatgctacagatcaaaaatactctaatagaaatgaagaatgcctttgatgggatcattagtagactggacttggcacagaaatctctgagcttgaagatatgtcaacagaaactcttaaaactgaaaataaagagaaaaaggctggtaaaaatggaacataattatttaattaaaaaaaaaaggagaagaaggcagaggctgcagccagccaagatcacaccactacactctagcctgggcaacagagcaagactccatccaaaaaaacaaacaaacaaacaaacaaacaaacaaacaaaacacattatatccaagaattgtgggacaactacaaaaggtatgccttacacccttcacaaaatttaactcaaaatagatcacaaccctaaatgtaaaacacaaaactataaaactcccagaaaataacataatagaaaacctagatgacattggttatagcaatgattttttagataaaacggcacaatccgtgaaagcaacaactgataagcttaacttcattaaaatagaaagcatctgctctgcaaaagacaatgccaagagaataagacaagccacagaatgagagaaaatacagtaggccctccatatccgcaggttccacatctgcagactcaaccaaccgtggatcaaaaatattaacaataaaaataatcaaactttaaaaacaatatagtatggcaactatttacacagcacttacattgtattacgtattgtaaggaatctagagatgatttaaagtatacagaagtaagtgtgtagattatatgtaaatactacactattctatataaaggacttgagcatcctcagattttggtatcaggggtcctggaaccaagcctccacaataccaaaggatgtctttatttgcaaaagacatgttcgataaaggcctctcatccaaatatacaaagaactctaaactcaacaataagaaaactaacaacccaattaagaaatgggctttataaagacctttacagagacctcatcaaagatgatatacaggcagcaaacaagcatatgaaaaggtgttccacctcatacatcatcaggaaaatgcaaattaaaacaacaaaatactacacatttattagaaaggcaaaatccagaacactgacaacaccaaatgctaagtaggatgtggagcaacagaaccctcatgtattgctggaatgcaaaatggtacagcctctttggaagacagtttggtggtttttttacaaaactaaatatacaaaattaaatatatagaaaactaaatatactcttaccacatgatccagcaattgagctcctaagtatttaggcaagagagttgggaaccaaaataaaagtcctaacccttccaacagactactggaccctcctttagctaaaagaccccaaaattttaagttagcagccatggcaagacagtaagctgttcatgatccatttgcttccaacccacttctctcctttctaatcactggattttctcaaaagccagtgtgagaaaacaaaagtccaaaagaccccttcgttcaagtcatctaaacacaccccctcctgtttttatagtttcaacatgacaactattttaggccacaaagattttcttcttgataagtggcttttggaagggactggttctggccagtcacctgaggatgcagtttatggacttcttccctacatttcaccttttacatatagaacctaactacaatgcatttaaatattaaatctccacctcaaagtgattatgggaggtattttacatatgagtaaacctaaaacgcatgtgtgtgggtctccttcatgaatattcatggttccttctgtaacctgttgaatatagctgtatgcctagccaatcatcagcataagttcttatcttaaaccctcaccttactggaccccactctgcctggaaatgcctctcaatttctgctgagactatgcctcccagcctgtcagaatggcctatacaagctgcaaacctttgtgagaaatgaagctctcctttccaaatctatgaacctcatcattcttcagctgacagagttgaaagctgacatccacacaaaaacctacacacggctgtttacagcaactttcctcataattgccaaaacctggaaacaaccaagatgtccttcagtaggtgaatgttgataaactgtggtacatccagacaatgggatattactcagcactaaaagcaaatgagccatcaagccatgaaaagacatggagaaacttaaatgcatattactaagtgaataaagccaaacccacagaatatacaacaccaaaagtgaaccctaatgcaggggtccccaaaccccaggccacaaaccagcaccggtcagtggcctgttgggagcccagctgcacagcaggaggtgagtggctgcaggtgagtgagggcagctgagcaccacctcctgtcagatcaatggcagcattaaattctcatagaagcacaaacccactgcacatgcaagggatataggttgtgcgctccttatgagaatctaatgataaatataatgcaatgcacctgaatcatcccaaaaccaaccaccccactccaccctggtccgtggaaaaactatcttccaccaaaccagttcctggtgccaaaaaggttggggactgctaccctaatgcatgaacactgggtgataatagtgtgtccatgtagttttatcaattgtaacaaatatactacactagtaggagataatgacattggaggaggctgtgcatgtgtggggacaagagatatacaggaaatctctgtacctcccaatgaattttcctgctgctctaaaaaaactgctctaaaaaatacagtctattttttaaaatgagacatcactaccacaaggaaataccattatactatcaaaatggctaaatttttttacactaagtggtagcaaagataaaaagaaaactagatcacttatacatacattgctgatggaaatggtacagtcactctagaaaactgtgtggcagtttctttaaaatctaaatatgctactacacaatccagctactacactcctaggcatctactcacccaaagaaatgaagacataggttcacagaaaaacctatacccacatgtttatagcaactttactcataatagtcaaaaactgaaaacatcccaaatgtttttcaataggtaaatggttaaagtgtattctctccaataccaccattactgaatgctactcatcaataaaaaggaatggactgttgatacatgtaacaactggatgaaaatccagagaaaaaagccactttcaaattccagttatgattccatttataaagtattcttgaaaaacaaaactatagaaatggagagtaaatggcttccaagagttaagagataaaggagagggggcagagagagaagtgggtgtgggaaacatgaggtatgtggaaatgttctgaatctcagctctatcaatgtcaataccctggttacaacactattatttcttaaaactgtatataaatctataattatctcaaagtaagaagtttagttaaaaagatgaaggaaaaactcttatgactagagggacaattttctttttttgagatggagtctcgctctgtcccccaggctggagtgcagtggcacgatctcagctcactgcaagctccgcctcctgggttcacgccattctcgtgcctcagcctctcaagtagctgggactacaggcgcccgccaccacgtccagctaattttttgtatttttagtagagacgggatttcattgtattagacaagatggtctcgatctcctgacctcgtgatccgcccacctcagcctcccaaagtgctgggattataggcatgagccaccgcgcccggtcgattagagggacaattttatttgatatacagcaacactgaacattattaaatattcaaacactataattttcagtatgaaacaataaaacatatcccctgaaaattcttgtaccacaaccactcttcaaagattcatatataaacaataagaattttagctcaccttccacgctatcagaacaggaagttccaatgccagtgtctccactgtcagaagctatactgtgtctcctgatatggttatttcgatggttagatggaacagttgtggcctgccacaatgattcattagcaggtagccatgctgatgaataatctgggcctaaaaagggaaatatgtaacagttaacacatatatctgagtaggcagaagattttttttttaccttgtggaaaatacacatagggtataaaaggtataaaaggttcttttctgcccaaaataatttaaaatgatcaacaaaattaaccaaataaatgtatatatcacacatatatcaattaagtgtgattacatagcttcctctagctgaagaactctgttttctgcttccgggcattaaacttttaaagacgtactgctgtgttattaaaaatgttggaactatccacttatcttcaaatgtcagtactctgctctagaataattgataggtggcatctgtgattatacatacatgcgttagctgaaaatcagggctcaggaaaattcaataataatgcatgataatataaataggatatccacatggaatatgaaaacaatccatttttttctgctatatatctactaaattttttctacaatcatcacttaaaatttttaaattttacattattttatttgaattatttccttaattattatttaataacagtttaatagcacagcattttcctactcttagcttgatttgtctttttttttttttgagacgagtctcgctgtcacccaggctgggtggagtgcagtggcgcgatctctgctcactgtaagcgctgcctcccgggttcacgccattctcctgcctcagcctccggagcagctgagactacaggtgcccaccaccacaccccgctaatttttggcatttttagtagagatgaggtttcaccgtgttaaccaggatggtctccatctcctgacctcgtgatccacccgcctccgcctcccaaagtgctgggattgcaggtgtgagccaccgcgcccagctagatttgtccttttaatttaaatactttttagctaatttaaggtttttcaatgttctttcaatgtttatttccacttactcacttttacttaacttttatttgactttttctgttttacccatcacttattttattgtctagtacagtgctactcaaaggatatcaatggaccagtgccaatctgtactatttgttacaagttagatgcagaaataaataagcatctagaaatgttattgtactataattagaaagagaaattttaaattcgttcaactttacataaaacctgtagaagcacaaatctttactaatgcctaatacagtaagtctcaattcagggcttacagaattattcataaaagttaagaagttcccctacatgaattttaggctctcatttcaatgacagttcttaaaaaattaataagcacattacagattatctgaacagccaacttaaaacattatttccacataatttcaatgctcccgtatctgtatagcagccttaaaaagatttatcacataattcaatgtccccatctgtgttttgcggttgaaatagcagttgcttctaagtaaagagcaaatgacatcactgggtatttaccattatttgaaagaagatagctttacagaattattcattgataccctattgaaaccggcatgcaaggaatgccttctggcagtttaaacataagggtaacaaaacaacaaacgtgcataaaattaattataccagtttttttaaccacacttttaggattagttgttctctatgtcagtattaaaatcaaaatatataaacaaattaataaaaccagacctaaagctacctctatcatactaagctcaacattaatgattcacttttaataaaacattgtcacattattttatttaatgcatttatttatttaaatgcaatttatcaattaaatttaggctttatacatgtataaagtatataagcagccttaaaagccttatacatttaaattaacaaatcaaatttgaaaaacagtggccaaagagacacttttaccagctttgaggttcagaacaaccacttaaagctttgtagattctagacttctctcagaatgagacttttcaattcaagtgattcaacactcacattaaagcaccagaagaaggtgttctgtcaccagatctattctaattctgatctgtggtctgtaatctataccaaaattttttttcaatcaggtaacatcccatctaaatgagctcaaagtcctgcctaaactattatcaaaaatggcaaccagcctagtctcacaagtgcaaacctattagctggataattatttttttttaagaatacccagcaaatagcataaataggctgggactatatgtaaatgaaaaaataaatataagaaacgatgccaaatctcactaatggtgggagaagtgaaaaagacaataaattttctggatttttaaaactatcaagttgataaaagaaagactggtgtcaaccaagtgaggggaatgttcgtatatttttgtggccttgcaaattggtacaacctttctaaagggcaaactggaaagtggtatctaaatgtcaatatagacatgaccttctactgagaatttatcctaaggaaatatcagacaattacaaataaatatgagtataaggacattcctgacagcactgcttaaagtaaatgcctatgaacaaaatataaactgttaattagttgataatgtttaagtgctaaaaatgattttatcaacctattttttaacatggaagaacatccagaatatatctagtgtgtatggaagagaagcattttatgtagctatatacataatatgattccacagctggagaagagtttgtacatttacatacatggaagaagctttcagggagctctatatctaaatgctaacactgactatgttttactaaaggaagaaatacattacaggaacatttactccatcattggttattattattattcaatctaccagtttatgtggggaaatgctgaaaattatgcatactgatttgcagattacatcaacatttgattctgagattagaaaccagctatagctcaagatacgcaaattcagattcctagtaacaatttttacaaaagctgcataaaatggctagaattaaaacccttgcttttaggcaatataactattttgagcagtataaagtcatgctccattaaagcctacaacacacctccaccctattgattgttgacaagtcttggccaataaaccatttgtggattaaaaggcaataatcattctctctctcactctctctccactcactcactttctcactccagtaatggggaggaaagcccactgtacatattaatgctatggtgttattatcacaagctaggacaaccttcaatcattagtcttgtataattaactattgccagaaaaacagttcaataaaacctttttctgtcaagagccagattgtaaatattttcagttttgtgggtcactcaatctccgtctcaactagccaattctgccactgtagtctaaatcagctgtagacaataaaatggatgtggctatgttgtaataaaactttatttacaaaaacaggtgacaagtccaatgaaacctgggggccagtttgcagactcctgagatgtggtaaaaaatcattctaactgaaaagagtccctaaaattcaactgattcataagtaactacagccagcatattaattcatttctttatttggaagaaaagtgagctcatcctagagtacatatcagcaagccaggctgcccagaatctgacaattcatgaaagcactactgaggtttttcaaggattacaaagacaaataaatgtcaacaagtgttttaggtttctttttccagaataaatgatctcagtttatccatatggtatggaactcctggacaatgtcaaatatgtgtgatggttaattttacatgacaacttgactggaccatggggtgcccagatatgcagtcaaacattacttccgtgaaggtgtttggatgagctcaacattcagattggtcgactggataaggcagactgccctccataatgtgggtgggcttcactgaaccagctgaaggcctgaacacaacaaaaaagctaaccatcccctaagcagaagagaattcttcctgcctgatcccctttgattaaatacactagtacactggctttttcctaccttcaagcttgaactgatctcttcctggggcttgagcctgccagccttcagactggaactatgctatcaacaatcccaggtctccagcttgccaaatcacctcacagatcttgggacctgtcagccaccataatctcatgagccaattcttaattaattaattaaatgctattggctctgtttctctggagaacttcaatacaatattgggaaaactagaaaaattctaatcttgcctacagatatgaaaaagtggggacagccttctatttagaaaagaacaatagttgtaatcctcaatttccattacagtatttcaatatcatctactcaatatgatacctattccacagatttccaaagcacatcagtacaatctcaactatctgttatctaacttttatacaaaaaaagctataagaaatgacagagaaaatggtctaagacatgctatcattccgcccctctagaaaccctaaattctatctttgaatcacagagcagtacatacatacttagagcctttttatttagcaactcagggaaatgatcttcctaaaatttctttcagtgtactgccaccttataaacttgaacctctgacttttacagaaggacacaaaaagtaagcaaaccacataaatcatcaaattgttgtctaggccgggcaaggtggctcacacctgtaatcccagcactttgggaggccaacgctggcagacagcttgagttcaagagtttaagaccagcctggaaaacatggcaaaagcccatctctacaaaagaaaaaaaaaaaaaaattcaaaaaaatgcctctgtgcatggtggcacatgcctgtagtctcagctacctgggaagctaagctacttgaacccaggaggtggaggctgcagtaagccgagatcatgccactacactccagcctgggtaataaagcaagactgtctcaaaaaaaaaaaaaaaaaaaaaaagttgtctatatatttaagaagttaaaggcaaacactaaaaatatttgcagatatggtattaatgcataattataaagagatcataagcaaactaaaaataaataaataaatactaaatggtttagtctaaatggacaaaggacaaaccccaaagggaaaaacacaaataaaaaattctgaaaaatagtccaagcccactggtaagcaagtagtatcaaattcagaagacatgctatttttcagctatcaatctagcaaaaatgttaaaagaacaaaacaacagtgttcctagatactcccatacactgataatggtaatgttaatttattcattacaaaaacacaaccttttgataggctattaggcaatatacatcatgtgtagcacatgcctgtaataccagctactcaggaagccaaggtaagattgcttaagcccaggagttcgagaccagcctgggcaacatagtgagaccgtctcaaaaaaaaaaaaaggaaaagaattaactatataaattgatctcctcccacctgaactaatttgccttaacctttaaacataactatgtctttaaaaagaagatctggtattgtatgtgcctcaaacactgaagatgattaacaaatgtcatgaaaataacattctaatcttttaatttaaactgaaaaaattcacagtctgaaaagaatgacatgacttgtctttagacaagtcaatccagaagcacaatacaggaagaagtacatgtgaaatatgctgaccaggtgatttaataaggaaaattttctcacagaatagttacaagactatgttactgaaatgggaatattgatatctagtatgcaatatgcacttaaaaactcaaaataaggctgaataacctctggcaataatgtcttacctaaagacaaaaggactgctgtaagaacagcaaagatcccaagaaactctacattggaactcctccttggaagacaatatgttacatttttcaatactaattttttaatactaattttaattattttaatagaatactgagtgcctgcggataacattaaaaattctgaatatttctcagacaggaagattagcattaaataaaaaagcaacctattttacttctgaagctcttttattggaagcaaaaatgcatacagtatcaagtattccacagcatttgaatatatatgtaactgcactgagaacaagaactactctcattgaatattttaatgacagctctaaattgaagaaaataaaaataacactactgacaaagcagatttatacttttaaataagctgaatacataatacaaatcgagaatacaaattgcaatgtttttcagaatgcagattatctgtcacccattagtatgttttaaaatcaacttggaaaccaacactttcaaataaaatagtagataaagcatgtttacccttatattacataagtagcacgcggttcacattttaacatctctgaaatattaacaagtacttttgcacaaagaacctattctgctgctggaataactccactcaagccagcctctactctactatcttctagaatcaagcatgtttatgttattcttctacttacatagatctgtgagccccttacggcatattaaataaattcaaactccttaagttaggcaaagttcttcaccaattgtcagcttcactttgcaacttctacctacaaaaactatctagccacacttacctaatcacttcctccaaacagatgagactctttcatgactccaagctgtttcacttctgcaccttaagagtcctagttcagaattaacttgttctgtcttccctgattcctccaggtggcattaaatactttgttcactcccaatatattattcaaaattccaacaacatttaataaattatattaacccatatgtatatgactttcttctccctcaccaaactgtgaaaaatgaaaggcaactttttttagtgtccagtacctagcaaagagctgcacacttatacagggtctcaataaatgtagtcattataaccactggatacctaacaaatgttcacagaataaaattagaattttggaagccttacaattacaactacaaaaatatctttgtgttcagaaaaaggattcaaacaagcgttttgtttggtggttgttgtctgcttattttaaaatccaggatattttaaactatcccttgagccagtatgcatttaagtatctatttagagatcagtaaatatttatcaatgcagctttttttaaggtaattttaaataatttagagatctgatggccaacattcctaacatgggaaaacagtctccaataggttaaaaagacacaaaactcacacaaaaaattagaacattaaacggtaagaaaaaaacgttcatattaacagtagccaaacagaaaaaaccaacaaatctggaactacactgcagaatatctagctaagatgacagaaacatcacatagtgttattttctccatcccaatcctccactccatttcagtactatttatctctagggtaagtgactccaatagtcttagtttgtttcttttatcacagaattaccagtatagctcagtgtgcactgtgaaaccaggctacctgggttcaagttcattctacctcttattagcagtaagtcctcataaatcacttaacctctctgtgcctcaatttcttcatatgtaagagaagaaaaaaattatagaatagtacctatattatagggttgttgtgatcaatgaacatgtaaagttttttgttgttgttattgtttttgagacagagcctctctcagttgcccaggatggagtgcagtagtgcagtctcggctcactgcaacattcatcccccaggttcaagagattctcctgcctcagcctcccaagttgtgcggattacaggcacacaccaccatgtctggctaattttttaggttttttttaagtagagatggggtttcgccatgttggccaggctggtctcgaactcctgacctcaagtgatccgcctgctcagcctcccaaagtactgggattacaggcgtgagccactgcacctggcctgtaaatatatttttgaaagtgccagacatataattaggatctcaataaatgttattatttttattactgtccatgcatagaaattttccagaaggataactaaaaactattaaaaatggagtggaggactgacatgaaaggtagataaaaaagcttacttcactttaagcttttctgtactgagtcaacattttactgagcatgtgtaactttaataatgagaagaaaaaaatcatctgacaaataccacataacaataattcttctgctcctcatgaggtacagtaccccactctcttccaagtttttaaccttgctcttttccctccctatttaatcaaggacatctacactgtcaccagcttctctcttaatatcttactagcatgtttacaactacttatctccttcaaaacacaaacccaatgcccatctctctgataaccaccacttttttaacatcattccaagagattaagcataagctttctatctctatgatctgcaaagtgaatacatgcatgccagggagtacacgagccaatccactggcaagctgctggaagaaaaaaacttgtttatactgaaaattatctttaggaaaaagtaatgcattaaattttgctataatatttaacatacaggttaacactagtgcccttacttggattatcagagcattatgttacatatatataacataaacggaggtgctctatacagagggcttgacggtgacatcctcctttgttcatttgattttttcgtatgggtatgcattgcagttcatggctggttaagcagatttgcatatcgataacattaggtagttttacttaaactagccctcacaaaatggatttgtggctctatattactgcaaagaaacctgaagttgaaaaacctgaagataatactaaaaatgtaagtataaacaaacaagaaaatagtcaagctgatgcctcccatgcacacacttcaacattccttttgcaagagaaaaaaaaaaaattacaaaattagatctgacagtaatatgtcacctagcatttctgtttgaaaaaataaccattgatccccataagggtaaagatgatgctttcaaatgaaacgttcaatatgtagagggcatactggaaatcaacatgactcttgtatctgcatatgcgagttggaaaaaataatttttaaaatatatcaactgtatgtaccactaaaaaaaaggatgccaattaaatgacaccctgaattacatgatgcatccatatatcagaaatgctaaaacatttttaaagtacattttaaaattgataaagtataataaatattgcatacataaaataggagcatttgggtgaaatttttgctgttaggcatgtctaaaaaataaggagtccattggttctctatggtctcaaaacatttgctataccctaccctttttatgaaaggtttgtaaaatgtgtcaaaaaaataaaaataaacaacaggtagcaaaacggggaggtgaattgagaaactgtgctgctccaatcccaaaagagatccaaagatctgctcagacatgaaaagttaggttctagccagaagtaaaattctaggccagaagaaagtaagaatcaagaataaagtaagatcagattccaagattgggaattaaacttaagcagtcactgaagatgctttcactcagctaaaataaggttagcagcatcaagtaagtatactttctcacataaacacactagttaaaaaatacctacattaaaatctagctcaatctaagctaataggctttcttgggttgggcacggtggttcacatctgtaacaccagcactttgggaggctgagcagggtggatcacctaaggtcaggagttcgagaccagcctggccaacacggtgaaaccctgtctctactaaaaatatatatatataataaattagtccagcatggtggtgcacacctgtaatcccagctacttgggaggcggaggttgcagtgagccgagatcacaccactgcactccagcctgggtgacagagagactccgtctcaaaaacaaaaaaagctgtgttcaaaaaagcattttggcaactattaggaataacagccacgtatttagtttttggtaagtccttgttcctgtttaaaaactgggaaaataaggtacagttaacaactaatgaggctgttcataaaaccactacaaatatatacaacttggtatttcagacgggcttatctttgtcctagaacataagaatcatacacaatacatttaaatggctaaagaaaaataaagtcttaaaatattacaaaataattgagaaaatttataaatatatggaagttttctgttcccaaaattaaagcacttaacttctagtccaacttttcagtacattattcctaaaatgagacagaatgctcagtattaatgagaatgctttagaaaagcttcagaaatgtcatagcaaggccatatatatgtaatttcttatggtcaggaggcaatctctgcctctacaaaagcaatgtaatcaactggtagaaaatgctaaactacatgaaacatagtccaaatctttcatcccaaaatctttcagagaaatatataactaaaaactatagttcatttcagaactctaaactttaatactaaaaactattttcaaaacgagtatcaataaagcaaataagtttcattcactagacattaacagtgtagaaaggcatacaacagtttctgatcttacattaactctctttaaaggaacttaaaatcctatcaacgactttaattaatttagcactacctaatgaagtctttaaacaatttacagcaggagaaaaaaaacaaaagtaggggtagagttacttttctgaggtagattctcagatcagacagaggttaagaaaagcatgaaataaaactagatacagtactaaagtctggttccctgattgagagaatcttctattctgaggggcgagaacactgttaacaccagttcagacgccctgagcagacagagtaccctggtcaagacttggccactgttcagtgtaaggaatcccagaaaacccttcagtcctaggcaacctatgacacacaacccctagttttaaaactgaaacgtcaggcaaacccagacaactggtcaccctagcttaataagtggtaaagagcaattcaaacatttattaagcacttatgtatcaatccttatgcaataaagtcagctccactggattagataatctctaatttctgctaggtttatatttttaagtatctcactgaaactggccaaatgcattgatgcattttcttctgactcatcttacatggctgcctggaagcatgagactggtgatcactactgccttcagactcctctctaccagaacacttcattgtcctgcttttactcctaccaccctggctgctccttctcagtgtctttggacggcacatcttcctctgcctgaagagaaaatgttagtgtcccagggcttagtcctctactgtcttctctattctctcggtgtgatccatgacctttaaacaccatttataaccaagtaattctcaaattcctatctctcacccagcaacctccctactgagctccagcatttatacccaacttcatattcaacatctcacctgaatttctcaaaaggatctcaaatttcacatggccaaaaagaactcttgattccatttattttccttacactctctccccaccgccctctgcccactaaccttccccatctcaggaaatggcatcactatcgattataatcacagaagccaaaatcaagatgtcatttttgactcctctttcccttaattgacaactccaaaccatcagtaaatccttaagatttctcatgtatataccaaatccattttcttctctccaaatccaatctaaccattctaactcaagccatcatctctcacctaataactgcaatggcctattagctgtcttccctactgctgttcttgccccactcctctacaatttcttcttccacagaatagccaagactgattgtaaacacctaggacaaggaatatctgttccatgtccccaatacatgggaacagtatctgcctcatagtaggcactcaatgtgctcaggagtgaaagaatgaagtcactccccggcatcttctgacatgcagaatagaatccagactccctacaacccctaacattattatcaggccttcctcacctcacagtcctgctcactaagctccagactcactggagttcttcaaacttctcgaactcatttccgccttggagattttttgttccctccacctgaacacttctcccttcacgtctggcttcttctcatcattcaggtaacaatgttacctcctcagaggcctccctgaccagctactcaaggagctctgcccatcctctgccacctcaccaatcttcttttcctcttagtacttaacactagctgcatcatctcactatctgtttacttactgatcctcccctctaaaatgcaagccactaccaggcagcatggtggttcatgcctgtcatcccaatacttggaaggcccaggcaggagatcacttgagcctaaaagttcaagaccagcctgggtaacagtgagacctcatctctacagaaaatacaaaaattagccagcagtcagtgcacatgcctgtattcccagctgagcctgagaggctgaagtgagaggactgcttgatcctggcaggtcaaggctgcagagacctatgattgcacaaccgcactccagcctgactgacagagtgagacactgtctcaaaaacaaaacaaaacaaacaaacaaacaaaacctaaaaaatgtttttaaaagtaaaatacaagcctccgtagagcaagaaccttatctttcttgttcaatgatgtatccccagaggcttatacaatgtctagcacaccatatttattgaaagaataattcacaaacatttctaatgccaaggtaacaagcactatgctaggtaaccattttttttttaattaaagaaaaacagaaatcaaaatattggtatgaaaagtaatttggggccaggcgtggtggctcacgccttaatcccagcactttgggaggccgaggctggcagatcacgaggtcaggaattcaacaccagcctggccaatactgtgaaatcctgtctctactaaaaatacgaaaattagccaggcatggtggcacacgcccgtagtcccagctactcgggaggctgaggcagaagaatcacttgaacccatgaggcggaggttgcagtgagccgagattgcgccattgcactccagcctgggcaacagaacaagattctgtctaaaaaaaaagaaaagaaaagtaatttgatgttatttttatgttgatcatgcccatccttaaatgaccctatacaataaattgctcttcttagaatattactttgccagtgtaaaatatgaaaatcctgatagtaataataataatgaataacatgttattgcttaaaaattggctgggtgcagtggctcatgtctgtaatcccagcactctcggaggccaaggcaggcggatcacttgaggtcaggagttcaagaccaacctggtcaacatggtgaaaccccgactctacaaaaatacaaaacattagccaggtatggtggtttacgcctctaatcccagatactcgggaggctgaggtaggagaatcgcttgaaccccggagacggaggttgctgtgagccgagatcgcactccagcctgggtgacagaatgagactctgtctcaaaaaaaataaaaaatgatattgcttaaaaagtgtctgatgatcacgttcttcactttcttaatgcaaaatttatgtaattaggctataactcaggaaaatactatccagaagactttatgtcttcatcatcttttcagagtataaaaatacacatttcatccagtctgaaaaatcatgactctctcaaccctttctgttcacacacataaatattacaacatgacaatagaggttatcaactcaccatttattgcttggcctcagattaatttaccagcttcattcaagccaggaagtgatcaaattccaattattaatcaagttcatttcaccaaagtcatcactaaagttaagattcaccccttaccccccaatacctattatgaaagaacatgttcagttgggtttaggccagagttatgtttcattgttaccacagtattcctagaagtccatctaattcagaaccacagcagaaaacaatattattagttgtaaccataccagttattaccactatcattatgacatcactaaacaccttatggcaagcatcaattaagaggtaaatgtaaagctcaaagcaatgaacaaatgacattttttcagctcaagtgtttcctgtaacattttattttcgcacactataaaagtataatactctacctcaaaatgttttaagagttgaatatatgttttcgcttttgttttttaaagagacagagcctcactctgttgcccgggctggagtgcaacgacatgatctcagcccactgcaacctcagcctcccgggttcaggcaattctcctgccttcagcctcctgagtagctgggattacaggcgcacgccaccacgcccggctaatttttgtatttttagtagagactgggtttcaccgcgttggccaggctggtttgtaactcctgacctcaagtgatccgcccacctcggcctcccaaagtgctgggattataggcatgagccactgcgcctggcttatgttagtattttaaaaaaattatttacgaaaaggaacatacttagcacaactaggtattaggaagtactcaaagtatcactttatcatgcttgatttcaaaagcctacgggaaatatgtctatccttcatccaacttgaaaccagtatacattctgaacaatagggtaatctcaaatgcaatcaaccaaatgcataaaaagataccaattgttctattttaaattagccttctaaccacacttgccaatacaaaaaagagaggcttttatttgatatttgtaaggaaacttaagaaaacactcattttagctgggcgcggttactcatgcctgtaatcccagcactttgggaggctgaggccggtggatcacttgaggccaggagttcgcgaccagcatggccaacatggtgagaccttgtctctactaaaaatacaaaaattagctgggtgtggtggcacatgccggtaatcccagccatttgggagactgaggcacgagaaccgcttggaaccgggaggcggaagttgcagtgatccaagatcgcaccactgcactccaggctgggcaacagagggaaactctgtctcaaaaaataaataaataaatactcattttatttttggtttataacagttactccaaaaagctgaaaaatgggaaaagccaaattaaactgaatcctaaagcgaaggctaaaagttcagtatttttcaaactacacttattattcctattttttactgccatttctttaaaaaaaaatttcttctgatttttagaaagtggttctataagccgggcgcggtggctcacgcctgtaatcccagcactttgggaggccgaggcaggaggatcacgaggtcaggagatcgagaccaccctgggtaacacggtgaaaccccgtctctactaaaaatacaaaaaaataacccgggtgtggtggcgggagcctgtagtcccagctactcgggaggctgaggcaggagaatggcgtgaacctgggaggcggagcttgcagtgagccgagatcgcgccactacactccagcctgggcgacagagaaagactgtctcaaaaaaaaaaaaaaaaaaactaaagtggttctatagtacctttggcttttcctttagtctagttatatatttgtataaacaaataaaccagtttcaggacagcttgaattaatccacatattaagataaactcattttaataccagaaattatttacttatccctgccttcacactttgttttcagacaagtccaattttagggctggaataattgctcaaattattcaaaagatatactgaacaatatttcaaaaataaaaatttccttccaattatcaggaaaaaaggtccctacatgaatcaactcagaggtcattatcttgaccttcaccatctgctcacttgcacaagaagcaacacaagtttttcatctaaggtagaactttttaaaacttaaaattatctaagataattttaaatatttatatttgctcaaaaagggaagaaacacaataaataattacattactatttcagcatgtaactgaaaaaaaactttacaaaggcatgtcctgacttgtcaatagtttattactgacaaattgagataaaatacatactttggtacagctatactgtccaaatttcttcaattagggtagtaattacaaagtatcctcttccactattattctatgccatagcaaatgtctctctagaggctgcaacataacaaagtccttcgttacctaactttaaatactaaaatgttctcttcttcctagaaaacaatgaaaaatagacaccatgcctcagtgatatacctccaaacaagctgctattatcacgaataaattttaataggttagattgcaaagacattacagatggcttttgacattttcagataaactgaaaccactccctccagcccctagggataatgaagtagcttctcaatcactgaagttacttagatgacaggatttgtgaataatctgtaaactcgggaaacctctgaactgtctccttaggacaaataacatacaatttagaaaaaaaaaatccctacttaatactgctttttactaaattcatgcctacattaaatttcaggatcaaacttaagtgaatgattcaaatcattcattaacatacattaagtgtttcaggaccaaacttaagtgaatgattcaaatctaactctggctttttaaaatgtacatatgtctttttaaaaaccacacatcacaaatatctaaactatcaaagaattgcattattcgaaatttcaatagcctgatactagtgactcggtcagtgcctgattttttttaaatagcagaaaatattaccatcaaaagacccctttccaaatgctgcttctgcttttttgttttgtaaataacagctttggaaatgtatgcaaaaatatctctaagttacacaagtcgagctcaaacactttgtggagcaaggttacttaacaggagtcccagaaacagctaaaattgtagggaaaattttgcgtatgtatatatggcattgttttttctgcgcagaatgtccatataactcagtttctcaaaaggcctcaaaactcaagattaaaagtgcctggaaagaccatcatctttagagaacatatcacaggcaacccaagacttattttttatcccaagttaggggaggatttatcctaattttgtggctcctacacaacttctgagcgacgcaagcatgaaatggctgtccgatacaaacagaccccttcagatacggaatgcagcaaacccctaattttccttgaaggggccacggaaagccaaacggattcgtaacccggttgctcaatggtccattggctactgcaggacgcgccctcctcttacgccgcaggggctgcggggcggcgaccaggttcctccgaggggctgaagttcccttgggggtggctgagagcggccgcatctctggcagcatcctccctcccgaaaacgcgccctaaaagtagcggctgcgggcgtgggcacagccaaccccagcctgcgcctaccagaagtcgggagggcgcggaactgcggcccctccgagacgcgcccgggccgccgccgcagcactgtcgcagcgaccttcccgcccgggtccccgcgagcaaacgggcaagccccgttatcacgcaggtcacacaccccacgagtaaaaggaaaaaaccgggcagacaataaagcccaacccgcgggggcccaagcgagctggaagttgggggcgctggggctgcagcccaaggaggagcggcggggacgacgggatgcggggctgatgcgcctgggacgcggcaagccatatgtcagcccgggtgctgacagcggggaggacactgggcacgcggcggcgtcggggaggcggccggggtaagacaggcctgaggcgggaggggagcggcggcgaggtcccgaggcgccgcggtcggccgtgacccccaccccagccggggcgctgtcccgttccttaccggcagggaagctgcgggctccgccggggctatcccggccgctggcctccggagccaggaagcgcccccacatcgcgggcgagagggccgggtgggccagggacgcccgactcctcacgtccgtcctcctgcttcttcggcggcggaaacttgcgcggagcgtgggcctcggcgacacgggcaggaggaaaggcgggatggctggttaacggctgctcagctacgggcggggagcgcaggggccagattcgccgcactgccggcgcctgccatggccaagccggctgggctgaggcccgcgccggggaagcggcgactcggcggtgacggctgctagatccccggctgagcccaggctcaaaggctccaggcgaagttgcagctgcgggttctctccgccccctccgccggcagagccagagccggggctggggccgcgagggggcggggcctcgggcaatgacttcaggcgtgcgcggcgccgcgcggggcggggactgcggggggcggggactgcggggggcgggtgagctaccccgaccccgcttcgcctccttggcggcgactgggctgtcccgccctcccgccgcatccctctgtctccatcctcccgccctgcgagttgagtagagggcagcgacttggcctattttgcgatactcgcccctcccttgggtaatccctcacgccctccctccgggcacctctgtgaagacacgtggaagacctgcccctggcgtcacaaccgctcgagatgaaaaagccaagccagggcgcggctgagggggcttccagcctcccttggaattaggattgggatttaaatcctcatctgtattccttcgtttatagattactttaggggcagaaaaggggtggttttcctttactaatttaatgggggcgtgggggcaacacaggcaccagaatatagcaccgggatgtgcaccggaaaaggcccgggggtaattagtacccgagggggagaggggccgtcattgtaatcgcacaacgtttcagattagcaagcagaaagtaaaaatggcaccaaagtctgtaaagggagccctttcctccttgccccctactccttcacgttcttcctcttcttggccagtttccacccttcacctgaacccttagtgcaggaggagacgtcctaaggaagggcgaaaagggacagcatcgttttatttttaaatcttacttctcactggcaatatggtgatgcttccaacgtttagttacgaactagttcgtataaaaaattctgggccagcactgtggtgggaggcgggctctgcagtaggcccatcactcagaggtaagtcggaacgcaggtcgcttaactagagaggctttgagttccgcttttcctgttctggaatcttgctaacaaaggcctcatatttgcatttttcccttaaagacattttaattgggaaatactacttaaaattcttggaagttaaattagatttaggtgtgtgttctatcacttaccacatccgtgttgtaatttatctgattggagttttacatttagtctccctgtggtagacttccaattatttctccaaatcatgtaatgttagccaagggtcagctgtttctgatgataaaaagatacagaaacatgaaagacgaatgtgattggttcctttttattattttaatgtgcactagctcgttttatctaacacttgaagaggatagatttttttaagtcccaaaaagaaaattagcagaagctatagcactatgtatagatttttttttcatgctttgtagttaccacagtctcaggaacagaatttttgaaattcatttgtgatgcagttctaagaagtgtataaaatattacagaaatatcttggcctttgcgagtttaaaatacacttattatttcaaaactgccaatttcctaattctaaacagtgtttaaagaaaatcgtttactcgggttttctacatctttttatcaatataaagggcatgctactacacacaaaaaaagtacatgcgaaggtgaaagtatctaaaatatttcaatatctattacagagtaaaagcaaacagtaaaaacatgttgctcttttggcacttggcaccaaatatgaaatttttgtgtccctagtaattaaacttgggaggatagagggctaatgcaattagaactaattgaaatactaagtgagaatattatgttgctaaagtatccatttcttttaatcatatgaattctgagtatatactgaactaatgcttccccccaaatccatgatacatggatgatatgtacatggtatgatacagccatggttttcagaatgattaaaatttatcataacacaagttggagaacctaaggactatctaaccattactaaaccccatgtggtaaactgccatatttttgttttgttgtgacagtgtgttaggactacaaggagaattttaaaagcaaagacagttatcgttgaacctcaataaacctcaatcttggcagttgttctgtgcagatataagtaatgaaaatagtgactctgtgtatgtgtgtgtgtgtgtgtgtgtgtgtgtataagtatcattgctcagatgaaattaggatatttaatgttttgggaggggactttttaagaatataaactagatcacaaaagaagaaaatagtactaaaaatgccacatttaataccaaactatattaaactatttgtttaaaatgtctcatttcaaaaaaagacattatttaaaactgaaaaataagtgttgcatttataattcttaaatttgtatataaatctttgaactgattaagttgagctatcttacatgtgtttttctgattcaaatttatcagattgtgcaaacatcatctacagaactgaagagggatatgacaatgaataaaagtgatatttttaaattagaagagccaggtgcagtcactcatgcctgtaatccagtgctttgagagaccaaggcaggagaatcacttaagcccaggagttggaggctgtagtgagctgtaatgattgtgccaccgcactcaagcctgggcaacagagcaaaaccctgcctctaaaaaataaataaaatgagaaggaaaccccatgcataatatgaggaaagctcaagagagctttatatttacaaaaatataaaatatataaatagcaaaagaacccaacaatatgtaggaaaagtaaaccaaccaataacaattgaaatagttcctaaagaactattgctactacatagaaagagatttatgaatgaattctaaaagattccaaggactagacaattcttgtatatcaagtgtgtatcaaggaccatgctatacaacctcttccagatcacaaaggtgacaagttatccaattatttgtggattgttgtaatcccaaaaatcatttataatttaaaaaaacactctttcttttgaagatggatttgactatcttaattggatccctggcaggtagaattcaaataggtgaatggaaaacaaataggttacttaacctgtgcctcaattcccttacctgtaaattggggattataatgataactgcctcacaggattgctgtggggtttaaacatgttaatctttgtaaaatagttagaacagtgtatgtgtacatcctatattggtaatacagacaaacatacaatttagaaatgtaactgttatagctcaccaagaaaaaataacattcattggtataggccaggtcagttgtagatgataatttatatacatgtatcagaataaagtagtgactgggatcttttcctgaccctttggggttactaattagtccaggaattatggtgaaatagtacactcttaacaaatatataccaaatttttgggagccaagttcatagaaaccttcattctaggctgtgatttcctacccagtgctaccaaaataaaggaaggaaaattagggagaggtagctaggtggtatggcgaggccaagacaaggacaccttatctcaagtccctgattcctgggaggtacagaaaatgaatctcacctgtacctttgactccagagttgggttgcaataaccaataagaaagaaggtatgatatggaccactgaagcagtccttgggataggaagtgggtgtgggagggatagaattctgccaacagatgaagtcttccaaaggaccatcaatgttttcaggaactgcttaggactgacatctttgtcaatggaacttattatggtaaccacctggtcatcctgagcgtatgaaaagagacaagatcatttacttgtttgggacagcaacctggacagtgcataagaagacaaattcttccctccctgcctgctttttcagacactggaacagtaaatagaaggttggaagtgtggattcaagaaagcagatcatgccttcacacacaaacccacacacagcctcctacctgacctgccctggtggggaagaggactgttgaaagctgaaaatgttcaaaatgttggggaattggattgagatgtactcagtggaaaaggggattttcaacagtgtacagctggcagtgttattgggggagaaaaaactttgagtatatacttccaatgatttgagacttctcactaaaccagttacctattttatgttgagtagttagtaatacctccattttacagatggggaaaaaagaccaaagagaagttagggaaggtcacacaggaagtaaagagctagaattcaaatctgatccatgtgactccaaagcccatgccttttccgccatgctcttcaacatgctgtgaaataaaaattagaagatttcttttcagatgccatatgagaaggaaatacctaactataggatttctgtatagtgttagggttcagctaagactggaaaccatgtgacattaatctgcggtggtatatggttttctttagctgtagccagcagtttgagtgtaggaagaaagaaggcagatagataaacagggttttgcagtgtgggcactcaaacaggaaaaaggggcaaagaatgtaaggatattggcagaagaatagatgaagtgatgggaaactgggtgtagcctatctggaaaaagcagttaaatcaaggcaaagctgaaatgtggagagaaggtcatgggaataaaggagtggaacttttacaattgaaaagcaaatataatgagagtaagggagtaaaagttggaaagatacgatgttagggtgggagaggaggatgctgaagtttgagactgcagagatgagacagtggaggaattgatctgtgaggtgaccttggagtgtgtctctctgatctcccttcaagaaagaccttgatattcagccatgaggaatgtagttggctgacagcctccaacttttagtgcctgtaggacctgcctcagcctttttatttaattttattttttattgatacataatagatgtacatattttgggcatatatgtgataatttaatacattcatataatttgtaaagatcaaatcagtgttattgggatgtccatcatcttaaaaattttctttatgctagaaacattcaaattattttcttctagctattttaaaatataacaatagattattgtaaaccacagtcgccctactccatgcttttcccagatatccccagccagtgacaaagctcagccgagatacttgggcctggccattctttgcaatgcagagcccttctaatcatcagtccttgttctctagcttgctgttgagttgactgggaacttgtcagatgtgcattgtggtctgagcctttcctttccagtcctgcttcctgtgcctttcatctttcacaggtgttaccttccaataagcctcttacacccctagttccattttagcatccgctttccagaaaagccaactgacacattctgtgaggaagatgaagattgggggttttgttttaaaaaggaaaacaggaggtctacacagcatgatgaaaatgtttcccagagaggacagtatactgaggatgagttaccaggaaggcagcatgtagcagcatagactgagactatacaggagtataaatgagtaaatgtcttaagttctgaacagcagagaaaggcagaattgagagaactgggcctggcacagtggctcacgcctgtaacctcagcactttgggaggctgaggctggcagaacacttgaagtcaggagttccagatcagcatggccaacatggtgaaaccccctctctactaaaaaaatacaaaaattagctgggcatggtggcacatgcctgtagtctctgctactctggaggctgaggcatgagaactgcttgaacccaggaggcagaggttgcagccaagatcacaccactgcactccagcctgagcgacagagtgagactgtctccaaaacagaaagacagacacgacagtttcaagttggactcagaataccacttgggcacatggaactctggaggagaaggtcctcaatgcttctgactggactgggccagggagctactgccccccaattaaaaaagtttgccactattcagagtacttccaggagcaaattacaaacttgtgaaacttactgagttaactgatgtcaataggattttaattcattaattaagaataattagttacaacttcactactcaaataattttaaatcattaagacagttttcatagtagcttccttacttctgggtactagaagagaattcaattcaatatactctgttcccgttggtaaggtttttttattccaaagaattttcagcgtattgcttacccagtggaagaatgtagggatctctggaactgtaaatagagttaacatcacttaaacaatccctagaggaatctgagctaatttaaggagtggacctttttgctaagatttcagtggaggtctggaattttaacaagttattataataaactcagaaaaacagacaagtctaactacaattttcaggtttatgggagaactaatttctttatggctttttttctggtcataaaaataatacatataaaaaacaaaaagatgatttagagatattattattcatctggcaattatttgttgagtaccaaagtaggggagaaaaactaaaaccagacacaagtgtgaaggatcggttacttcactataacatttcaagctttttaattttctattgtgtaaccagtataaaatagctatatgggaaggcttctttgttcttttgtttttaacacaatagagttactttgtcctgccgtccttataatctctcatgtatgggtcactcttaattattttattttgttcaacagtatcctgattgcagaagtctcttagcctgacataaattcaagctgtaaaatctagaacctgtatttttaaaaataaataaacttttaaaagaccactttaaaatggaatacaataattacgaaattatgattgtaaatatatgttaaatataaaagtggaaaaagcaacatttaaatcagtatatttaataagtgttataagtaaattaataaatattttaagttgacatttaactattttgcttatatctcaaaagtttaacacatcaggttgtcccaaacacacttttgaaaatgtgctttagaaaaacgggaaaatcatattatatttggacatatctagaccaaattaaaattggtcttttttcctctactttgcggcataaacaaggtatttcttaaacagccctaatattttgtagtgttattttgggggaatctatttttaacatactacctaaaactgaactcagaaaaaaatcttacagactttttttacaagcaagacttaaaagtttttaaaaccctagtagaataaccaatctctactttcattatagtaattgacactagttttttaatgttctatgcaccttgaatcaccagttactacaatgaaaacacaaagagccacctgaatatcaaatacatgcattattacaagtgctcacacggaatatgagatgaattactgatgaacaaagcatctaaaatcaacttatactcctcatgcatatgctgtggatgatgacaaaagaaattatgaaaagatatatatatgatatacatgaatctatattctctaattgagacattatacaaatctttataatagactttatattaattaattaggtacttttttccattacagtaatctcctaatgaagttatggagcaaacttcagctttagcaaagttgggcaagttatttatactgcgaaagatagctgaaggataactgttttcaactgagaccaaaagacatagtagttagcatttattttcataatcttaaaaaggcatacaatttcggtaggaggcagtagttatagtgacactaagggagatggtagattgggagcattcaatcagcattcggggagaatagagagaaaaggcaatatcaagagaattcgtcaccacagttgtctggatgctgttgccttctttgctcacccttgaaggtcagtctggttctggcccaggcccaagatctaagtttcagatcacggcaggcttaggagaacagtgcagactggaacatctaatcccaccccagcttgccctaagatggcccctgaatttgttcagctcctgggcctgccgccgtcctaacttgcctgaaactgttttccaaaaaattagagcatagatgagcaatgccacgttagcttcagttttgattttgggtgttaccacataatttttttaaaagaatttttatcttcccacataccaacttttagaacagatggcttaaaatgtcttagaggaaattagttgtaatcagcagatgagagtgtgtctccttgttttcgtggcagaggtagctatcaccccttaagtacctatctgctacatgtgaactggcaccaggcattgtagtttttctgttgcattttcatccagagggttatgatgggcttcgttaaaatgatttggtacacatgtgggcatttgcctgcaagtataacctctgtgaagaggtaaactgtataggcttcaaggtggctttctgctgaggtggctgccagcctccctggagaaggtgtcagctgaagacctcaagtaagagccacagtgaagctcatatgccttgatctcttttctgatcctggcaaaaggccagctgtggagtactgctgcagtcaggagctgggggagttggcagattgccagataaggggccatactgtcatttataaggcaatggcttttatagatctctagtaacccatactcctacttacttgaacactatgatttctgggagaaaaaagagccagataactttcccattggaataaaaccaaaacaaacactgtatttaggttcacaggatctatattgaatgtcttttcaaagtacttcatacttatttcagtcaatatcctttgcctgatcctgtgtccacaacacacatgcctcctgagtcttaagatgctccttgctcctctagacacctttgaagatactctcattccactacgcctggggccatgtaatgtctgtaattgcctcattaactctcaccttgagttctctgaatctggttttctcaaacatatttgaggataaggagactgtcacttaatgtgaaaggtgtcagaattttctttttttcttttttttttctttttttgagacggagtctcgcactgtcgcctggactggagtacaatggcatgatctcggctcactgcaatctcggcctcctgggttcaggcaattctcctgcctcagcctccccagtagctgggattacaggcacccgccaccacgcccaggtaattttttgtatttttagtagagatagggtttcactgtgttggccaggctggtctcaaactcctgacctcattatctgcccacctcagcctcccaaagtgctgggattacaggtgtgagccaccgcgcccagccaaggtgtcagaattttcaaaggaaaaatggaatattgataaactgagtaaaatatgattaccatataatgtcatcttaagatgttcttgtagtttcaaacttgtataaacaaaattggtatttatacatgtgtcctattaatgcacacgagagtagattagaacctatatccagagtattttttcttgtgccttgaaaaaccaacttaaaaataaggtatttcaaaatttggtttctaaatacgtttcaataaggtttgttattattctttttcttttaaaattacatttttataaataataaaattttaattgtgctccagttaactattaataaatattcagaatccttaagggtttattttagttaaaatgtttaggactaatgcattagtaaattgaaatttggatacaggaattgcctggatctttgttttacaaaaaaaatcagaaaaaagtaataccaaccctataaaatcctaaatctctaataatgtaaatatattattagtggtaatgttatttgttgagtttaagagtatatttaattttatagaacaataaaatattttgatatagaatattcagggaaaaaatagagaaggaagacaattgtaagtcggagagaaactgggatctgtctataatgactgtgttaaagaatagcactaaagccacctcataaaccaatgacgttgtatcacgaaatgacttttaagttgatggagctgcagcaaataagttcaaagcaagaggtgccagcaccagagacttgggttttgatacagctctgctccctactggcttatcattgggatcaaataggatcattgcagtactatctcataaagccattgtgaggaataaataggatcatgttggaaaagtgcttcacaagttttaggtaatctaatcttgctaagaaaaggggcgaataattcacaagaaaaaccagagtaatgataaaaggtattattgcatgctaagtgagcactgtgccaagaatttcacatgcagcttcccatttcatcttcataacaacatgataaagaatagtatgaattggccgggtgcggtggctcactcctgtaatcccaacaccttgggaggccaaggtgggcagatcacttgaggtcaggagttcgagaccagcctggccaacatggtgaaactccgtctctactgaaaatacaaaaattagctgggtgtggaggcgcatggctgtaatcccagatactcgggaggctgaggcaggagaatcgcttgaacccaggaggcggaggttgcaatgagccgagatcgcgccactgcattccaggctgggtgacatgagggaaaccgcatctcaaaagaaaaaaaaaaaaaagaatagtatgagttattattatctccatttcatagatgaggcaaatgagtcatagagaggtgccaggagacatagttaattagtggcagagtaggaattcaaagacagttccacctgactctagaatctgagcactttaatattagctatagtatattaaaaagttcaacttcattagtaagtaaagatttaacaattaaaacatatggacatgggagtgcaaaggaatgataaacatcaaattccagttgtctctgtagagggagggaggaaggcattggaatggatttgggaaagtggtgcatgacgatttcagttatatatgtagtattgactctcatgtattcatcctgatatagtggaaagagcataagtattgagttagtcaagccaggcttttaatgaaaatgtggaaatttgttaagacttgacaaaccagaaccaggggttatatattttttctgcatacttttttgaatgcttaaaataattttcatggtaaaaaaaaaaagcagtgaactaaagtcatcctacttcatttatacaaagattaaataattaagaaaataattttggtgaaggtttggagaaaccgatatacacttctaatagtataaatgggaccaactcttttggaaagcaacttggcaatatgtgccataaaaacaatctggctctttggttcagtaagtttccttttgggacattatcctaagggaaaaaaatcaaaatgtacatgtgcatacagaaacatacacactggaaaaactgtatgcatgaaaatgtcaactgcagtgttgtttataacgatggaatatgataaacaatctaaaattttaacaatagaaaagtagtcaatattttgcagcctttaaagaaatatttatgatggctatgtagcaatttgagtaatgattgtgatgtaatgttaattgaaaaaaggatatgaagttgcatatccaccaggattaaatcaatgaaaaaataatcatagaaaaagatttaggaagaaacagcctaaagtaatgagtacagaatttgtgtcaaaatgatgagatgcattctttcctttttctcttccagatttttgatatagatttgacatattgtttttgaaatggaaaactacagttgtccattggtacccaagagggattggttccaggatccccaaagataccaaaatttgaggatgctcaagtctcttatatagaagggcatagtatttgcatataacctgtgcacatcctccagtatatttaaataatgtccagggtacttacaatacctaacacaatgtaagtgctatgtaaatagctgttatgttgttttttttattgttgtactattattttttattcttgggaagtttttcctttttttttttttttctgagacagaatcttgctttgtcacccaggctggagtgttgaccttctgggctcaagtgatcctcctgcctcagcctcccgaatagctgagattacaggaacgcaccactatgcctgcctaatttttgcattttttgtagagattaggtcttgccatgttgcccaggctggtctcaaacgcctgagctcaagcagtcctcccacctcagcctcccaaagtcctgagatcatggtataagccactgcacctggcctttttccaaacagttataatcagccactggttgaattcacagttggttgaattcatggttggttgaatctgcagatgtgaaaccaatggatactaatagccacctatattacatagtacaaacctagctttgaaaatagtgagacagatatgaaaataaactagaattcacgggagaaaatgaggggttctaagaaaggtgtagacaatacattaccaatacaggaggtcagaggaaggggagatctgtcaggctggggtcttcaggaatgcttcacgaaggagggactatcagtggacttcagtaatttgtagagccgggtaagagctggggatgaaaggagggctaagcaggaggcatgcaagttgcaaagtggagcaatgggagatgttctcaggaaacagcactgtgtgtcacggaatattttactttcagtttttctgggttttcagaaaatgtggtaactttaaagttttcacagttgaattaattccacagaacaactggttgtagaatcatagcaacataattatgagttgtgcttctggctccaaatctttcatctaaaaataatcgcagtgaccacatcttgggaaaacaaagccattacctattcttgtgctccagctatctcggtagtcacttactggaaaatggattacaggtaaaataactgcatgtttttaggacactacttgtctctcttaccttcagtgagttgattaacgaaataatttaaaaacttatattctccaggcattctctaaggcatgaacatgattttgaagaaatcctttaccatcacacatcacacaagcctgcctgtgctcctccagaaacgtagccctagtactcctggaagcccattttgttccttcagggagtatgctttctttgtgcagagaggagaaaaatgctggagacagagatgtggggagtaagaggagggacggtaggtaagtctcagccacaggtaagatgagtgggaacctgtatgctccactgcccccatgtgtaccagctgttctttgcccagcttccttgggctagaaacatattcagtgagtaatacatgaatcaacaagatgataggtgtgtcatttatcaaatgattacttgtgctagaagtttacaaccattcaattttatttattttattttattttattattttattttattttagatagggttttgctggatgcgcaggctggattgcagtggctcaatctcagttcactgcagcctcaacttcccaggctcagatgattctcctacctcagcctcccaagtagctgggactacaggtgtgtgccaccacgcctggctactttttgtgttttttatagagatggggttttgccacgttgcccacgctggtctcaaatgcctgggctcaagcaatcctccctcctaggcctcccaaagtgctggaattacaggtgtgagccattgcgccgggccacatcccttaactttaatgatcataagaatcctgcccagcttataattcaaatgccagggtactcaggttcttcaacagactctagttttcttatcctctaagattagtgtaaaataaaagtgcctgattgccatctcacacactggtgagaaattctctgttcctctccacatctccaggtttcccttccttgcctcacattctgttttcctacacaggccaaattctccatgtctcctttacatccccctggtgtttgtgttcccttttgctatatagccttgccgaatacttggcgcatcaccccaatttcttcactccccaaagttatcacccacatatgattgcttggttaacaaacatttatttaacttttggtaaaaggtaaggaatgttccactctggtgccaagtaacaacttaatattggatattaaaactgtatccccaaatagagccccagattcctggctactttgctggacttctctctttcctagggttggtgctttcatctcaaactccaggatgctcaaaattattgttttattatgcaaagcattttagttctctgcctggggcttcctccttcatatccaaagcggacctatacaggtgttttcctaaacttaagagtcctagaaatcagaaagctatagtctgctacaattttaaatagcatttacacaagatgaaaaaacaagtttagtgaaattaaatgactgcccccaaaaaagggtcagagcctgaattaaaagcctggcttgactaactcaatacttatgctctttccactataccaggatgaatacatgagagtcaatacctattgaatgtttacaacatgtctggctctgttctaagagcttcaggggcattagctcattcaatcctcacattagttaataccccactttatagaaacagagataactacccatagtggcagctaacacatggaaaggtcaggattagagcccaggtagtcagtgtctgtgcttctcatcattaactgctactctctaccagcctcaagatccagctccctgacattctttcagtggctgaaaataagggcagcttattatcacatttgggattaagttaaaaaaaaaaaaggaaacaggggcagctactgtgtgagagttcagtctgctccctgaaaatgaccccagcatggtttggaaactcaaaatttctaaaaaccctgagagtacatgggcattgttggggtctgaaggtatagactagatttgctcagtgacaaacttaattataaactttataatggctgctttcaaaaccaatcaggtaattcagtcttttcttgcttaattagttgccacaaattcactcaatccatttagtcagtcagtcattcaagacttattgagtgtcctctatatgtcaggtactgttaggcaccaagtgaagaaagagggatccttcgggtccagactcagtcctggagtggctccaaatgttagaattatgattagtgtttcttcctatactatacgggatggtgctgagattctagatttcgtggcccagttctttagagaaaaaaattactaacatgaagaagggcattaaattgggtcaccattgcttgagggaactattccttaagaatatagaacttgctttgattttttttacactctaagtgctgctctaaggtttgatttcctgagtggacaagactatcaaggcaagaagtcccatgtaggtgacaactagcaatatttgggcagaaacatatctcactttaataaatgggcatcttaatgtaaagctggatcttagacatgaactaaatcagtggttttcaaactgtgctcctagggcctcatttgcaataaatgaacattttaaactgcatgtgaaaactgcattttttggatatctgatttatatattggagttttgcaatttaatttcatttaggaagaagaaaaaagagcccttttgcaaaatgtgaacacctctgagattttcattcatttctctattcacaagggactaaggcctagagagatgaaatgactcactgaaatggcagagataaatcgtaaacctaggtcattactcccagcccagtccaatgcacagatctccccctttctatctactacccactgtgtgtctggagagcatggcacacaggccagtgtaaatctgggtgaactatgtctttgtagtactgcaaaagctgagaattcagttccaaatggttctgcaaaaatactgactgaggactatttactgtatatatgattaagtgctacataatctactatgttcctcataataatccatgagttgggctgagcaaatatctccccagccctctcctcaattttgcaaaaagcaaaacagtctcaaagccgttgacttctttaaagaaatgtattagtagataacaacaacaaaacaatccaaaattccaatcttctgacttttaggaagacagagctctaaccattatattatatactgttcaagccaactggtaagaatatgcagtgcttgtgcaggcaggagagcaatgatgtaattaaataggacagctcccaaagttgacaggcataaatgatgaaaggcaaagtttagatatcaacctatgagccatggacacctgcagagttttaaaattattacaaagggacctgaagtcccataaggtatgcttacctgaataaggtgggttgcactgatatatacacccagacttcaaatggatagagatgctcttttgtttaataaagtatgccttcaattaaaagcattactgaagccagatgtggtactgtgtgcctacagtccccactacttgctactcggaaggctgaggtgggaggatcacttgagcccaggggttcaagtccagcctgggcaaaaagcattactgaattcctagcaatgtgtttatccttatgtactttcagtcaacttttactaaaagtacaaacactattatgtgcaactctgtgaaattttgttgttaaaaatgaaatcatagttgaaaatgtggggactgtctgttcaaggctaaaataaagggaacagaacaaaattaagatgggaaataattattttaaaacatattttgtatgttttcctgtgtttctattttaaagctatatatctaaattattgctctttgttttcatgttgaatggctgcttcttatctggctttgtttattaagtgtggtcagatcatttattctcagaaaagctaccctgtagcctggccctacattcctccaagataatatcatctgcaggactcaagtttcttgccagagagctgatttgcagaagtaaacaaactgggagtaaaaccaagaaatgttaaagaaactttctgacttaagacattgataacaaaaactatgttagcaataagtgtctctaaaaatatatagaatatccagtcaagctgacctacagaattggaacagtaaacagaacacaaaaagggctgtaagcaataccatctaggaacacagaggtaacagatagggctccatgtctgtcagggactccaggaggaacagctgttcccttctctcaaaacaaaccatcctctgatgcgtttcagttgcttaccaactcagatctgcttttgaggagtaagccaaacacacagcctctggtgatttaccttatagagggcattagggaaacttaaaaaacaaatgtcaacttgaaaaggccacattttatatctttccttcatctctggcagtattccgttgttgttccaactacccacccccttgcccttccttacatttgattctttgttagatgaagcatggagacaatggaaagcaactgggaaacaaactaaacatttccttctggaaatattacctacttttaaataaccactagggtctataaatattttcattagaaatttgccctccctccacacacaccagtcactttgtgaaaaaccaatttctccaagtcagaacctagaatttatggtctcctctcattgcactactaaaacctttcatatccacagtgaatctaggctattacctctggagactggagttcagggcctcactcatatatttatctcatgaactaaacccctgtaattccctgtggagttggggtttggaggcagatgatagagaggaaagttagagttacaaccatttggttcaatgtggtagagcgctgaattgactgtgtgatcttaggcaagtcccataagctctctgggccccagataactcatgtgtaagaggaaaggatcatactagatgacctccaactttgtatcttcgaggtactgaatgggaaccaaagagtaaagggaagtcgcaaatagaattatggatgtggtaactgaattattcccaattcttccctctctccctgcgatagaattacaaagcatttgtcaagtggcttggcagtaccttctatcagaacgggcagaatatatgtagcatttccccacctacttcatatggggcttgcccgtgtgacttgctttgactgaagttagtagatgtgatgcaagcagaggcttttttttttttttaacttttattttaggttcaggggtacgagtgcaggtttgttatatagataaactgcatgtcatgggggtttggagtaaggattattttgtcatccaggtagtaggcatagtacctgatagatagtttttcgatcctcacccttcttccaccctccaccctcaagtaggccctggtgtctgttttctcttctttgtgtttccttttgttgttgttgttgttgttcccttctttgtggccacgtgtactccatgtttagctcccacttataagtgagaacatgtggtatttggttttctgttcctgtattagtttgcttcattgtcgcactaagcagaggctttaaaagtggctttatttcttttgcttctgtaatctcctggctagccactggttcaagaatgaggaaaggggatgttaaactgaccaaaaccttgaacaagaaaaatagacagttttgttttaagcttctaaaatttgtgtttggttatgtggtactattgcagcagaaacacaaaaatctctgctgaacttttttcatatattctatccaacaatatgcctactgaccttaaaattttattgagctgttgaactaaactgaaatcatctaggcatcttagcttgaccatggaaatgttctcctgattagcaccatcagcaggacgacttttggtgctgaggatactgcaaaactagaaattagtgtactgaacttttttatgtaaaaaaaaaaaaacactgtgtttttagctatattgagaaacgattcctgtgaaattgtactgtgttggctgtaaggatggtggtcactgtaacttacagtgtagtctttgtggcaaacttttggagaaattgctctctggtttcagcaactggagaaactatgttatcgtaagcaattggtttgtttgaatcttatggacagtggatctctatctggttgtgagccctcttgaattgcctggaaaattcagagccaaatatgtggccctacataagcaagtggatgtaagtgactttgcagcatacgttttgtttagcaacttcccctccttgtattattttcttttttctacacttattttctctttttctgcattccttgtaaattgttatcgttattatgttaagtattaagtattattttatcatatacatttatgtcagccaccttaaatccttttgggagcagaactgagaatacataaagcactactgttaataaaaaaaattaatttccgttagtaaaatgaagagagaaataaaattttatcagtgacccctcaacccttttgttgttgaaacttactaaggatctggcgtttctctattctgaaatatctccaggtcagtgttgtgaataaagcactgatatacattggtaccatttcgaattcatcatcaaaataaatgtaaagacaagctgggcatggtggttcatgtttataattccagcactttgggaggctgaggagggtggatcacttgaggtcaggagttcgacaccagcctggccaacatggtgaaaccccgtctctactaaaaatacaaaaatcagttaggcatggtggcctgtgcttgtgatcccagctgcttgggaggctgaagcacgataattgcttgaacacagaggtggatgttgcagtgagctgagatggtgccactgaactccagcctgggcgaaagagcgagactctatcccccaaaaataaataaaaggacaaaaattgtctttcttcaagctgtttgaaatagggaggaaggtttttctttacaaataatttgacgtattattctctttttttgttttgtttttgttttgagacagggtttcatctgttgcccaggttgtagtgcagtggtgcgatctcagctcactgcaacctctccttcctgggctcaagcgattctcctgcctcagcctcctgagtagctgtgattacaggtgcatgccaccaggcctagctaattttcatattttttagtagagatggggttttgccacgttggccaggcaagtctcgaactcctggcctcaagtgatctgcccaccttggcctcccaaaatgctgggattgcaggcgtgagccactgcgccaggcttgatatattatattattcttttaattattaaagttaattttttttaatatttgttgaatattgactatgtactcagatggtgctagctgttatggacgatataaagatattaataaataagatacttgaatctttaagatgccccatggccagccattgtggctcacatctgtaatcccagcactctgggaggctgagacaggtggatcactgagcccagcagttcgagaccagcctgggcaacatggtgagacttcatttctacaaaaaatgcaaaacttagctgggcatggtggcacacacctgtaatctcagctactcaggaagctgagacaggagaatcacttgagcctgggaagcagaggttgcagtgagctgagatcgtgtctctgcactccaacctgggcaacaaagtgagatcctgtctcagaagaagaaagaagaaagaagaaggaggaggaaggaggaggaaggagaaggaggaggaagaggaggaggaggaagaggaggaggaagaagaagaagaaaagagaagacaatgacaacgaagaagaagagaaagaagaggaggagggaggaggaggaggagctcccatgtgtctacattacaaagacaacttggtttccttgggtgtaattgaggttcactgcaagaatgatgaagaaagatgagggaggcaatgtggaaggactagcaacctgcaacagaagcatgatctggcctcctggttctagtgcagtgctctaatacatcaagagattagttgccaaggttgggggcaggacaagtataggaaacaccagcataaacacaaaataagagttaaagatgaggaaaatagaaacttgaactagtcagggtcactagataaaagcaaagaataatcaatagaaacagagccaaatcagaagctgaaagaatggttctgattcaagatattcatctgagtttacatgttttaactaccattgaatatccaaagggatatgaaaatatgaattggcacttgctgtgaaatttagaagatttccagtaaagtgttctatgtttacaggcaaatgtgccatatagggaagtcagagaggggcaaataccagtcccaccagcaactgtagaaagtccagtaaagatagagtctacacaaggcaatatctcatggcatcccagcttgcccttcatatagacagcgtactgagtagtatctcagaaaccagtgagaaattctttggcacaatggtgaggtctgtgggccctaccacctctgccctactcccacagacacttggaatgccgatttattaaagtaactctggtaaatcttgaaatttcctttctcccattgactgtatctaatatttcaacaggacccccaaacaattctgaaattaactgtgaactccacccatggacataaacacaatcatcagaataaacaaaccaatgaaccatcttctagattaaaagacttagttgtaatgtaaaaaaggaaattaaccagaggaataaacttaaatgaccccactcgtgaaagagttaataataaaaccaaaacaaaataaaacaaaaatctttagaaaaatctctaaatcttaaaaaatctagaaagatgctgagttaccaacaagattcaaaagaacattacaccatatgcacaccatatgcaaaatttaacactaaattgatcataggcctaattgtaagagctaaaactataaaattcttactagagaacaggggcataaatatttttgaccttggaaaaggcagtggtttcttagatatgacaccaaaaacacggataacaatagaaacaaagagattgtacttaaataaattgtacttcataaaaattatgaatatttgtgcttcaaagaaaacctcaagaaagtgaagagaaaaccagtgggctgggcatggtggctcacgcctgtaatcccagcactttgggaggccaaggcgggtggatcacaagatcaggagttcgagaccagcctggccaacatggtgaaacactgtctctactaaaaataaaaaaattagctgggcatggtgacaggtgcctgtaatcccagctacttgggaggctgaagcaggagaattgcttgaacccaggaggtggacattgtagtgagccgagattgcgccactgtactccagcctgggcggcagggtaagactccatctcaaaaaaaaaaaaaagagagaaaaccaacagaatgagagaaaatatttgcaaatcaaataactgataagggatttgtatccaggacttttacaactcaacaacaaaaagacaatctgattttaaagctatctgaatagacattgctccaaagaagatatacgcatgaccataaagcaagtgaaatgatgctcaacattattagttattagagaaatgcaaatcataaccataatgagacaccatgtcacatcctgtagaaaggctatcatttttaaaaaagacataaaaggcattgacgaggatgtggagaaattggaatcctcatacactgctggtggaaatgtaaaatgatgcagctactttggaaaaacaatttggcagttcctcagaaagttaaacacagacttaccatatgacttagcaattctactcccaggtatttacccaagagaaataacatgtttacacaataacctatatacaaacattcataccaacattattcataatagcccaaaaatagaaataactcaaatgtctgtcaactcataaatggataaacaaagtgttacacacacacccacacatgcactcacatacaagggcatattattcagcaataaaaatggagtgctgttacatgctacaacatggatgaactttgaaaacattatactaagtgaaagaatcccgacacaaaaaccacatattttatgattccacataaaatatatacactttatattatatatattgtctatatatataggcaaattcatagaaacagtagattagtgattgccaggggttgagggagggggcaatagggagtgattgctaatgactatggggtttcctttgtggatgatgaaaatgttctgaaattagataatgttgatggttgcacaactccaaaaaggtacaaccattaaaaaccgctagactgtgcactttaaaagtgtaaattttatggtatcttaaaaaactatcaatcatttaaaaattacattttaaaataggaacaatttaagattagaaaagattccttttgaaataaaaataagattgctagaattaaaaaaaaaaaatgacatggaagctgggcacagtggctaacccttgtaaacccagtgctttgggaggctgaagtgggaggactgcttgagaccagaattcaaaatcggcctggacaacatagcgagaccccaaggcaacccagtaagaccctgtctctaaaagaaaaaaatgaaatggaagcagtaaagagcaaaattggaaagtgacaaaaatcaaatcagtgaatttgaagaattcagagaaaagtgataaaggagtgaataaaatgagagaaaagatgatgtattaatggaagacgatgatggatctagaatatctgataaaagatttcaaagagaatgaacaataataaaagagataattatttctaatttcccaaagaagatcaagccaagttaagatccaatcaggtgaagagttgttttttgattgtattgtattactattgttattgtcgttattactattttttttactattattagtcagcttgaaatgtctatttttaactgacaaataataattgtatatatttatgggcacattatcatgttttgatctatgtatacatggtggaatgattaaatcaaagtaattagtaaagccatcacctcacctacttaacattcttctatggtgagaacatttaaaatctacttagattactgaaatttattcctcctatctaactgaaactatgtaccctttgaccaacatctctccttttcccaaccctaccctcatcccctctctagccgttggtaagcaccgttccactttctgcttccattagtttaactttttttagattccacattatcattgacttcatgcaatatttgtctttctgtgcctggcttattttacttagcataatgtcctccaggtataaacctgcatattgttgcaatgacagaatttccttctttcttaaggctgtatggtattccatcatgcttatataccacattttcattattcattcacccactgacacttcagttacttccgtatctttactattgtgaatagtgctacaatgaacattgaagtgcagatatctctttgacatatagatttcaagtcctttggatatatacccaaaagtgggatggctggattatatgatgattctgtttttagttttttcataagcctccatattattttccataatggtaatgctaatttacattctcatcaacagtgtaccagggtttccttttctctacgcccttgtcaacccttgttatcttttgtctttttttaaatgatagccattctaaccggtgtaagacgatatctcattgtgttttgaatttgcattttcctaacgattagagatactgagcattttttttcatttctctgttgacgatatgtatgtcttcttttgacaaatgcctgttagcttcaacttgttgcctagaaaattatggagtctacttcatgttgtattacagtagaacattaaggtatgatcctggaaatcagggtcccagctctgttacttatcactaatgtagctttgggcaaatcatttcacctctttgggactcaagttcctcatctgcttaaaaaaaatgaaaggaaaagcttgaactagatgactttaacacaattccttaatcaaaagatatgagccaggagacagatagaaagtaaggcaagaaagctagacagcagaagataataaggaagtccttatctaccagaactaaaattttgagggtgacgtgagaagggggcgagctgtacaagcagtcctgacactgtccgtagtcctgaagtgtcattattttgtctggctgccagttggaggagttgggaattgcttaggtaagcagtatggagatctgacaattttagcgcagaacagtgaaactgagctcattcacatctgtgtatttaactactacagattctgatgattcccaaccctatatctctagcattgaccttcatcctgatctcccaatacatgttttccactgtctaccaagtattaccagcatttttactgtattgaatttacttcaaactcaacaggtacaaaagtgaacttatcatattcattaatgatccttcttcttctcctgtattttctatcttgattagtgataccaagatgtatccctttccccaagccaaagaactaggagacttccatgattttaccatgcccaccacctatagtcaatcaccaagtgtgtcctgccaatattgcccataaatacatcttacattcatctctttctctctaccccactgtggatggatttatttaggttataaatgtttcttggttggactaccataacatcctcttcaataatcttgtcttcaattttgcacccttctaatttacatttatgatcaagctatttccctgctaaaagccttccctggctttagttgtttatagcacaaaatccaggttactcagaatggcattcaaggacacttcataatttgtacagggaagaaaattctgaaacaggatatttattagggagttcccaatggatcaacatctgtagaaaaatggagaaggaaacagaattaggtaaaaggagaagttgagctatgatccagccccaataaaggttgctcagcccacccgttgggtagctctggaactggactggctgctcagaattgttccaagttggatcaagtgggagccacggctttgtaaaacacactggtcatgcattggatgcaagatgtctttggaaggaagaaagacttgggtaatgctacaatttgagggttgtcttctggcatcattgtcagaaactgggagaataagtccttcattcccaaaggcagatctcagcagcacatcagaaaatccaccagccaccgtatatttgtctacctctacacatcctcctctgtacttccttgactctctgcatttactttatcataccatttactgaactctattttattgcctctttacttttctgtattcttcactagactgtgaactctgtgcaacaaatgctgctactatataaatcattgctttatcctcaatgcttgcagcattaaacaatttataaaataaaacattaagcactttgagaggctgaggctggcagatcatgaggtcaagagatcgagaccatcctggccaacatggcgaaaccccatctctactaaaaatacaaaaattttctgggcatggtggcaggtgcctgcagtcccagctacttgggaggctgagccaggagaatctcttgaacccgggaggtggaggttccagtgagcccagatcgtgctactgcactccagcctggcaacagagtgagactaagaaaatattaaatgaatgaatgcatatttcctttctccccactctttactccctgttgctctagtaaaaccaaactacttgaggtttcctgaattttccaagcctttctttgaggccatgctttgggtgtgctagaatgcctttgacttagtcatcagctgaatatctacttctctttcaaaagtcaattcaattgttacctttggaaaactttccccaggcacagtcacaatcttcattctctgtttcctgagaactcattttgtaccaactattatactcctattatttttaatttacatgtctgattattttcaggagatatgagaccttgagcctcatctattttgtgttcttagcacctaaagagacctggcacaagatgaagaaaaaaagaatgaacaataaatatgtgattaaaggttaggctctaggattactaaccaggaagtaatgtgcagaatgaactaaaaggaaaggagttatatgggagaaaattgttagtttatacaagaggcatgtgactgtggacactggatttgctataattccttattcctgaagttagttttttccacatgcaaattgaagagcagaatgatgatattagcatagttgtaactttgcctaacatgtcttagtcatgtagtgtcccagtctacttatgcaatgctagtgtaagggtgtcaaaatcaaatgccttcaggggccaggaagagtacctaaatgtctaaatgttcggtgggcctataggaaacaaagggcccacttgaggggcattcaatttcagtttttaaataatgtggtcaccaaacagaacaagtgtttgggcctgacatggcctgcaaaccaccagtttgcctcctcctcttttacacattttgaaatcacatttttttttaactacaatggaactgagtgggaggagatatgaatgacattttcatccttgcagaaaaagagggtgtttctatatttctaataaaaaagtagaattatttttgaagtggcttccttctctgccaggaagccaggaaatcagattagaaatttcattggcattaaaaaaaaaaaagatggcagggtacagtgtctcatgcctgtaatcctagcatttttggaggccaacgcaggagaatcacttgaggccaggaatttgagaccagcctgggcaacacagtgagacccccaccccagctccaaaaaaaaatttaaaagtattctgggcatggtggcatgagcctgtagtcccagctacttgggaggctgaggtgagaggatcacttgagcccaggaggacaaagttgcagtgagccctggtcataccactacactccagcctggggaaaaaaaaaaaaaaagaatctttccttggtgttgcttttttttttttttttttttttttgacaaagtttattttcttcttattaaaaaaaaaaatctgttaacatatttcaaaaatatagaaaagttcaaaaataatccctcaaaattccaaccagtgaacaaccttgactatcattttagtttatgcatcagatattaggtgggattgtaggactgacatgtgtactcagaactaggtggcaggtaagcaggaaagcaatttatttctaaccagctgggtttctgtaactaatgatctaacacagctaataaagacattctgggcagggcacagtggctcacgcctataatcccagctttttggaaggctgaggcaggctgatagcttcagcccaggagttggagaccggcctgggcaacatggcaaaaccctgcctctacaaaaatacaaaaattaactggtttggtggcacacacctgtgtgtcctctgctactccggaggctgaggttggggatcacttgagcccaggaggtcgaggctgcagtgagccaagatcatgcctctgcactccagcctgggcgacacagtgagaccttgtgtcaaaaaaaaaaagacactctgagatgactctaaagtgcctgactaaaaccagatagccacagggcctgacaacgaggaggagtttactgctgcgctactattgctgaaacggaacttggttttgaatccacaacagaactattgtgcgtgtgacatttgctttgagaaatgaatactgggttgacagtacacaagagcttttcagtctagtccataaagaactttcacttgattgccagctttttaccagtaattcaacatagaaaagtacagtttttgaccttaaaactttgaatgcaattcctaaaattaaaagatgtggatttatataagtcaaatgagaagacattacaataaacagagccacaggttttgtttgtttgttttttacaggaaattgtgttgtgtttacatttagagcattctgtgctgaggtattctctggctcatatatagaatcataagggagagaggagttgagaagtagttccctagaagaactagagagagagatgtaattatccctgatactaattagcagagatctggaatgaaaaaaacctcaataacctcatattcagacgattttttcaacatgttcattattaatagtaagcagacctcatgttaattttgaagaacacttaacagatttcaaaatatctgaagttcctctatttttttcctaatgaattttaaaatttttgtaatttttaaaaatagtattttggacttccctcgaaattttcctgcaatgtcactggtatatttggggatagagttttaagaatatccccagtgagggtttagaaaaatttaattcattataaatagatctattttaccttaattattattctattataattatttctttttttttttttttttttgagacagagtctcgctctgttgcccaggctggagtgcagtggcacaatctgcaacctccacctcctgggttcaagtgattctcctgcctcagcctcccgagtagctggaattacaggcatgccaccatgcttggctaatttttttgtatttttagtagagacggggtttcgccatgttgccaggctggtctcaaactcctgacctcaggtgatccacctgctgtggctgggtgggattacaggcgtgagcctgggattacagtgctgggattacaggcgtgagccaccgcacccagcctgttataattacttctaatcataatatttcttacttacaggccacctcatgttcagaccattttttccatatgtaattagaaatataaagcctgtattgcacttaaatatcattatactgttttaacatattttcatctacattaaaattcactttaaaattattagtcttagaaaaacaatcaaagaaaaataaagtatggtgtctccaaggttttggatattctaaaaggaagtagctgttctttcaagctaaatatcataaactgattttattaaataaggtcttacattttgtagtggcagcagtttataaatacaggcttactaattcattgctttcttttattcattagttatgttttggtactttatttaagtacccgagtggattatactagatgctgcgattcagaaacacaggctgtctacaggtgagacacaagtttcacctccaggggtacacagtttaattgcagcaaaatgttttaaagaaggaatgcttcactgtggaaaaaggaaacaagtggcttgttacccaaagagcacaaggaacccctccactgttgagttgttcacattttcttggtttatgcttcaggtagaggtaagtgaagcttcaaataatattatgccctaaagcttcaaactggaagaaaaaaaaaaagcccttgcacccctgaaatatgcatgcatgcctgagcatgcacacacacacacacacacacacacacacacacacacttttaccttgctctaaatttttgctcatgtacttagtaataaaatgttatttttagagttcacagccccaatatggaaatgtgtctagagcttggatctagaagtttatgtctttcttgaagttcctgggtcgtaataaccacagtgaggacaaaggcaccagaacaatgccaaaccaggagatatggcctgaattagaaggaagacaagtttttatcaggcataacaatgaaagaagttgaaaccatggagttattattaagagaagttgtggagtagttattcctggtagcctctaagtagcagttggtcctaaatcacaaaggtgtgtatttttctagagattccagacaagataattttgagggctcttatactatgattataaaaacctaataactatgttttaatgtagtgcattgtgtttttaccacttaagatggcagtgatttcatcagacagctttcttttggggagacttccaaaccaatctttgggggagaatctaatctcttttttgccaagctggtgaggttttcttcccccacattgaatgtttatatggaaagatatgaaccataaacatttttatataaaaacttattctttttgctttttattggctgcattgtaaggagtcatttggcctagagggaaaggagggtaacattccctatggcaaactacaacgaatcttccttctcctttcccaactccagcagtaatgatggaaaatcagtgcagcatcctagtgcattcgcagtgtggtttgacaaagaccataatgttcttgtcaacataggtaacagatcaatgtccatctgtagattccagtactttttcttactaagaagtgattaacagctggatgtaatatgtctactacagctacctagttttgtaaagcatatagttaattaaagggcaggaatcaaaaacatgatcaactctgtaaaagccctgagcttactcagctgcttcttgcaaacttcaacctgtggggtaaagagacatttgttgggtcatggcatgcttgcctctgaagaagatcatttcaaagactgggcctttttttctggtagcctagatgcaggacacagagttgctcattttgccagagtctctttttgccttgccaaactgacttttctttcaaaaaactatgtggaaaattaatgtgtaacttttcaatgataatattttctctttgtttggttttccccaatgatttcatatctatactaaacatccatcccaaataagttacacaggaagtggaggccaaagctaaaacaaactcacacccatttctctggcaacctatttaaaaaatagcgattaaaaatcaaaacattaaacataaccctttctggcgagataactctcccctaggttacattagaaaacacccccctacgtttacatggcatctttgctgtttatgatcttagttttcattattgtggcctaacaaaaatgtataaagcttaaagaccagctggagcaacatagcaagacccgagctctacaaaaaatttaaagcattggctgggcatggtggcgcatgcctgttaattactagggaggctgaactgggaggatggcttgagcaatcctcctataaccaggagttcaaggttacaatgagctatgatcacatcacttcactcaggcctaggcaacagagcccgacctgtttctaaaaaagaaagaaagaaagaaaaaaaggtttacagatattttgacactgcaaagaaatctcataaatatctcataaattattagtgacctgcaggaaatgaaagctcagcgttgcttcttttttcaccgctcctgatggggctgaacagtttctttacacccttgaatgcagtctgtcgtggcatgtgggtgtacatccttctctcttaagacaagatgtaatagtaacccatgatcttgtaatctcacataacaaggcattttgatctgcagtcctggttgttttctttaagctaaattttattttttattattatttttttttagagacaagatctcactatgttgcccaggctggtcctgaactgctgggctcaagtgatcctcccacctcggcctcccaaagtgctgggattacaggtgtgaagcaccgcgcctggcccctttaagctgaattttaaaggaacttagaatctcattctcttacatttttataaccaagaaatgaaccctgacggtaaagactattaatatactaattattcccagcattatacacttcatgtgaaaggcagatgaagaaaatgaagaacctgtcttctgttcaactaaaagggaaatttagctttacttagttgtatctgtaattgtccttttgtttttaagaatataagaatataaagaatataaataattgcaataaaacaacataagaagttgaccaatggaacaagaatagtatagcacttagtaagatgtacagatactattttaagtaccttgttttaaagttaagtaatgacagcctccagttaataaaccagaaataaactctaaccattatttcttggatttcagatatttttttctttatagaaataatgtgatgtatagtgttccttttactgggtcagccaacaaaagtatttacgttgatataaataaaatactttttgtaatcaaatattctagctcacaatgaaaaataattttaaaatgtgattatttagtacaagtaaacaaactttaaaaatacaacaacaagatttttatttttcatgaaataaacaacagtgagtagaaggaaattttgaggatgttcttgagaagaactttttgacactttagaaattgatagacaaagcacaacttagactttcctttcacttgatactaatatgcccccaatcctgttctcccatcattatagttatttttaggggtcacaaatggaacaaacataaagaaagaatgagggatgacagtggaaaaaatggaggtggaaaagagaggaagaaaggagaaaaaggaggaaaaaggtagtaaaaaatgttcttgaaacagttggcaatagttacaaaagtgagacgaaaaagtgcacgggttaaagatgataaaaacattgcttaaggaagaaccaagcaacctgagagttctgaaaataggggaaatggggaatgcttggaatgtgtatgatctccccagaggaaacaatgttgagaaagaaaggaactcgattcattcccaaagtgggccactgggtgaccatgaaaggccagcgcagcctggtgctctcttgaccaagggaaacgtgggttggaggagtaacttcaggtaaaatcaaggtctgtggagatggagggtccatgtgctcggaagatatatgttctaaatgtagcaacacatgtttttttttttttagaaacaactttattgacgtatcatttaaatacctttaaattcacctgttttaattgtacagttcaatgatttttggatgtactgttgtgcaaccatcaccacaaaccagttttagaacatttctctcactccagtaaaatctctcctgcttcattacacttactctttgttctcactcccagtcccaggcaatcactaatctgctttctccatatatagattttctttttctagatattttatataaatagaatcatgcaatgtgtggtcttctgtgtctgtattctttctcttagcatgtttttgatgctatccatgttgtagcatgtgtcaatatttatttttattattaaatggctttctattctgcttgaagataaacacattttgtttttccattcactagctgatggtcatttgagttatttccaccttttggctattataagtaattctgccaagaacacttgtgtgttgaggtctttgtgtggacacctacgtgcatttcaagcaaaacgtaactaagagatccacctgctcatggaaaagacaaatatttaggcctgttgtgttctacaattctaggatccaaaacttcacatacacactctccacatggcaaccagaatggactttttaaaacagaaaatcagatcacatctcacctgattaaaatttcccagaggtttcccatcatactgagaatgaagcctacatgcctttccatagccacaggactctacctcatctgacctcagctgacatgtttcactttatctcgtaaccacttctcttactctcaacttcactcatattgatcttgttgctcctcaaatataaaagcttattctgacctcagggctcatacatagtctgttccatttgcctggaatacttttccctaatattcatttgactcaatccttctcatccaggtctcccctcaaatgtcattcatgtagagaagcttttgatggctgccctatctaaaacagcagccatatctctcacaatactacctttgtttttcttgagacagagtttcactcttgtcacccaggctggagtgcaatggcgtgatctcagctcactgcaacctccgcctcccaggttcaagtgattctcctgcctcagcctcccaagtagctggaattacaggcacctgccactgagagacaggactagctggatttcctaggctgactaagaatccctaagcctagctgggaaggtgaccgcttccacctttaaacacggggcttgcaacttagctcacacataaccaatcagatagtaaggagagctcactaaaatgctaattaggcaacaacaggaggtaaagaaatagccaatcatctcttgcctgagagcacaggggaagggacaatgctcgggatataaacccaggcattcgagccggcaacagcaaccccctttgggtcccctccctttgtatgggagccctgttttcactctattaaatcttgcaactgcactcttctggtccgtgtttgttacagctcgagctgagcttttgctcgccgtccaccactgctgtttgccgccgttgcagacccacgactgacttccatccctccagatctggcagggcacctcctgatccagcgaggtgcccattgccactcccaatcgggctaaaggcttgccattgttcctgcacggctgagtgcgtgtgttcatcctaatcaagctgaacactagtcactggattccacagttctcttccatgacctgcggcttctgatagagctataacactcaccgcatggcccaagattccattccttggaatccgtgaggccaagaaccccaggtcagagaatacaaggcttgccaccatcttggaagcggcccgtcgccatcttggaagcggcttgccaccatcttgggagctctgtgcgcaaggaccccccagtaacaccaccacacccggctaatttttgtatttttagtagagacagttttcaccatgttggccaggctggtcttgaactcctgacctcaggtgacccacatgcctcggtctcccaaagtgctgggattacaaacatgagccacagtgtccagtcctctgttttatttttaactgaaaagtctgaaacttattgcttgctgtctcccaaacagaatgcaagctcagtggggcaggtactttgtttatctttttcactgatgtatctccagcacctagcatatggtaaatgttcattaaatttgttaaattaatgcagaaatgaaaagcagaaattggacctcttcttacagttctatactttatccctagaatttctgagaagtcagtttgatcatgcaatgtattcagtttgtaaatttatatttttatttatctatttattttcgaataaaccttttgcagtcttatcagtttgtgaattcctaagccaactgaccacaagtctaatactgacaaatcatgggccagatttggtcctcacatctatctgtttgatgtagcaggtacgttggagcctcctttccatttctttggcccactcctatttcagctgcagctgcagtgagagttccctaggagctcaggctcacctcattgacaggatcacacctcaggcagctaaagaattattccatttttctgccttgggcctctcttatgccctagagccattgggcatgtgtgtggaccacttccggaccatgtttatgttccccagtgcaaatatcagccatcagccaacatgggaaccaccttcatccacacttccttcaaatggaaagctctggaagacatttacacttcccagtagtcccagcagaactgatgcgctcttcccttcagcagagacttgaataacaccttcttgtactgacttctcctgtgtcatactccctgttcctttacttatgttttctgggattacctcgccactacacacaatctgcagccaagtctttgtctcaacctctgctttcaggggaagccaaattaggcctatgagttacatcattaaaaaaatttgtaaaataattgttcaaatttaagcttgaaatatttcaagttaaattctgagttcttaacttcctactttaaggtgctgcatgtaacttcacatacaataatttttatggttcttatttggtaaggaaaattattgtccattagcttgttttcaaaacttcaacctttcaggtgttcataggtcatttcaagtgttttgtgaggaaaatggtctcaaaatctctagtctgttaggaatgagaagagatggggaattctttttactatagaatgtagcaggaaaaaaatttaaggagttttttgcttcattagatttgctgtggaatgagaaatcaataaattaatgactacagtgctaaaataaataattgatcagtgcttgtgaatatgatctcctcttcattactaaaccaactcagccttatcgtttccaagctaaggtaattgtaacctgcaaccagcagaagaaccaaccattttgttttggtttgaagcctcatgagtacaattcgttcattcaagcatttagtaatattaataaaaagagatgaattgcaatagtgatgcattcttgcctcttcacaacatgttttgcttataagaggacattatcttccccccttcagtggagtcagttatttgcagttcttgtcccaggtatagttttacatgctaatccctgcctgctttttttttttttttttaatagggctagggtcccactatgttgcccaggctggtctggaactcctggcctcaagcaatcctcctgccttggtgtgccaaaatgctggattacaggcatgagccaccatgcctggccctgattccttccttctgagtagctcagtttacttaaaagcaactctttatccctgaagcagtcttggcatttgatcttatttaggatgcagattcccctaatattttggagaccattttctacacttctggtgattgatacaatgcctcagtttgcttatgactgaaacaatcttgtaatttatgattcctcattcttctgtgtctgacttgtagaccatatcaaatttgtcatgtctaactataactctaatactctcctgctcttttatacccaaatcttcagaatgaatattgggaataccatattatacatggatctctaactttttgaatgacctgaagcttttcctttaaggaaatacctctctgctccctggccggactctgaatcccatgacattatggtcccttccacaggagtgagtccatcatccagactgctcaatcaccgcactccaccatcagttccaggattggttcagggagccacactggcccaaccagttatgtaactttgctgaaaccattaggagagaggttacatctttttcttttcattgggattgctctagttaaacataaatccaaagctgctggtggccatttttgccaaaatatggggaatttttctttaaaattgactcagtagaaagaaaagaaagggcttggcatagtggctcatgtctctaatcccagggattagggaggcagaggcaagaggatcgcttgagcccaggagttggagaccagcctgggcaacatattgagacctcatatccaaaaataataaaaaattagctagacatagtggtgactctctgtggtcccagctactcgggaggctgaggtaggaggatcacttgagcctgggaggtagaggctagagtgattgttatcacaccactgcattcccacctgggtgacagagtgagaccctgtctcaggaaaaaaaaaaagaaagaaggaaagaaagaaagagaaagataaaaagaaagagggagagacagtttaaaaaaaagagactgaaaaagagaaaaagacagacaaggagtaaaagtctctgtcaaatgacaaaggaggccaggcgtggtggctcatgcctgtaatcccgacactttgagatgccaaggcaggtggatcacctgagatcaggagttcaagaccagcctggccaacatcatgaaaccccatctctaggccaggcatggtagctcacgcctgtaatcccagcactttgggaggccaaggcgggcggatcacctgaggttgggagttcaagaccagcctgaccaacatggagaaacccccatctctactaaaaatacaaaattagccagatgtggcggtgcatgcctgtaatcccagctactcaggaggctgaggcaggagaatcgctttaacccaggaggcggaggttgcagtgagccaagatcgcagcattgcactctagcctgggcaacaagaacaaaactccatctcaaaaaaaaaaaaaaaagaaagaaaccctgtctctactaaaaaatacaaaaaattagccaggcgtggtggcaggcaggcgcctgtaatcccagctacttgggagggtgaggcaggagaatcccttgaaccccggaggcggaggtttcagtgagacaagatcgcaccactgcactccagcctgggcaacaagagcaaaactccatctcaaaaaaaaaaaaaatgacaaaagacaggcatcatttaaacctctgtgctcagccacacctgaagcaaacaagatctgtcttttccattttcttagacaaagaatttttctttgcaaaattacatgacttatttttcttaagcaactttgaggtaaatttttgttacctgcacttggaagatgcctaatacttgctatgtctacttggagtaggattgcttgggttcggctatgtccctagagatgtcttttcttcctccatgaagcttgtcgttattaccaggatcaattatctggagaggagggaggccctcaggtagcaactcagggcgaggggacaaggctgaggtgtatggaagctcccatccctttctgggtcttaatgatgacaaggccaaatatttgagaatatgtacttgcagaaacagacctcaagaaaggaaggaaagagccctgcaatgggttaaaaactgaagacgaataagctatgcaatatatgttagagtattttgtttcatggtcctactcatagtacttgttgccattttgttacattctaaccttcagtaaagcttaattgggcatcaattctgcctcagttgaactaaatggtatgcaaggaagaactatatgtccatatatgggacaaagcactgaaagcagggcattagtttttgcctttcgaggtcagcaggtgatacagtcaaaataatccctgaggagagtgtttcaagctagtagttgggactgtaaggtcaacctcccctatcaagaagagatgctctctcattgactactttgaaacatctgggttttatttaattaaggaaggcataaatgtatcacgccaattatatgaaagcataaaataagacatctaaagtaaagaaaaagattaacatcccaaataagaaaagcaacaatgctcaatttcttttaatctaaaaatctattaagacttcccaccacactttcagacttgggaagagatggcagtgagctagttaagggcagaagaaacaagacatagatacattgatagaagtatagatacaatgatagaagggggcttcacggatttttgctggcaggcaggaaatcataaggtagttccactaaagcttaaactttgtggcttttggaagatgcatcacccttgttacttagaagcatgcccagcacatagtaggccaaaatgtgaggttggggctatttatattcttacctcagattagaattgggcctaaaaaagaggcatagaaagattctgaaggtggtactcatgtgatccagctgctgagatgcggcagaaggaaagcagagacctctaacccaacttgttgaaaagcagctgaaattactgcattcagtttataaacaataatagtccaatgataaattttaaaaatctctgtgagactaagaatgctgcccatttgctcctctggaacagtagcaagtacagtgaagggctagcaccacagctttatggaaggaattgcctttactttccatttccaaacctcatattttgttttcattgagtcaattattaatacatttcttaaaaatttccatgcttttaaagagagctattttcctccttaattttttataccagctggagattgacccatacaatactactggtaggtggatgaacatttgtctttcttaacttttaatattatcaaaaagtaaaacttgtaaagaaacatttcattctgaaaccaatgttagtgctgcaaaaataatttttggaacaatatcttatgatacagaagatctatgtcatccaaggagcctcactgcaaacaatacaaatggactctgcctgatatgggcagaaaaaggatttattgaaaggctattggttagcctgcactgtccaggacagcaaacaggcccagaggttgtgcacccagagatacaaccaaaatcatatcacaaagctggtcctatgtggacgttgctgctgctgccacttagcatcagatatcacagctggcccaattggcattatgtgttggatactactgtagatgtggctggccatgctatctttagaaactagacattgctgctacagtcacaagcagaaatgttcccttctctcttcatgtttgcaaaattagcccccaatttcaaagtccataggtttgaatctagagtatatacccatgttgcatggaggactggaaagtaagtatctagcattttgggcttctggggtgaatggtgaggtgtgacttccagcaagactcaaaaggaagtgaggaatttcccaaacagaaggaggggaaaaaaacccataaaaacagtgaccactacagtccacacctttgaatgcctaactacatatattctcttctttatttatctttacttatgtgtctacctaatacgatgcagatatatccaaaacagcaaaaaacacattcaactcctctcccaagagaaaccaaaatgtaatcagttactgcatccagcttcaagtccagaacttctgggtaatgatgttcattcatctcccagttcaatcataatcccatcttgatataaactatggattacattgttcaaattcattaccaccacttaatataaaataatgatgagaaagaaaaaataaaaggaaaattagttaaaatataaatatgtatcatattttaccaatttaaaatacatttttccaataatttaccatgtctgaaatcaaccaatggcatcttataattgctatcaactgggtggcaattgtgatgtaattctccttgccttagtattaccttaactgattttttagaaaaattttagtgtttgcagaagagtgacatgtgatggaaatttgtgtctaaaacccctacaatctctctctcgaggtataaagtaaaaattctaagtgaaagcaagcagcatcacatcatagttcagtgggaagtgtttttctttcatagaaataaaggtacataaatatgccttggagagtcaatgaaatacagtacatgatacagaaaaaaaagtgggggcagatactacaatatacgtttctgcaattgattacaaattggcagttgccatatagcaacaaattccttatttcaccagccatcccatgttccctttccctccagtccacatctcggattgtcagtattctttccctggtagagtgacctagacttttattactaagggatcagagccaaaaggtggtcttgtttatgtaaggttgttgcaatctttcattaaatttttattgtagacatggcagtgtggaagttaccccagagaccctctttgttccacccatactctttccttctaatcattagaagcaacaccatttactctctatagacgtgatcaatcatttaatccaatagcataaaccattttatcctgcttaccaagttattagaagatataagcatggtcaaatggcaatctcagcttcttattcaatggaatactgtttctcccctggtggatgcatcttctttttgaggtactaaaacctctaaacgagcaaggttcagaattacagaaatgagaagtaaataatttgcaaatggatcattagaagtaacaatgagtcaccaactcctacttccacagcttggtttttagggtgtattgtggctatgagggaaaaagagcaacattttttggttgatatttcagagcagtggctctcaaactttaacatgcaccaatacttttttagagggtctgtttaaacatcagttgctgtgcccactccaagacttcccaattcagtagttctaggatgaaactagattatttgcatttctcacaagtacccaagtgatgctgatgttgctggtcttgggatcaccttttgagaactactggttcagagaatataacacattctacaggacagtgccacaattttgcattttgtcttatagctgttcgtctatttctagttaataaacatatggtaagccataaacataagctctactgcttatttaattaaaaatggctgtccagataaaaagtaatgtgtacaagataccatgatggtatgtaagtaagatgcctttataatttgtcatctgaactggggtgcttttgagggtgatgagggctactaattacaccaggacaacagcaacaaactggaactgacttgggtgaaccagatatgatccccctttgtaagaggtatttagtatatacaggatggttgtactagcaagtgtcagacacaaatgttaggaggcggggcatggtggttcacgcctgtaatcccagcactttgggaggccgagacaggcggatcacctgaggtcacgagttcgagaccagcctagccaacatggtgaaaacctgtctctactaaaaatacaaaaattagcctgatgtggtggcacatgcctgtaattccagctactcgggaggctgaggcaggagaattgcttaaacccaggaggttgcagtgagctgagatcacaccactgcactccagcctgggtgacagagcgagactctgtctcaaaaaaaaagaaaaagaaaaagaaaaagaaaaagaaatgttagacaggaaaataaatccaaatccagaataagtaatagtacagtaaggatgaatttctatctcttctgtgatgatagacagccaataaattaacctgcctccctgtggctgaatgtcctcctgggatatgatatcatgtcagaggttcaagatttatttctgctgctagcaagttgggcaatcagcagtgacagccagcattggtgatgaaaggtccatattgttgagcttgtgcatactctgcatccaagttgctgtagacactttgttcatgagcccgttgagtgagccccaggatcaatggggaagaagaatgactaacatttgcagagtggattattttgtccactggtttactaaacctccacagagttttttgttgttgttgttgttgttgttagcagttaagatatttttgacttcaaaaaaataaaaaccttggacagttgatataaaccattaagaatttattacttcacatgttaaaacgttctaagatagggtggtgcaagaggtagttgattagatagctcaacaattttattaaggatccaggtccttcccatctttttgctttgccatcctgagcatattaccttagcttctttcatagtcataagaagactaaggtacttcaggagagacatcttcacactaacatctaaaggcagaaaaggggactatttattgtttgcattttaatagataaagaaactcccattgaactaaccccacagcagactcccttcaatttctcattggctaaaatggggttgtatggccctttttgaggctcacgagggaaacagaatcaccatgatcacttagattcactgattcacctgcaagcgtagaggtgtggtcagccttctctggagcataaagtcacatggaggagcttggacacctgtacaaatctgaagttttgttcacaaagaaggggtatagctattggattgacaaccaatgttgtcacacttatatgaatcccaaatgtcttcgtatgatagtcccattttgagacccatccagacacttgtcaccagtcctctggtctttatctttccacttccatgaaaatctgaccaaactatttgttactgtccatcagcatttctctcttgctggaaaaatcaaggacgatataccactcaagctctgcatactaggataattttccttctccaccttcactttggtgggactgagtggaactgagtagcacttcagtaatctattttgtacatttacttttagtgatgccagcttactctcagagctatatgtaaactatgctagttttcttcagttaactggtaatggagaactattcatgaagtcatgatggttggcagagaggtggcggtgtggcatgaggatgaatgccaggaagaagagccatcagtatatgaaacttgagctctcaggacatgctcagatgcactcacatatatactatttccactcgaatatgtctgactttatagctgtgtagatcagataacattcacttcatgataggcagcttgtgtttcacagtcatctggtttctatctgggcccagtattaagccaagtgctattccttcaaagaagaatgaatggctactcactgaagaagttatagctttgctctagaaccctgacgttcctgctgcgaacttcgtattcactctttctgcagactcatttgatttttgagtaccactggtcccactgggtcctaagggccatataaaaaaagctgcagcctggaccagctggagcattcctctgggccctactcaaagctgttagcctttcagatcactcaagaaaaggagctgaagggcacacaaaatgagacatatgttgcttctaaaatccagagaccaccatcccacatagtactttttcctagaggtgggaaataaattgtccttgacactgaaagtataaactcacatgtcatgcaacactggatcccaagaaacatcattgaattatcatgagatttatttctactttctggcatgcatggtcttaatctaaaatactagccacttgctgttctccagagtcatcagaatgttatcttcagcatatccctggatgatgagatgaccaggttcctttagagcaacttatggcacagagaatggagaagtaacataactctgagttgaaaatatagttctgctgttttaggtaaagtcaaactacttctgatgtgctttctgtgtttgctgaagcagaaaaaaaaaaaaaggattgtccagatgaacgctgcaatcaatatcccatagtatgtcttgattcactgtgataaggatactacatttgaaagatcatatgtacttgaaagacaagtttccacttgacttagcctacagttatcccctagaattatctaagactgatccatcttttgcactggccagcagttgaagaattaagtggggatgtgataggaagcacagtgaccttcagctctatgatttccccaggaatgtagtgcaaaaaaattacaataattttttcaatgaagtataacagaatattttttgatttactattttgacagtgacggtaacccctgagctttcacaaagtcattcttaaccatgataactgtgttaaactctattctataggtcagagggtcagtgtcagaattctgccatttactgaggttatttttactaataatatgcccggaaactgaaaataatcctagcgagggttcaggggcttattagaatgcatttgtgttcagcgcagtggaccactctaagtattttaaatacaaagagtcttaagacagagaattaagtgcttataaaatcattggaaagactggggaggcaagtatcagaagggcaccatgggccaggtgcagtggctcatgcctataatcccagcactttgggaggctgaggtgggaggatcactttagcccaggagtttgagatcagcctgggcaacatagcaagacccccatctctataaaaaaattaagcaattagccgagcatggtggcacgtccctgaaattccagctactcaggagcctgaggtgggaggatcacttgagcccaggaggtcaaggctgtagtgagccgtgatcacaccactgcatgtcagcctggatgacagagcaagaccttgtctcaaaaaaaaaaaaaagaccctaccagaacgactgagttaacgaacacaacaccaaagctacagccactaatcctggagtattttccattattcaactgaattaggcccctggtgggctgctcatctgtttttatctttgtaactccattatatgtaaaagatttctggagatgtttgaaggatgtatcattttgaatgccataccagctctagtgctattattattattattactactattattattattatttttgagacagagtctcactctgtcatgcaggctggaggagtgcaatggcatgatctcggcccagtgcaacctccgcctcctgggttcaagtgattcttctgcctcagcctcccgagtagcggggactacaggcacgcaccaccacgcccagctaatttttgcatttttagtagagacagggtttcatcatgttggccacgctggtcttgaactcttgacctcaagtgatctgcccgcctcagcctcccaaagtgctgggattacaggcgtgagccaccatacccggcctctactgctattattataggagcatgcccaccttaactttgccagttaggtgccactacttgtccttttccatcagtgtcactgttgaaatcaggagcccttttcaaccacagagtattctctttttaccccagcacatgaaaaccaccaaaatgccttttaagatacctatgcaattcttgagcccctggtataaaaaaggttttctgtgcatttcttcctccttctagaggaaggagactgttagggaataagcgtgtagttcacatgtgataatctaccccaatattctcatctccataacctgttggcttccttcacctgtattcttacaaaaatgtctagcatttcctgttcatttggaatgaaatactactgagcacagctcaagagagcaaataatttacacaacttgcagctgcttaagccagcaccttaaatccagaatctccaataagtgtatccctattgctgaattctgtgtgatctatagttatgctcttcctttcttggtctagtactctcaatccatttccacacatattctccatattatgccagcataccttagcactctttcaattcctttggtgagaacatcttctgctcttgaatttggctttgcagttgaactcctgaggcatatgggatctgaatctacacgcagttctggtgatcttgagagacagtgggagtgggatgtgaggagaagtgacttgccttgcgaaactgttccctagactttctcaagtgagagtactgagaacccctgacagtaacagcatcatcagacaggaaggctcattgggctaaaaatggtaaaacctgtgtgaaattggcctcaagagtctgcatgtttattatgtaacatagtaaggattctgaggcaaggtgggcttcagcagtgctacatgcaggttctggccctgtttttcttcagttctcttgttctgctctctgggaattagctttgtcctcaggagggaatccctcttggttgttagggtggccaccagagcataacgcttcctatgtacattctgtaggagagacataatcccaaagccacaggatacaagtcctcccattcagagtgatttgccatttctacattgttaagagccaccatggaaacggcattcattggacagctttcgaggatgggttcctgcgcttatacactgttggttggaaggtaaattagttcagccactgtggaaaggagtttggagatttctcaaagaacttagagctactattcgacctagtaatcccattacagggtatatatccgaaataaatcattctgccaaaaaaacacatgcactcatatgttcaccacagcactattcacaatagcaaagacatgaaatcaacctagatgtccattaacagtggactggataaagaaaatgtggtacatatacaccacggagtactacacagccataaaaaagaacaagttcgtgtcctttgcagcaacatggatgcagtttatggtcattatcctaagcaaattaatgtaggaacagaaaaccaaataccacatattctcacttataagtggaagtgaaacattgagtattcatggacataaagatggcaatgatagaaactgaaaactactagaagggagagggagagagaaaggcaagggttgaaaaactgttgggtgctatgttcagtacctgggtgatgggatcaattataccccaaacctcagcatcatgcaatatacccagataaaaaacctgcacacatacccccaaatctaaaattaaagttggaaaaaaaacaaagaagattgggttcctgaaccagtcaccagcaagggagaagaaattcacatgatggttcattctaataacatttactcctatacataaggataggtcaaatgcctgaataaaattggggtttctattaggaaggaggaagagaaaaggtccatatgatggaacatctattgaagctaaaaatgttctctctcatccagtaggcagagaagaataacagtaatatagcattttagggctaatgctcaatcttggaaatacatgcattaatattttgctttatatttactctccgtagatagctccactttggaatagtagggcttttactttatggtggaaattctattcttttttttttttaatcattcactatgactaattggatgtatatctacaaaatgactacctgttatttacctaaattttaaaaattttggctggacacagtggctcacgcctataatcccagcactttgggaggctgaggtgggaggattgcttgagcccaggagttcaagaccagccttggcaacatagggagaccccatctctacaaaatatattttaaattagccaggcgtggtgatatgcacctgtggtcccagctactcagaaaattgaggtgagaggatcccttgagtctgggaggtcaaggatgcaatgagctgtgattgcaccactgcactccagcttgggtaacagagggagaccccatctcaaaaagaaaaacaattaattgcaatttcagttacaaactagttgaaatgaaataagtgggagaaaaaagtagtgtgtgcatttctttatatagaccttttgataaaacctacactttctaaaacaagttaacattttccaagtctggtgaatttaaaatggttacaaaattgtttacaacttttttcatcaagagctggagttggccaggcacggcggctcacgcctgtaatcctagcactttgggagtctgaggcaggcggatcacgaagtcaggagatttagactaccgtggctaacatggtgaaaccccgtcactactaaaaatacaaaaaataagccgggcttggtggcgggcgcctgtagtcccagctactcgggaggctgaggcaggagaatggcatgaacctgggaggcggagcttgcagtgagccgagatggctccattgcactccagcctgggcgacaaagagagactctgtctcaaaaaaaaaaaaaaaaaaaagagctagagttcattttaccaccccttaaattcaagctgtccttataacttgctttgaccaatagaatgctgcagaagtgacgatttgtgacttctgaataagacctcaagagaacctagcaaaacaaataaatcagtcttttggtgggggggattactatttctgtagttctttctttattttatttatttgtttgtttgcttattttttctttctttttgtcttttttgagcaaataaatcgttattttaagccactaagttttgaggtagtctttatgcagtaataaataactgatataccaaccctttcataaggattcatgttctatcattttactgggatttgaagtgtgttgttattcaaccatacttaattagaaatcaaacattatagataaaagctttttgaactcttagcctcaagtgagcctcccacccagcctcccaaagtgctggaactacaggcataggccaccgtgccccaccagataactttttcaaagaggaataacttaaaaactcagtcctattttatatgcagaaaaacaaaaatagcatataatctctatgggagtgaaatataagtatgtaacttcacgcatccctgtaaaatataatgcgatggctcagagcagggactgggaaaatgctattcctctcctgtttactgcaaacgctttatgagcccctaccatatgctcttgtattatatctggtaggtacttttgggtgagggttgtgtggggaaatgaaagtgaagttggggaggtgaaagctccattaataaaataaaatccttaaccaattaaaattttaaaaatatatttaatgttatctgtatctcattattaatatgtacatcatattctaatgacccatgtattattagataatacatgtatataattcatgaataaaaatgtatctctgttgagcaaatgctcaaaaattttttatacgcatatgtgaatgatcaaaaaatatagaggatgggctaggaaacatggtagcccttttaagagacaaatatagaagcaaactatacctgccatgtaatataaataagcacacacatgcctaccagatatcatgtaactggcatgacaaagtcactgggaaaaggcatacctatctgtaattattgacctactctgggctatgacattataccaaactctttggaggaatcaaagatgaaattagaagttttcttgactaacatccaattcttttggaatttccctttgggggcatgttattttagggtcattctaagggttcatgcctataataaaatgttataaaaatatccctggagctaccctgcccactggctcattttctgagtggactcaacagactggtggcctggggtttgttctgggccccttgcctcaggtgcaccctggtgtgacctcacacaccacaaaacagcctagtgttctgttttgttttgcttttttgttttgagacaaagtcttgcactgtcgcccaggttggagtgcagtggcttgatctctgctcactgcatcctccgcctcctgggttttcaagtgattgtcctgcctcagccttccgagtagctgggattgcaggcacccgccaccatgcccggctaatttttgtatttttagtagagacagggtttcaccacgttggccaggctggtctcaaactcctgacttcaagtgatcctcctgcctcggcctcccacagtgctgggattacaggcttgagccaccacgcctggccaaaagagcctagttttaagctaagagttcatggcgctggggcattttattcctccatttgcctagcagcttccactgcagatgttttcttacccttctggctattttcacctttctttcagtggcttttttttccatttttaaaaattcacaggcttcctgtttctaagtatttaccacatttctgttcatgctttttccctgacttttatttttcaccccttcttagccctctctcccaaccacatctgttttactccctttcattttttccccattcctttattccctgctgtcctgtttttctttgttcaattcagaacatcagccggaagcttccctgttgctaagtaaccacatcacccacacacacccttttccattttcaacttatttcttctgttttaataaactcatggggccgaacagtctctaaaagaaaacgagaggtgctgctgtcttctcttcatgcagcagagatgcataccctctcatatcctgccttttcttattagattttggcttcttgttttattgataatttgccccagactgtgagataacactaaataagcacaaaatatctttttgggcttggacaatttgcagaagggaggaagagatataatttctgcagaaggaacaatgaaaatgtttaaaatatagttacaaggcatggcatgggctcattgaagggtgtttgccttgaccccggaaccaaatccagccctccctagtaaaaggtttccattagggatcaagttagctagcaagtccctcttaacattgttgagttgtgaggaagctactaatggcatggtaagtgtgatttgcacaaaatgaaggataaaacaatacaagaaatcattatgtggttttccaaatctcaatccttttccagacatcaatctgacatggcacttgtgccaaaggcataattggaggtgtgtgagcccttctcacaatatgctcttgagggattccaagtcttctggcacattttaataatttaatgggaatggtaactccatatgtccaaacactagggcagagtaacagagataccaggagatttgaaaaaaaatcttttcacccttgcaataccataaataatttccttgcctggtgtgaattctttctctgacctcttgcatttatgcaatgcctgggaggcctttcctgctaagcccgcccccacattgttgctctcagctttttgcccacagtgagcactgtgctaattgggtagatttgggagctgcttcttaagaagtatcacggccgtctatgtaggtgtgtgtcccagctcctctggtagtgctctgtgctctctgtcagggaagggctcgtatccagcatgtaatgaatactcaataagttgccttaaatttaaccacagaacacagacactctgacaaggggattatttttagtttcattttctagatagaagaacagtggttttcttcatattgaagtctaagttcatcaatcaaagtgccagaaatgaagctgatgcatttccatcactatcctgaaatgcagatggagcatttcagtagagggaaatttcaaaagctttatttgtcaagacctgttgatattctgaaagcagaaaccctgtaagactaaaacctactctaaggtattctaagaatgcctagccagaactggaattggcaagctttttctttctagaatctagcccctttgagatgttaggtcttctgagagtttcagaaagttttaacataatttcaacttttatcttagggtaacctcaactgatgaaacatacatttgaacctcctggaatttttattttatgtgccacttactttaaattatacaaaaccttcactgtcttccagtattcacttctcttttaactttcttttctcaacttgagatatcaggaaacgccaccatgtcatattttcttttcttacatttttgaacatctaattccttttttcctttccgtcctcctcatcaatgtggtctagtcttatagggaacttttctctccaatcacaatcccctcctcttccacttctcgcttagctactcttcccacaccccaaaaagactctcgctttgtgattccagtcctggaattctttccctattagtgtcctcttcacttcactgcttccctaccccatggagctctcatgagccatccctttaaccattctcttcagtatctcagttcccttgcccctcattggcctggcaaatccccaaacttcaatgagttcatcttcatatctccctgtctgagcccaggctatctctcctggagagagatcacaactctgccatggatgccattccaactctgtgaccccaagtactggtccctccaggctggtcccagcagtcctcctgggtttccttctcatattcctcctcatctgctttttttttttttttcttttttgagacaggctcttactctgtcacccagactgagctcattggagcctcagctcattgcagcctcaacttcccaggctcagatgatcctctcaccacctcagcctccccagtagctgggactacaggtgtgtgccaccatgcccagctaatttttgtattttttgtagagataaaattttgccatgttgcccaggatggaatgaaactcctgggctcaagcaatcctcccgcctcggcctcccaaagtgctgggattatagccatgagccactgcacctggccttacctcattctttttagctcctcattcaattctacagtgaggaagcaccaacacttactaaactacttcctttttattaaacttcattttctgttattacaaagaatgtgctaatgagatgcttatgcatttatttttgtttatatatctaagtatttctgtaggatacatagaaatttttaggtaaagtggcttgaaatttttaggtataggagttttatactttttgcttgtaaatatatttaaacatgtgcaaacttttatgtattaaaataggcaaaatacgtaaaaccttaattcacggaacagcaaatctgaaccaatgaacatatataaagatactcaagctcacttatagccaggaaaataaaaattaaacattgcaatatcactttatagctactaaactgtcaaaaatctaaaagaccaatacaacctattactggtagaaatatgggagaaagagttgcttttttgggggggggacgggggggaaacaatctggcagcatctactaaaatttaaaaaacatatatagacttcaaccgacaaacctactaactcttagagttcaatcctataaaatagaaggccaaaaggtcggaatatatagacaaagatatctttgggaatattcatttcttcctgcaaatatttattaagttcggactatattgccatcacttcacagatgaacaaggcacaggccctgcccttaagttactcacagcctgtctggagacagatgagtacacaagcaactggagttcatgagcgaggtgtctagaagcaatctgggcctgggatggaaggctgcaaagacttcactgaaaagcaaatttgcaagactgtaaaatacaacatgcttccaaggccttggattaagttgtgtggtccaggatagctgaacagagtaaagatacctggatatagggaaaagataacccataaacttttcacgaaacaaaattgtgttaataaaagtcacaggtactctagttactctagtggcagtggagacagaatatgagatacacaatgaaaaaagaacttactttttaggaagagaattaaaagagtctattattaaatggtagccaaaatgctgtttttctcgtatacctggcacagaacctactcttgaaagctatgtgttgaatcaataaagtatgacatgggaacagcatataaaaaggtttagctcagataaacttgaattcagtcaataatctcacctatttaagatttttccttgaatagacttttttccttccttccttcctccctcccttttccctaccatttttcaggcgaaagaaagactggtcaaataggggttctaaatcctgttaacctcactttaaccctgttatttcaccatttaatgacaaggcaaaaccatcagctcttaaatcatgaactttaaatgccaaaaacagtgttgagaaatttttaaaatatgagtgttatatagaaaaagaatgactaacactaaaagcaaacaaaacaggcagttcattagaaaccggtaatatagaatagccccgattttgtacctaacagatctcggaaagggactgacagcccacagagaaacaagagcagcacatcaagacgaaggcacattttcttcccaactgctgtcatttaaggaaaacccatgagcgtgagttctcttatgggagggtagcgacctccatgaaatcatgagaacattcccccagtctaagtgctgcctggctttactcccacatcaacagcaaaacaactgcatagcaacctacatttgcccatttcctcactcattaatgtttgtccagaggaaacacccctgccagtccctgtctgctttgtaaagtatgtcaaacaggagttgagtgtgtacgccagattgggaagtgacacatgctggcatttctcagcgcatgcggctccccactcggctttctggagctctgccttttggcgacagagcagctagagctcctctcccctcccccatttcctctcataaagataaccagtaacaacaattggcgtgtgtgtgtgtgtgtgtgtgtgtgagagagagagagagagagagagagagcgctcccagttggccaagtaccctttacatccagtgacctgttttacgaataataggaaagactttccagcttattttctgcattctcaggagtacgcagagttcacagtaaatgcagagtaacagtcatttctaaaacaaagataaaacactccaaatgctgctctgcaaagaccatttgccatctgttcctttccccctgacagggctgcttatcaggactccagcaaggacaccatcatagcaatctagatccgagtacttttcctctgttgcagggggtgtttccttgaactttcccatctgcttctaagcaagaggtataaaatattatctataaaataagactagcaaatgactcacagtgaataaaaataaatcagggtgtagtttgtcatcatctttaagagaaaaaaaaaggaaaatgctccacaattggagaaacaactcactttttcaaacctcctcaaggaacgtcttcaaatgataggc

SEQ ID NO: 1675 - DNA, 160427 bp, Homo sapiens
tttggtgtaggcaattaattttttaaagattttactatttgttagaaagatatacaagagcatttctatcctcaaagaaaatccttggatttctgcagacagcagagggcttctcaaaagttactacaaaattaatcacctccacataaatgtatacataacctggcatgacacctgacagggtaaatgacagacaaataattatatgctgaggaaatgttgttgacctaattcaactttattagaaaaacctactttttcctctagtttcttcttctcttcactaaataggcttagtctttgtttgagaaactcattaagctgtaaaacttctttctcagtagatgcaagcttttgctcaaattccccttgttgggaatgggaaactgattcctctgaaaatggtgtctggagtgaagtgttctcatattgtggctgttaggaaagaaaaaaaggaggtaagactttaaaagtttgtcttgaacaaatgtgaagaaattggaaatgaagtataatataaggagtacatataggctacatgaacagacacaccttgatttaaattccagctatcttgcttcctagttatgtaccataattaaagtaaattacttaccttctcaaaaccctggttttctcatctctaaaacagaaacaataaagcctactttgcagtgttttttgaagaaagataaagtatgtaaggtttccagcatataggagaaacttcatgaaagacagctattatttgattttaaaagtatacttcaacatgtaaatagtacagtatatacattaatcatataaaagtgaaagttctaagtaaataaataaaaactaaagaaaaatttcttcacagttaatcatttccagctaatactaaattcaatatgtattaatagaatgtttctctaactagaaagtaagatccatgaatcggggattcttgtccatctcaaagtgtccatcttatattccctattgcatagaaaaaaatggcacaaaataagtactcacaaaataattgttgaatgaataaatgtattattgcttctatgagcaaggctttgaaggaaattcttttcaaggggaagatattccctctcccccatgtaggattaaaatctggaagaggaaggcaggaaatacaaatattccttcaaacaaatcagcatgtggttaagtgctgtaaaaagatatcaacaaagtactgtaaaagcaaagaaagaggttatttttccatttatttaaaagatatttacaaagcacatacgttaggcattgtgctaggtgctggggattctacagttaataaaatcagatcccaccagtttaatgtgtcatacacaaaaagaccaaaaaaagacaatgaaactaagtgctaagatagttacatgtgcagtagctaagggagggtgttacagaagtaaatttgaactaggccttgaagaactgatactttcccaaaaggtaagcatgcaactcaaccattacagaaatagcatttatcatgtccaggctatttcaaagatggcagactcaccctttacaaactcaaattttaatcagagacatgagaagcctttagatgattgtaatatagaacagaatgaatatggtagccaaataaaggccatgttaagtacaaagtattgggagaaagtaggatacatgaagacattgagcgaatgaggaaaaaggcttttctggagaggtggcttttgagacagattttgaaaaacagattctggcaagaatggaaaaaggaacaggcattctagaaagaacatttttaaaaaggttaaaaagtagatacagagagttatcatgtcatgtttataggttacaagtgggcagaataaaagggaaaacttacaaatctaggttgcagccttcctgtagaattccaagaattgtgaacttggctttgtaaatctctatattccccagcattcaatctagtgtctagactctgagcaagtctgatgaaagggaagagatgagaggaaaaagacaagagagtgctagaagaaataggacaaagctagattcagtgaacaagatgcactgagaatgaatatggatgttatcatttaaagaaattattctaactaatttagctgaaaagaaacaaggagctgatatagagcatggagaacagaatgaagaaactggaagcagggtgaaaggatttagagaaaatgattatttaaagatgtaaatggaaaataaatgttaaagataaccaaggtttaagattttgtctaactaatacggaagattatcttctgggcagaagtaaatataaagaagaacagtaggttatatagaaaaataggttatacttaagcagatatacttaatataattagagcctatgattattatttcatttgaatatacaagtacagatggacaccaggcagaaagatagatatggaactcaggaagatggctaggctatgaaactataaaaagctaatacagacttccagtttctagcccagcgtgtaaagatatcagaagtcgccactcagtcctaaaaaaaataaaataaaaagctgaaaaaactgaaatatcaacaagtcttctaaagtctgtgagagaaatgaggttacagggcaaactgctgcctccaaaactggaaaaaaaggataggtagaaacagaggttcataacctaataaagcaaaaacccattagtagaagagccagggtgggaaaatctgtaactaatgaattgctagagacttggagtagataaatctgagagttaaaaattccacggggacccaatcatacaggaggtttccatatgtctgtgagttttacctccaggagtgttctacaagatcttcagtgagtatcagagaaaaatcccctcctgtttctggcagggggaggggaaaaggaaccatttaaaatatgccagagcattctgttcttaaaaatgcctgccgtcaggagaaactattttaccagagcctaaactgctggggttttatcagagcttaacgtagttggggtaaagggaataacccaactccagccaactccagccttccacatagaggagggttaatacacaaatcaagctcctttggccttccctgtggaaataccaactccatcgccctcctgccatcctgtcccgcctaagggtggggaaagaaaaaatcttagaaaactgaagttcacaatccagaggaacaaattcaccaaaagactgagacctaaacacaggactatagaatacttccccttccctgcacactttaccactgcattactaaagctctatttaccacacttattaaaccttggacatcatgtctactttcaacaaaaattacaagacacgcaaaaaggcaaaaaacgcagtttgaagagaccacaaagcatcagacacagagtcagatatggcaagaatgtcagaattatcagaccagggatttttgacaactaggattagtaagattatgatagaaaatgtagacagtatacaagaacatacagataacgtaagtgtagagataaaaattctagaaaagaataaaaaagaaatgctaaagattgagaacactaacagaaataaagaatgtccttgagggactcattagcagagtagacctggctgaggaaacaattcctgaacttgggatatgatgacagaaacttccaatactgaaaaagagaaaaaaaaaaaaccttaaaaaaacaacatgccttgtttcacatgaggcttctgacttggactttcgggttaatgctggaatgagttaaggctttaggggactgttgggaaggcatgattgtgttttaaaatgtgagaacatgaaatttgggaggtgctggggtggaatgacacggtttggttgtgtccccacccaaatctcaacttgaattgtagttccaataatccctatatgttgagggactcagtgggaggtaattgaatcatgggggcgattacccccatgctaccgttctcgtgatagcgggtgagttctcttgagatctgatggtcttacaaagggcttttccctctttgctcagcacttcttccttctatcatatgaagaaggatgtgtttgcttccccttccaccatgaatttaaatttcctgaggcctccccagtcacgcggaactgtaagtcaattaaacctctttcctttataaattatccagtctcaggcagttctttatagcagcatcagaacagactaatacaaagccctttactgttggtgaagaggtgatcctgcctgctgccaagcacatttgtcatgaactcttaggagacgctgcagttcaaaaggtgacatgtgttcatctttcatctttcagccatcacaacaaaatgaactgatgaaacagcagaggatattgaggcacagttgttaaagaggatgaatgagtcactgtggtatgcaatccaggttgaaaagtctatcaatgttaacaaggcaacaaggcttgcttttgtgtgatatattttcagaaggatgtgcaagaggatatgtcatacgcacttttattgccaaccaacaccacagctgcagaattattcaagtctttgaatgattacatatcagaaaaatggaattggtcattttgtgtcagtatacgcacagacagagaggcttccataactggatgtccttctggcttcacaacttgggtcagatggtcacttctgcatgtgactccacacattgtgtcacccatagagaaatgctggctagctgaaaaatgtcacctgaatttagcaacattttgcaggatatccttaaaattatcaaccacattaagtacatgcccttaacccacatctgatggtgcagctctgtgaggagatggacgcagggcacacacgtcatctcttatacacagaagtgattgctttgtgttattttattttatattttttattttattttattttattttattttattttattttatgaggctggagtgcaatggcacgatctcggctcctgcaacctccacccccggggttcaagcaattctcctgtctcagcctcctgagtagctgggattacaggcatgcgccaccaagcccggctaatttttgtacttttagtggagattgggtttcaccatgttggtcaggctggtctcgaactcctgacctcgtgatccacccacctcggcctcccaaagtgctgggattacaggcgtgagccactgtgcccggccagaagtgattgctttctaaaggtagattactggccagagtttttgagttacaagagccactccagagatttcttttagaaaaacagtcaccactggcaacacatttcagtgacacagaatggctcacaaaacttgcttacttatgtaacatattcaacctgctcaatgaagtcaatctgttgtcacttcaagggagaatgacaacggtgttcaagtcaacagataaaagtggctgcattcaaagccaaactagtattatgagggcaatgcataaacattgggatttctgacatgtttcaaacattagcagaaatcttgaaacagactgagccagggccttctttctcccagctggtacatggatcacctatctcagctttttaaagaatctgagcattaattcccaaccataaaaaaacccgaactgggaagaaatggatagcgacccacttgtaaattgccaggtgaatcaactttgtccacactagaagagaatcaactgcttgagactgcaaatgacagtggtcttaaaagtatgtttgagacaacttcaagtctccatacattttggattagagtcaaggcagaatatcctgagattgccacaaaagcactgaaaagcctgcttccatttccaacatcatatctttgtgaagcagggttttctgcaatgatagcgaccaaaatgagattacagagtagactggacataatcaacaaactttgggtgtcactgactcccaacactcccagatgagaccgtctagttgtggaaaacaagctccgggctcccactgattctacattatggtgagttgtacaattatttcattatatattaaaatgtaattataatagaaatgaggtatactataaatgttatgtgcttgaatcatcccaaaccacaccccctccccaggtctgtggagaaattgtcttcctcaaaaccagaccctggtgccaaaaaggttagggacttctgctatacactctgaagttatccttcaagagcgaaagagaaagacttccacagacaaaaattgaaggatttttgtggccagtatatctgctttgcaagaaatgttaaaagccttcagagagaagggaaatgacacaggtcagaaactcacatctagacaaagaaagcaagagcatcggaaaaggaataagtgaaggtaaaaatttttaaagctttattattcttaattgatctaacaagtgacattttaattacagcaacaatgtaatcatttatgtatgtttctgtgtatgtgtgcatgtatgtatacatatgcttatgaataagtgaaatgactgataacaatgatacaaggatgagaaggaagatggaggaattagaagtattttgctattatatggtacttatcataaggtacacttcattaccttcaggtggtgtagggttacttgacagcagacttggattagttataaatgtaaatgaaaactatagggcaaccactaaagaatgtaaaaagagaagtgtaataaagtagaaagagaaaaattgattaatataaaatgctcaattaaaatgactgggaaatggttggctcatgcctgtaatcccagtactttgagaggctgaggcaggaggatcacttaaggtcaggggttcgagaccagcctaggcaacatagtgagacccccatatctacaaaaaataaaaataaataaatacaaatgataaaagacaaagtgtggaacactacaaaaaaatctacagctaagcatcaaaatacatcaaacaaaaactgacagaactacaaagagaaacagattaatctactatcgcagttggagattttaacaactgtatcagaaatggacaaatctagcagcttgggaggccaaggcaggtggatggcttgagcccaggagtttgagaccaccctaggaaacatagtgagacccaatctgttaaaaaaaaaaaaaaaaatagagagagagaaaggaaaggaaaaagggaggaaagggaggaaagggagggagggagggaaggagggaaacagaaaagaaaagaaatggacagtttcaacaggcagaaaatcagtaagggtgtaatttatctcaacagccccatcaatcaattaactgtaactgacatctgtagactactcatccaaaaatggcatcacacattcatctcaagctcacctggaacattcaccaaagcggacaacattttgggccataagatacaccttaaaaagataaaaaatcatccaatgtctgctgtcagaccatagtggaattaaactagaaatcaaaaacagaaagacagctgggaaatcccaaaatacctggagattaaacaacacacttctacataatacataggttaaaaaggaaatctcaagagaaatttaaaaatgtcaactaaatgaaaaggaaaatacaacctatcaaaatttgtggtatccagtgaaagcagtacttagaaatttatagcattgaatgcatatattagataagaaaaaaaggatctaaaataaatcatctaagcctccacctaggaaatcagaaaaagtagagaatatcaactagaaaaagtaaatctgaaataaacaaaagaaactaaaagttcaatgtttgaaaattaattaaggtactccatcaccaacaggctaaaaaagacaaatcatgattatgtcaaatccacgaaatgcacttgacaaaatctaacacccattcatgattaaaaactcttggccaggcacggtggctcatgcctgtaatcccagcactttgggaggctgaggcgggtggatcacaaggtcaggagtttgagaccagcctggccaatagggtgaaaccccgtctctactaaaaatacaaaaattagccaggcatggtggcagccacctgtagtcctagctactcgggaggctgaggcaggagaatcacttgagcccaggaaacggaggtttcagtgagcccagatcgcatcactgcactccagcctgggggacagagtgagactctgtctcaaaaaaaacaaaaaacaaaacaaacaaaaaaacaactctcagcaaactagtaatagaggaagcttcttcaatttaataaagaacatatacaaaatacaagtatagctaacattatatttatagtggtgagaaacttgaagcttcgccaccaagatcaaaaagcatgcacgaatgtcccctctcactactgcttttcaacatcatactggaagtgctaactaatgcaataagacaaaaagagtacataaaaggtatactgattggaaaggaaggaagaaataaaaccatcattgttcacagataacatgatcatcttttataaaatgtcaaaaagaatccatacaaaaaaactcctggctaggtgcagtggctcatgactgttatcccagcaccttggaaggccaaggcaggaggatcacttgagcccagaagttgaagaccagcctaggcaacatagtgagaccttgcctctactaaagtatttttttttttaattagccaggcatggtgacacacacctgtactcccagccactcaggaggctgaggcagaaggattgcttgagcccaggagttggaggctgtagtgagctactgctgggagccaaaaatgccaaagggaccgtgaccaactcagcattccactggtggctatatgatcaaacagcaaactatttatcatgaacgcaggacgtgggcaaactcacactgcacctgctgctaaaaggtttcctgaggaccatcactccctggcgctgggctccttgaagttatctactgggaaatctagcacctattgttcgaaggatgcagtctcacaagcctgctgtgaaccaaacaggctgactgataattactcaacaatcaccctctctttctcgttatctcttttacctaatacattcagagggctgaaaaagctcaaggaccctgtccactagaggcaaggtgcccccgaccccttcttccaattatactcttttgtctttgtcttttattcccacgttcaccccctttgttcagtctcccaaggtccatgcaggctacaagtactgccccaaacagcaacaaaatcgggtgctcaacaagctacaattgcacatatgattgtgcaactgcatgccagcctaagcaacagagcaataccctgtctcaaacaaacaaacatcttgaagggacatctgttctacttcttcttgtttggataaacagcttgtgagaggcttctcaggaggcaagtctaatctcataggggcatgacactggaagtctttttctgcctcattctccacatggtcttgatctcgcttatttttgtcctcttcaattctgctttctccccttttcttcccccagaactggcttctctcctttctttctctttttccactttctgtccttgtgtttgtcatgattgtttttgtctttgaagaggctggagcagtgctccaaactgcccgtggagagctcagtaactgctttccctcctactttgaggaccagcttcaagggcttttccacatactctttgtagaggtgcttctctgacttgtgctccttgcccatgtctgaccaggccctggtgcccacctcccatgccaggcccaggccttggggtgccacttctggtccaggccaggcgaggtggaggacaggagcagggcctaccaaaccccgcacgccaatgcagggggttagcatgtgtgccaggtggcacaaggcccctcttgagaagacagcccatgagacctagctggggcctgagaacatgaatcaactgatgagacagctgcagagaaaagatccaagtgctcttttcgttttctgtgattttattgctcctggctactccatcatcattaaacacccaatggatctcagcaacatgaaagaagagatcaagaacagtgaagaactaacggataacttcaaaccaatatgtactaatgccatgatttacaacaaaccagagaccacttattataaagctgcaaagaagctgttacactcagagatgaaaatttttagccaggaaaaaattcagagcctgaagcagaccacagacttcatggctaacttgaaaaaacttgaaagcagaaagacagaacagacatctcacagagtggggaggatggaggctgctggctgagagagagagagagagagagaggactctggagatgccgaagcacaagccttcaagagtcccagcaaagaaaataaaaagaaagacaaagatatgcttttaagtttaaaagcagtaatttagagagacagtaggagcagcttgactgcatcatgaaggaatctggaggaaaactgaccaggtggcttgttaacagtcagtgggaatttgaaagaagaaaaccagatggaacaagaagactgggacttccccatcctgtggatcccattgtaggagagccagaatactgccctatgagactgggaatgacaactggaagacttcagtctggagtgaatattctgcaggggttcaaagaggataaaaggaacaaagtaactccagggttatatttgaattatggaccctggagttcttatgtaccgcattatgactccacatttatgaatatcagcaaggataattcagatttaatctatgcaatctatgggggaagactgatcttccaagcaatttcagcaaccatgagtttctggccccatgccaagattacccatatgttaagacagatagtttgctggatgttttaacaaaaggaggggattccagggccctataagagttggagatatcacctgacgatgaaggccatactaggacacttgacacagcaaaacaaatggagattacacaagtagagccagcaggacatttggactctaatactcaagataggctcatggcactgaaagcagtaacaaactttggcgctccggttgaagtttttgactcttgaagaagctgaagtattccagaagaaacctgatgagaccaacaaattgctcagggagctccagctcaatgagcatttgaacacctgaccccttcccaatatgatgtctcttggatccctcatacaaagaaatgcatcttgctgaacaggtgaccaataatcttaaagaacttgtacaacaagtaactccaggtgatatcgtaagcatgtatggagttcaaaaagcaatggggatttccattccttcccctgtcatggaaaacaactttgtagatttaacagaagatcttgaagaacctaaaaagacacggagtggacctagtgggagttgaggccacctggtatttgattatgtattatgtacatacttttccattcttaacttaaaaacgctttcacaagatatcaaatatttgtaaattgtgcttttaattaaacttcggaacagtgaaaacaaacaaaaaacaccttcctggaactaattatagcaaggttacaggatacaaggttaacacacaaaagtcaatcatttttcagtatgtcaacaatgaacaagtggaatataaaaattaaaaaattcactaccatctatataagcaatcaaaaaataagataggtataaatctaacaacatatgttcaagatctatatgaagacaactataaaactcttctaaaaatgttctaagaagaactaaataaatgaatagatattccatgttcatggataggaagactcaatattgtgaacatgttggttctttccaatttgatctatagattcaacacaatcccaaccaaaatcctagcttattacttagtagattcaatgaactgattctaagtttatatgaagaggcaaaagacccagaatatccatcacaatactaaaggaaaagaacaaagttggagtactgacactacccaacttcaagacttataataaggctacagtaatcaaaacaatgtggtattagtgataaaatataaaattaatcaatacaacaaaatagagagtccagaaataggacacataaatatagtcaactgatctttaacaaaggagcaaatgcaatacaggggaaaaaacagccctttcaacaaatggtgctgaacaattggacatccacatgcaaagaaaaaaaaaagaaactagacacagaccttatattttttacaaaaattaattcaaaatggatcacagacctaaaacacaaaactataaaactccaaaaaaaaaaaaaaaggtagaaaatctagatgaacttggctatggcaatgactttttagatataacatcaatgctgaatccatgaaaggatgaactgataagctggacttcattaaaattaaaaactttttccctccaaaaaacaatggcaggagaatgagaaaacaagccacagaccaggagaaatatttgtaaaagatgcatctgatctaaaaacaaacaaacaaaaaaaacctgttatccaaaatgtacaaataataggccgggcgcggtagctcacacttctaatcacagcactttgggtggccgaggcaggcggatcacttgaggccagtagttcgagattggcctggccaacctaatgaaaccctgtctctcactaaaaatacaaaaattagctgggtgtggtggtttatgcctgtagtcccagctacttaggaggctgaggcaggaaaatcgcttgaacccagtatgcggaggttgcagtgagccgaaaccgcatcactgcactccagcctcggcaacagagggagactctgtctcaaaaaaagaaaaaaaaaaatcatacctacataatgaagcttacatttaaaaaaaaataataatactaggtctacagaacttctagacagctgaatatgtggaagttccctcctgaagggtggcacccctggagatggcatgggatctccacattccttatctcataccttcccctatgcatctcttcaatctggctgttcatctgtatcttttctaatatcctttataacaaatgggttaagtgtaagtaaaaagcttctgagtttcagcaagttaatcaaacccagggagggagttatgtgaactctgatttatagccagttggtaagaagcatttgggacttgaaattggcatctgaagtggagggcagtcttgtggtagtgagtcctcagtctgtgggttctgacgctatctctacacatacagtgtcaggattaaattagaagacagacacccagatggtgtctgctgaagaatatgcagaactgactgcctggtgtgtagggaaacaaataccatacatgtggtgcagaagtactgtgctgagtggagagtagagtgggaaaaatgcatctttggtttttcctatatcactacagcggctttactcataattgccaaaacttggaaattatcaagatgcccttcagtaggtgaaggctgtgcatgtgtggggatatggaggatatgggaaatcttggtacttcccatttaattttgtagtcagcctaaaactgctctaaaaaataaaattcataaattttcaaaaagttatcacaggtggggccaggcgcggtggctcacacctgtaatcccagcactttggcgggactaaggcaggcagatcatgaagtcaggagttcaagaccagcctggccaacatgttgaaaccccgtctctaataaaaatacaaaaattagctgtgtgtggtgacacgcgcctgtaatcccagctactcaggaggctgaggcaggagaattgcttgaacccaggaggcggaggttgcagtgagccaagatcacgtcactgtactcaaaaaaaaaaaaaaaaaaaaaaaaaaaaagttaacacagatgcttctactataatacaaatatatgcattcctggaaaaccactggaaaatcatgcactaaactgtgatatacccagaaagcggaacattattcagtaataaagaaaaatgaactatcaagccatgaaaagatatagaggaaacttaaatgcatactactaagtgaaagaagccagtttaaaaagaaatggtttgaatagtatgtactatatgattccaattacataacattctgggaaaggcaaaactatagagaccataacaagttcagtggttgctaggggtccaatgggttgaacaggcagagcacagaaaatttctagggcagtgaaactactctgcatgatacgataatggtggatacatgtcattactaatttgtcaaaacccttagattgcacaacaccaggagtgatcctaatataaactattggtttttgagtgttaatggtgtgtcaatataggttcactaattataaataatgtaccctaaggtacaaaacattgatagtgggggaggttgagcacgtgtgaagatatggaggatatgggagatcttggtacttcccattcaattttgtagtaaatgtaaaactgctctaaaaagtaaagttaataaatttttaaaaagttaacacaggtgcttctactataatgcaatatagacattcctggaaaatcatgcactaaaaataatagggcgtatggaacgaataggattaaaaacactcaattcaaactgatgcaattttaactagtgcactaacaaaaacagtgactcaggagataacttggacagtctgaacaggtggtcacagtgatattttaaaaccacatacacacacagtcaaaatgctggcggtactttaattagaggtctggtgagtgttcagatgatataggtggactctgtgatatagggcttgccgtgcaggtggagtaggagggagcataacctggcgtgaactgaaagtctataaagaaggaagtgcacttctcaaggaagagcacccaaagggcaggtactcttttacaattttcttatgtaagttggaaaaagcttctgctaatgtagtaggtaaccctaagccttttgctttgctggccaaatattttaattttattcaccatattctaactccccttgcctggggagttggtgggggaaagcacttatgaaccaatctagaaaactaagcagacatcattctcctatttaccaattgtgtatgagcaaatttgcaccatagaaatgtgttttgtagcaagacaagctgtagttgaaactctatgtgaacttaatcatatagaaaaacaaaaatctgaggtcagatgttttaatttctacatttagtaacatcttttcaacctttatctgccttctctgacttttatacaacggttccctttctatggaaaaacacttgcttgctttcctttctagaacaactccctcaggctccttcacaagttgtgctcttctgctaccttctaaaatgctgctgtttcctgtttctagttctggatcccattttcctctcattgcacaaatcctcccttggaatacctgatcatgcccaaggctttaataaccacccacctagactgacaacacctaaatctcttatctctggctcagacctgcacccacaaatattaccctcattcttcactcaaccccaaatttacaatgtgtaagtttaactcactatttttctcctctaaacagatccttaacatagtaatctctataaaccaatcaattgttgctgtatgaaattaggcaatcattctctcaccacattaaatatgtcattaaatctggcccattttaccatggcttggtcatacagatgtttaatcaacagtcttcttctcattctgaccactacagataaaattcaaatgttcacataacttttggactattgagacagcttcctgactggtttccctgcctccaataacatctaccttaaatccaatctctattatgccatcagagtaaccaaactaggatactttggaggtgaaagatggcactattaataaatttataagcacagcaggcataaactgggccagccctaagcaaacctttacacctcaggtcattgatatcactcggcccttgcttacctcttcaaccacatatctaccactacctttctctcacattacatttcatccacacagaataatttgtagttttccaaatgcattatatttctcatcattcctttaagcttctccatatgccatacactatgcctcaaaacactattccttcacccccttcacctggctcaattcatttagttcatcaggttctcaaactagattatcacttcctacaggaagcctggccaggcttttggaagattagcttctatgttcatagctggggttcccacagcacttcatacataaaccctgtgcgaatcaacacactgcaactatctcttgtctgtgttctccattagactacacattccttgagggcaaaaccagcttcattcacatttctattgctacagcataaatggaaccttatccatagttaagataaacaatttttaaggaaatggataaatatattttttggtatactctctctgtagggtttaagttccataaaggcagaaaccattctttgcttttgtgttcccagaatttaacacattagatgtttaatgttttgttgaggaggctcatttgcaaaggtgggattcattttattaaatgttcattagtacagacttggtggtggaaacaaaccaattgaagaaaaaatagaaaaaaatgatataaatggaaagaaaaagaataaaatggaaagaaaagaaatgatgcaacaatgaaacttaataatagtaactattatttggttgatctttccaaggtacacatatatacagaaagaagagacctctttcttctccaatttaagtaaagaaaaagggtccttcatatttggtttattccacaaagtcctgttaaccacagatggaaatttaggtataaatggaaatacaaactattccttggctctaccaatctaccattagaactatccagaaagtttggattttagaataaagacatggttctcattctctacctatgagactgagtgatatctacttctaaggtcatcttaattgtaaggttagtcaaatttttaataagaaaatagaagttacttattaagagtatgttttccatctataaattcatttaaaaatgttacttttattttactgacttatttactctagaatacacattaatttcaataattattattaaaagcataattttctttgtctagtgtctatagaattaggatgaatatgttatggatcagaaaaatgtacctatacaaaatgctatgcataaaaaattacatcattcaaagatccaaagttaaaaaaatccttcgctaaagaaatattttattactctatctgctgtttcttctaaccctcaccattttattggctctctgtatctatccattgatagaagtttatcttatatatttatcatacccatttagtattaagattttccttgtattctcttttacaaattgctctcatcttttaaaatcagatttctcaataatatttcaattcctcacatacttcaaaatcctactaatatttttaacaaccccttttacatatccttccaaatactaatatttttatttgtccttgcacgctggcttggagagccctctactggcctgatgctgtgtcaaaagaacatttgcttcatccttcagatacctattttttacatgctttcgataatatgataattatataattaaagcctttattccgaatgacagaatgttaaagagaaattgaacaattctactaaaatgctgttaccaaagcaagatacactacttccatagtatagaaataccattttcaaataactgtacattattctcagtactcattataaagccttgctatcatgtgacagaagtccaagatgagaccaaattataacatgatgtattcataactaaagtataaaaggcaagttggagtctctatgttaaatgcctctggcctcaagaaaatctgatagttattttctcatcaatatttcctgattttaatataccaatgtctctagtatttataaatatcacatttgaagatatgatgaaggaaacaattccacttaacttaaaatctaggaataaaggccgtaatgaagagaacaacaataacaacatccacaaatagaagtatataccaccacaaagttatcaggcctcactttagatcccaataagtacgccaacagtctttttctttgggaaataaaccaatataaagtttatataaaaataaacatgcaaacaagttttaaaggaagctctttttaaaactgagtaataattaaggaaagtagccattccagtcatataaattttgttaacgggcctcatagactctatatctgtgttccaattagactatactctccttatgggcaaaattaacctcatttacatttctattcatatggcgtagacactgtcttacctacagtgaatacaaataaatttagaaggaatagacaaacttgttttcctatatggtctctccctctgtaagttttgagatccatgaaagcaggaactatttttcacttttgtgacatcagaatttaacacagtggatgttatgtcactgtttggttaaataggctcatttgtaaaggtgagattcatttataaaatactcattagaatcagacctcattgtagaaaaaattacatagaggaaaaggaaataataatataaacaaaatattgagacaaaattggaaaatttattttcaaattaaattatagacaaaaagctaatttcctttatatatacagggctccaaaaaacaataagcaaaaacctacaacctaacataaaaaatgatcaaaggatatgaaaagaaatgtgaatgggcccttaaatttataaaaagaaatataacatcactcttaagagaaatacatattaaaaccatatgaccataaggagataaatctcccctttcttttatatagacctactagaagggcaaaaatccaagtttaataacacactctgttagcatggctgggagttggggagtgggacggtgagagttcttatacactgctctcctaaagagcaatttgacagtatcagtaaaaatcacaaactcaatacctagaaatttcacttctggaaatgtaacttacaagaatatctgcatatgagcaaaacagtatttataaaaggttattctttacagcatcatttacaataaccctaaactgaaaacaactcaaattttgatgagtagggggcaggtagaataaattatgctatctccataaaacagaagatcgtgtaactgcaaaagcaagggaaaggggtgttatctaggtaatgatagagaaataatcactgtgtgttatataattgtatataacatttaaaaaaaagcaaggtgccagataatgtacatattcttatatttttttaaatgcagaagaaggataaaacacacttatatctgcttgtgatatgcatcaactctggaagggatacaccagaaactgacaacagtagttcctgtatgtgtgtggagaggggtgtgcaatctggacagatggaaggctgtagttggacactctttgccacacatataaataaatataaatcatgtgaatacattattaagttgatttaaaatgtccttatattacaaggtaagtatattattaacacaagctttactactaaaacagctacaaaatcctctgtaatcttacctgcaaactagccacataagaatcctcacaatttacataatgtcctaacatggcatgttgagcccgtaattcattatcccttatcctctcatgcaggtgggtaatttgttgcttctgcctgcaaaacataaattaaggtcacattatgagttataattttctaatagttagaagaaccttaaggagcttattcctcttagattcctttaatattcctcttagattctaacagtcacaccttgctttcttcaacaactcatagcttgctttaagcaagttatttaatttctgtaaatatgtatgcttagaaattttaaaactgttttgtgccaggcatgatgctaagagctttgtatgcagtatctctcatcttcaaaaatttattaactctcatgatgaagttttgaaggagagagcttttaaagaataataaagatagtatgagtaaacaaatagcttgatgttttccaaaattacttacaaagtaacttttggaacaagtaagttgtatgtttcaggttgcatcaaaagaccttgttctactcaggatgatttctaaaatttgctaacctttaagaaaatccacatataaaacattaaataggagataagtcaggagagattcgtcatataacacttttcaaataatttaaagctttacaagaaagaaaaaaaaaaaaacccttccttttccagccaaggtgcagtagcaggcagggactagttttgccctcatgcctgaaacaattttttaaaaaagacaaaatataggaagtgaagactctcaaggcattgggccaccaggcaattaagaacagtaatctcttagagataggtaactaatgaggtgggccctatgactgactgcacttcctgctgagagagttttcaagccccagcacaggaatggtggtctccctgaattgaagacacaaagctgagaatctggagaaaccaaggcagctgtagttagttcacagtactcgataacccttgggcactcggttgaatactaattaatacaggcatgaggaagctaccgacggtgtgtgtagagtggaagggcaaccaaaaaaaatattacagggaacagtgcttcagggtgccttggaattactggctattcccaactgccagaataaaaagcttcatgattcccagggcatcagcaattctcaactggggacagttttgaaaccagttaacatttagcaacatccagagacattttcaattttcacaactggggcagaatgttactggcatctagtgagcagaagccagagatgctactaaatgtctacaatgaacaggatagccaccctcaatagtgaattatctgatccaaaaaaaatcaacagtgctgaggctgagaaacccagggtttgtaagatgagtcttgtctcagtggggaaaaaataacccttgataaaacagctctaatgccacctaacaaaacttaaaagcaagtacaaaaactgcttcctagaataaagttcaggaatacaaaaatgtaatatcaaaaacaagttaaaattcataatgcctggcatcaaaaaattattgggagtacaaaaaaagcagaaaaaatgtaactcataataataagaaaatccaatcaactgaaagtgagctagaactgacagagatgttaaaatagacaaggatagtaaatcagttattataactattcatatgcttaagttagaagaatgaacgaacatgttaagaggagacatacatgacaaacaacacactgaatggtgattaaaacattagacattacagcacaaaagtacagtaaatttaaaaacagcaatagaaactatctaaaaagaaacactagagaaaaaaggacaaagaaataaaacaaaaaagctcatagtatcagtgagccgcgagattataagaggccaaatacatgtacaattggaatctctaaagaggaggtaagaaggtggcagggggtgggagtaggggacagaaaaaaaatatttgtgtataacaggccaaaattttaccaaatctgatgagaactatacacccataggttcaggaagcccagtgaaccccaaataaaagtaacatgaagaaatctaagacaaggtacatctaaatcaaatagattacagtgataaaatcttaatagcaaccagagggaaaaaagataaatccattcaaggagacaaagatgaagaggatggcaaatttctcaactgaaataatgcaatcaataagacaatgaagtactttaagtactaaaatttaaaagctctcaacctaaaatttttgacatgagaaaaaatttgaaaacaacacaaaaagcatacaaaaaaaacctgttaacctataatacttcacccacagaaaatatttttttaaaggttaaataaagatcttttttggaaacttaaaagctgaaagaattgatcaccccagacttcaactacaaaaaaaatgataaaggaacaccttgaggtaaaagaacaatataccagatgaaaacctgaatttacacaaaagaaagaagaataccagaaatgataaacacatgggcaaataaatacataagatatttttcttattatttaaatctcattaaaagatcataaattgtttgaggcaaaaaaaaatttatatccacgttgtataacctttgtagatgtagaatgtatgacaaaacagctcaaaggctagaagagaaaaaaatggaactatgctttataagattcttacattatacataaaatagtatagtattacttgaagatagactgctatactttaaaatatattataaactctaaagcaatcattataacaatagaggtatagctaacatgccaataaagagataacaggaattgtaaaaaaatattcaactaattcaagagaaggcaaaggggaacaaagatcagatgggacaataagaaaacaaatagcaatgccaggcacagtggctcacatctgtaatcctagcactttgggaggctgaggcaggtggatcacttgaggtccggagttcaagaccagcctggccagcatggtgaaaccccatctccactaaaaatacaaaaattagctggtcatggtgatgcatgcctgtagtcccagctacctgggaggctgaggcaggagaatggcttgaacctgggaggcagaggttgcagtgagctgagatcgtgccattgcacttcagcctgggagacagagcaagacactgtctcaaaaaaaaaaaaaaaaaaagaaaacaaataccaatataggagatttaaacttgaccatatcaataatcacaacatgtaaatggtttagatactcccaaacaaaaggcagacattggcagaatggataaaaagtaggacctaactatatactatctacaagaaagaaaaccattctgaacataaggacacaaacaggttaaaagtaaaaagaggaaaacctgtgctaaaaataatcaaaagagagccagagtaactatattaatattagtagaagcagattttttttttttctattttagagacagggtgtcactctgtcactcaggctggaaggcagcggtgtgattagagctcactacagccttgaactcttgggctcaagccatcttcctgtctcagccttccaaatagctgggactatatataggatccactgtgcccggctaagtttttttttttttaattttgtgaaggtgaaatctcactatgttgcccaggctggtctcaaactcctggcttcaagtgatcttcccgcctcaacttcttggtgttggaattacagatgtgcgccaacttgccaggccaaaacagattgttagagcagagaatattgccagggacaaaaattataacttaataataataaaaagatcaattcattaagacgtcatgacatttgggcctaagagcacagtgtctaaatacatgaagcaaaaaaactgataaaacagaaaagaaacagatacatccacaattgtaattggatattttgacacctggatctcaataattgacattaatagaacaagtagacagaaaatcaagagaatataaaagacaaaaacactatcaactgatttgtactaaaaggaatttctagaatactccccacaaaagacaaaagcagcagaatacacaccctcttcaaggatacatgaaacacttattaaaacagatgatcttctgagccatgaaacaagcaccaacaaacttaaaagaattcaattcatatagaatatattcttggaccacagtgaaattaaatcagaaaacaattacagacagaattctagaaaatcctgaagtatttggaaacaatgtaacataattgtaaataactttagggtcaaagaagaaatcagaagataaactaagtattttgaggtgaacaaaaatgaaaaccaaacaaattaaaatttgtaagatattgataaagaagaacttagaaatttattttttattttattatactttaagctctggggtacatgtgcagaacgtgcaggtttgctacataggtatacacctgtcatggtggtttgctgcacccacatcatctacattaggtatttctccgaatgctatccctccccaagacccccacccccagataggccctggtgtgtgatattcctctccctgtgtcagtgtgttctcattgttcaactcccacttatgagtgagaacatgtggtgtctggttttctgttcctgtgttagtttgctgagaatgatggtttccagcttcatccatgtccctgcaaatgacatgaactcatccgtttttatggctgggcatagtattccatggtgtatatgtgccacattttcttcacccagttgtatcattgatgggtatttgggttggttccaaatctttgctattgtgaatagtgctgcgataaacatacatgtgcatctgtctttataggagaatgatttataatcctttgggtatatacccagtaatgggattgctgggtcaaatggtatgtctggttctagatccttgaggaattgccacactgtcttccacaatggttgaactaatttacactcccaccaacagtgtaaaagtgtttctatctctccacatcctctccagcatctgttgtttcctgactttttaaggatcaccattctaactggtgtgagatggtatctcattgtggttttgatttgcatttctctaatgatcagtgatgatgagctttttttcacgtttgttggccatataaatgtcttcatttgagaagtgcctgttcatatccttcacccactttttgatgtggttgtttttttcttataaatttgtttaagttattgtagattctggatatcagccctttgtcagatggatacattgcaaaaatgttctcccattctgtaggttgcctgttcactctgatgatagtttcttttgctgtgcagaagctctttagtttaattagatcccacttgtcaattttggcttctgttgccactgcttttggtgttttagacatgaagcctttgcccatgcctatgtcctgaatggtactgcctaggttttcttctagggtttttatggttttaggtcttacgcttaagtttttaatccatctttagttaatttttgtttaaggtgtaaggaaggggttcagtttcagttttctgcatatggctagccagttttcccaacaccattcattaaatagggaatcctttccccattgcttgttttcatcaggtttgtcaaagatcagatggttgcaggtgtatgatgttatttctgaggcctctgttctgttccattcgtctatctgtcttcgtacaagtaccattctgttttggttactgcagcgttttagtatagtttgaagtcaagtagcgtgatgcctccagctttgttctttttgcttaggattgtcttggctatctagactcttttttggttccatatgaaatttaaagtagttttttctaattctgtgaagaaagtcaatggcagcttgatggggatagtattgaatctataaattactttgggaagcataaccattttcacaatattgattatccctatccatgagcatggaatgtttttccatttatttgtgtcctttcttattgccttgagcagtggtttgtagtgctccttgaagaggtccttcatatcccttttaagttctattcctagatattttattctctttgtagcaattgtgaatgagttcactcatgatttgcctctctgtttgtctgttattggtgtataggattgtgatttttgcacattgattttgtatcctgagactttgctaaagttgcttatcggctcaaggagattttgggctgagacgacgcaggtttctaaatatacaatcatgtcatctgcaaacagagacaatttgacttcctctcttcctatctgaatacttttatttctttctcttgcctgatggccctggccagaacttccaatgctatgttgaagaggagtgtgagagagggcatccttgtcttgtgccagttttcaaagggaatgcctccagattttgcccattcattatgatattggcggtgggtttgtcataaatagctcttattactttgagatacactgcatcaatacctagtttattgagtttttagcatgaaggggtgtcgaattttatcgaaggccttttctgcatctattaagataatcgtgttgtttttgtcattggttttatgtgatggattacatttattgatatgcgtatgttgaaccagccttgcatcccagggatgacgccgacttgtttgtggtaggtaagctttttgatgtgctgctggattcggttttccagtattttattgaggatttttgcatcgatgttcatcagcaatattggcctgaaattttctttttttgttgtgtctctgccaggttttgtcatcaggatcatgctggcctcataaaatgagttagggaggattccctctttttctactgtttgaaatagtttcagaaggaatgataccagctcctctttgtacctctgttagaatttggctgtgaatctgtctggtcttggactttttttggctggtgggctattaattactgcctcaatttcagaacttgttattgatccattcagggatttgacttcttcctggtttagacctgggagagtgtacgtgtccaggaatttatccatttcttctagattttctagtttatttgcgtaaaggtgtttataatattctctgatagtagtttgtaattctgtgggatcagtggtgatatcccctttatcattttttatcacatctatttgattcttctctcttttcttctttattagtctggatagcagtctatctattttgttgatcttttcaaaaaaccacctcctggattcattaatattttgaagagttttccaggtctctatctccttcagttctgctctgatcttaataatttcttgtcttctgctagcttttgaatttgttcgctcttgcctctctagttcttttagttgcgatgttagagtgtcaattttagatctttcctgctttctcttgtgggcatttagtgccagaaatttccctctaaacactgctttaaatgtgtctcagagattccggtacattgtgtctttgttctcattggtttcaaagaacatctttatttctgccttaatttcattatttacccagtagtcattcaggagcaggttgttcagtttccatgcagtcgtgtggttttgagtgagtttcttaatcctgagttctaatttgattgcactgtggtccgagagactaaatgcctataccagaaaaaaagaaagctctcaaattatctcagcctccactttaagaagttagggggaaaaaaagggccaggtgtggtggctcatgcctgtaatcccagcactttgggaggccgaggcgggcagatcacgaggtcagaagttcgagaccagcctggtcaacatggtgaaaccctgtctctactaaaaatacagaaattagctgggtgtggtcgcgggctactggggaagctgaggcagaagaactgcatgaacccgggaggcggaggttgcagtgagccaagatcgcgccaccgcactccagtctgggtgacagagcaaaactctgtgtgtgtgtgtgtgtgtgtgtgtgtgtgtgtgtgtgtgtggcgggggggggttgtgaaactccgtgtgcgtgtgtgtggcgggggggttgtgaaactccgtgtacgtgtgtgtgtgtgtgtgtgtgtgtgtgtgtgtgtgtgtgtgtggcggggggggggtgtgaaactccgtctcaaaaaaacaagttagaaaaagaagaacaaatgaaacccaaagtaataaatagccctatgtatattacagaaattgggtttttcgttgacctttcaatacagaaagatcaggagggtcaggagtcttcactgaagaattctgctgaaagtttaggaaataaaaaatactagttgtacacaaggtaccccaaaaaccagtgaataattcccaactctatgaggccagcatgaccaatatctaaaccagataaatacattacaagaaaagaaaaatacagaccaatatctcttataaatataaatgtaaaaattcttaacaaatggaatccaaagatagataaaaaggaaaatacatcataaccaagcgggtatatcccaggaataacatggtaggttttacatctgaaaattcatcagctacctagaatagaagtagtttccacaatctaaaaaaggcaactacgaaaaacagctaacatcacacttaatggtgaaaggctgaagactttcacctaaaacaaactagggacaagagaaggaaaaggatgtttactctcactgcttctattcatcactgtattggaggctctatttacttcagtagaaggcaagaaaaggaaataaaaagactctatactgaaaaagtaaatccacctttaatcacagacaacatgatcgtttatgtaaacaatcctattgaatctacaaaaaaatacctacttaaactaataagtgagattagattgcaggatacaaaaccaattttatttctatatatttaagaacgttttgaaaatatgcattttttaatcgacataattgtcatatttgtggggtataatgtgatatttagatacatgtatataatgtatagtgattaaattagagcaattagcatatccatcatctcaacctttatcatttctttgtgctgttaacattcaaattactctcttctagctatttgaaaaaaatataattattgtttattatagttaccctatagtgcaacagaacactagaacttctatctagctgcaactttctattccttaaccaacctctctgtattcgctacttcccccagccttcccgcctccagtaaccactatcccaaactccacttttacgagctaaactttcaaaaaacttcatttttgcttaagtggtgagactccttcacccagtcagttaaggagatcgaaatgcaaaaggtcaagcactactcaatcacctaaatggttatagtggcaaatgtttttctgaattgttcctgaagttaatctatacactttttctcatgagatggggagcatttaggaacagtttctatagcagttatttttcccattttctctgctttaacctaataatccagtctcctcctatgaaagttatacgcagtgtgaaaaaaaacacattttttctcatgtaattttggataatatattttcagaagtaatatacaacatataatttttacttaagtgatttgaaaggtatcgctgaccacaccatatcccaaactaaaaagttcggcaggtttactttcaattccatccaattggacaccaaatcccatgaagtctggctctgaaatagcctctacatgtgccatcaacattttaaaggccattactctcatctgcttcttcaaaaacagaaatgttatatatttgattccaatttaagtactatatatgttatagaaatttgtatatacaaacatttttacttttaaatgacagttatgctgctttagaaacaaaagctgcttagtttctcttctgttttatacaatatcaaatgcactgattatcaaaaactttataataaactcataaagaaaccaaagattatttaagatactgggtaggttatttactaaaatgcctccattattacccttcctatattactaatgcctcctgtcaacgtgattttgctgtttccactggccagaagtgaagtccactactggtctagtgactaacagaatataatggaagtgatgttgagccagttctgagtctaagcttcaagagacttcgtatgcttcattctttcttagaatcccacccagccaccactcgaacaaacccaggctagcctcctgcaggatgacagaacatgtggagtaagacaagccatcctgccgtggcccatcctatgccacccagcccccacctgctaccacagacgcataaataagcctagctaaagaattagccaaatgagcaacttgagttattttgaattattccttagtctgattctacaatatataaaattgagaaatatatattttattatattatgtcaataattttctgcattttctattaacttatatccaatggaatggtattcaaaaaaaaataacatcaactgatttccattgtttgagggagggcaaatccatgtaagtaaaactgaactttagtccattttttaaaagtattaatttcaggccgggcatggtggctcacacctgtaatcccagcacttggggaggcagagactggtggatcacctgaggtcgggagttcgagaccagcctgaccaacatagagaaaccccgtctctactaaaaatacaaaattagccgggcgtgacggcgcatggctgtaatcccagctacttgggaggctgaggcaggagaatcacttgaacccagaaggtggaggttgtggtgagccgagatcatgccattgcactccagcctgggcaacaagagcgaatattaatttcaattatataaaattgcacctatattaaattataggtattaaaaatacacatccaactgggcctgtacttattcgtatataacattcacttgtaccagaaacaactaatatttttaagtagctttttcctaaaatcaattaaaactatcttccacaatccttcatttatcaagtatggaagtatcaagttttaaggcatatactaataccaggctcttttcaaaatgttgggaataggctgggcatggtgactcatgtttgtaatcctagcactttgagagaccgaggcaggtggatcacttgaggccaggagttcaagacaatactggccaacacggcaaaaccctgtccctactaaaaaatacaaactttagccaggtatggtggtgcacagctgtaatcccagctactcaggaggctgacgcacaagaatcacttgagcctgggaggtgaaggttacagtgagctgagatggcaccactgcactccagcctgggcgacagactgagactcccaaaaaaaaaaaaaaattgggggaatatagtggagaacaagaaaatgcagatatctgtggtctagtttatattccagtagatcttcattaacaatgctaaatttctaagcaaaatcttgtgaaatttcaactattaaatgcgtttaaaggttgaaattagaattttaaggctaaaacacctactgcgttatcctatgcaagcatatgaaaataagtaattacgagcactggttaagaaaaaaagcctcctggaattgcttcccaattatcatgatatacaacatatttaattatcccaaaagcatacataaatgatgtagaatatacgttaaagaaaatataatgatgtaacatgaaggtttactgctcacaatactcaggagactgtctattaagtataaataattttttttcagagcttaggtactcaaacccttaaacattttagaacgtcccccaaaactgccataattcttaactataagtcatttcattttacacattcgtcatttttgtagtttctgtggcttcagacctagcatacattaaaggaaatgactgctttaaattagctttccaactggatagttctcaagggttaaaacacgaagacattatcttgtagctctaatagctgattagcattgcagctaacccgctacacgtacagaaaagacagaatggagcttccaaataatgaaataattcactaaaatgaataggagggatgacagaaatcagacagataaaccatcagttctaacagtacttctttaaaggattgggattgaggaggggcagagatgtgacatcaatgaatctgtaaggttctagatcttaaattctatgtagtggacataaagttaattgtttcattaatctaaatttctgtaggcctgaaatatttaataatttaaaatagactcaccgatcgattacaatttctttctgccttagaagtccttcttttattttcaacattgattcccacttactgaaatcctgatagccaggtgaataactttgacgagatgatccagtcaaaacctgcagaaacatgtttacacaattagtatactaaaatatttaaagaaaatatttatatattatcatattttcccaaagatttatattaaaaaaaaagaactccctctttgattttttaatactttcggaaatcacactatgaatacaacataacttggacaatttcaaggaagttctaaaggaaatgtatacatctaatgaagaattaatgacaacagaacgtttatcctggcaaattataaaactatataagatcttggccaggcgcggtggctcacgcctgtaatcccagcactttgggaggccgaggtcaggagatcaccaccatcctggctaatacggtgaaaccccatctctactaaaaatacaaaaaattagccaggcgtggtggcaggcgcctgtagtcccagctactcgggaggctgaggcagaagaatggcgtgaacccgggaggcggagcttgcagtgagccgagatcacgccactgcactctagcctgggtgacagagcaagactctgtctaaacaaacaaacaaacaaacaaaaccatataagatcttattcccattaccttgtggaagtggaagtggaagttttctggaaatgagattaatcattaagggagtaatacaatgtaggaatgtgccatggcttaactagacaaacattagcaggagattttccacaagaaaataaaagcagtatctgtagtattcagacttcaagttgacatgcatcacatcatcatttagttacattagaatttcaaaatcacaaatattttcactcagtagtgagacaaccaaatgcctaggcagataaaaaggggtccttggagaatctctgacccactccacaagtgtgcagatgcttctgtgcagatgaggaaacctgcccagggctcatgtgggcatgcccatagctgactggagcccagcatgcgttctgggggaaatgggtggagccatggggaattcctgccttatgcgggggaggagcctgctctcttcagctcacctggtgacctggaaatcaatctgtgaggtggaggacctgttagcagggctctatcttgctttgatgattgtttgtttgtctgtttcttttttccttttcacccaataaattcctttccaatcacccttcaaggtgtctgcatgcctaatcctccctggtcgtgtgacaagaacccaatttttttctacaacagtagtaagtatatccatagaaaatggaaaatatataaccatctactaagtagataatttggatgaaatatatcacttagaaaaaattgcttagaatgtaagaaaggtttcagatatttaaataaaccaacggtagaaactaacatggcagatatccttatatttcttccgttgaaaaagcagcaaacatttaaaaatattggtgttataggtttgactgtattccttaaaaagataagttgaagtcctaacctcttgtaacttcagaaagtgatcttatttggaaatagggtctttgcagatgagtcaagctaagatgagctccttaaggtaaggcctaattcaatgtttggtgtccctaaagaaaggggaaattttggacctacgtacacaaggaagactatgtgaagagacacagagacaatgccatgtgaatatcaaagtagagattggaatgacacatctacaagacaaggaaagccaaagaccaaaagctaggagagaggcatgggacaaattctgcttcacagtcatccaaaggaaccaactctgccaacaccttgatttctaactttcaacttccagaactgtgagacaatttctggtgtttaagctagctcatttgtgatactctgttatatcatctctaggaacctagtataactggtaaatcaaataggaacacagttctttggcaagccaaaagatgtataaacaccacaaagcaacttcaagagaattcaaatgtgtagtgatatttttatcctttactttccaaaaatgctattaataagaccttcaaaataaaccagtaattgcataacatcaaccagtcacagattaactctttgagatgactgtcaagtaatattaggatgggatgtttcatgcaggagacaggataggatgaacagactaaggatagagatcagttgaaaagaaggcacatacttttgtcagatgggaagatatttcaaaagtgacacatagtgttacaggggcaggttagacatctgcctctgaatttcattctctcccttgcctaatatacaataagggctgatattcagccagtatgcatcagtacagataatgttagctgttagaatactgaagtagtttcactgtggttggtaactaactgctgtttacaccactgtgcggactgtctctttcactgtccaggccactctccagaatgccccatgatccaacaaataacacagttactccccagcacaagtgaccttcaggaccccgctccatccataaataggcatcctttctgattagctagttcttgtacaagtcagtcccgcaaaatcttcccagttaaacactacctacaatcttatttatacttaattggcagagctaacattcaaacccaggcagcccaacaaaggagcacctgatcttaaggaccacattattccactgcttctactattgagacaggtttgcagcagaactggtttcacaagatacaggtcacaaagacctggcttataaaataggatggggtaaaaaagctggccaaaacttgccaaaaccaagacagccatgaaagcgacctctggtcatctttacttctcattatatgctaatcataatacattagaatactaaagtaaactcccaccagtgccataacatagtttacaaaggccatggcaaaatccttaagtcaccctatatggtctgaaaggtgaaggagaattctgggaattccttgccactttcctggaaaattcatgaataatccacctcttgtttagcatatgatcaagaaacagccataaaaatagccaaccagcaaccctcagggctgctctgcctgtggcgcagccactgtttcattcctttactttttcttttttttttttttttttttttttttaattgagacgcagtctcactcttgttgcccaggctggagtgcgatggcgcgatagagctcaccgcaacctctgcctcctgggttcaagcgattctcctgcctcgccctcctgagtagctggctgtagaaccatgcccagctaattttgtatttttagtagagacggaggtttctccatgttggtcaggctggtcttaaactcccaacttcaggtgatctgcccgattcggcttcccaaagtgctgggattacaggcatgagccaccgcgtccggctctactttcttaacaaacgtgctttccctgtactgtcggctcgctgttttccttcccgcacaaagccaagaacccatgtggcctcccaggctgaaccctagttttggggttttccctgtggcactatggcctaattaggtgttccaaatttcatcataaggactagaaaactgttttgaaagtaactgttctcagactgtgagaaaaaatttaacactataaacaatattattaacagaaactctctacttaatgaaactccgcattacctactgattatcaatttaatgggtaagtcatttgataaaatctcttttgtcaaactgtggctcaaacaggaaatttattaaagctagtaaaagctaaacaaaagagcattatcactaattccaaaactcaaagtaggatttggaaatgcttaaaatgatgtggtgaattattaaatctgctataatttataatactaatatttcatttacttgggagattaaaaataaatatctatttttatttacctactgagttatacattatttaaatcctaataacagttgacatgtactttaagtattggtttttgtatattatattattttgtatattattagcatgcctaacaaaaatcttctaggctagattaaggatttatggtctcctcttccaaagatctaaaataggtagattctctatttccaatgaccacacaccagcagtcatccacaccatattatttgaagctatatttcaccttatacatcttgtgcctatttcagtaagacaagtacctaggcaacagatgatgatcttctcaagaagacattaacactattttactcttcacaagtcatctgctaaaaaaaatttcccatggctgacaattaccttaagaaagtggcttttcttttctttttctttttttttttttaacgtttcttggcatcaagaaaaagattaaacagaaggaacaactaggcataaagagaaacagcaactgacaacactatttgctttcatagcactttgaaccattggcaggatggactgctaaagtacttgccaaatacttccataaatatacacaaaacaaaatatgagaatgtattattctgtgttgtaactcccttgatctaaaccctttagaaataaacaaaaattgagagctctgaaactgggaaaacaggaataaagaaaaaggattcctttccctgtaattaagatacaatatatttaaaatttaccaaaccagcagcagtcttccttatgatagtcttccttactaaacttaaaccctgattcataaaatagttaatagagagaacaaaacctgacatcctaccaaacgctgtaggttgacttaaaagtaattttttaaatccatgtgtatctacctacctctaaacatgacagttacggagacattttaccttctaaggagaatggcttttataatgaagccagcatctatactacattaaatgaagttatagaatggaatttgaagtacctagcaaaattcaagaataaaaaaatcatattgtgaagtctcaaacagcaaggcaactatacctttatgattttgcattctctataaacaactgatacactactaaaggcatacagaaaaggaacaactaatgaaaatgtattttcattataattgacagtctaggttccagtcttgacagagctaaaagaaaatctgatagaaataacacagaatcattttgcactaaatgtggaaataaatcaggtatctaccccggaaccatttatcttttgaaagtcctaaacaaaggtggaatagtgataagggaattagatgtgttcaaattgattcttcctcacatttccacattacaatcttacagagaagttattcaaaaactgtcaatttaatgtgtctgcaaatgttaaaggttttctgcctttatttataagacaaaattatcttctcttacacatttgatgagtgtttttatatgtatcacataggctaacaacttataaaatcttactagtatcagccaggcatggtggcttgtgcctgtaatcccagcactttgggaggccaaggtgggtggatcacaaggtcaggagatcgagaccatcctggctaacactgtgaaaccccatctctactaaaaatacaaaaaaattagctgtgcatggtggtgggcatctgtagtcccagctactcgggaggctaaggcaggagaatggcgtgaacctgggaggcggaccttgcagtgagccgagatcgcaccactgcactacagcctgggcgacagagcgagactctgtctccaaaaaaaaaaaaaaaaaaaaaaaaaaaattcttactagtatcaattatctattaagtttcaagtattatgcccaaaagcagtgaggagaaaaagccctttccctctgactatgatgccatagcaactttgagtatacataaatatctacttttaaagttctagatggcactgtcttagctttagtacattaatatatgattgtggaaaaggaggaaagccaagcgcaattgccttaaaaccttcagactaaaagttattgaaaatgaagcacaatataaatgttaatgttttcttttgttttattatagaccaggagctactgtggcttgcaaactatgttcttgcacaatactggctaacatgaaaaaatagatgcagagtgacagtatcactcttggatgtaataaaatccaggccaaaaaaaatcattaaataaaaataaagttttataaaactttataaggtaaaagataaaagttaccacgaagataaaataatcacaaatgtttacacatttaatagcatatctcatatgagaaaaaactattaagaataaatggagacataaacccacaatcatattaccaactttagcacacctctaagaaagacaccatgtaaagtggggatccagttcactcttttttttcacagcctgcaaactaaaaccggaattaatattttcaaatggttgaaaaaaatcaaaagaaaaatattttgtgcaacgaactaggcattgaaggaacatacttaaaaataataagagccatgtatggaaaaaaaaaaaaaacacagccaagatcatactgaatgggcaaaagctggaagcattccccttgaaatccagagtaagacaaggatgctctctcacaccactcctattcaacatattactggaagtcctagccagagcaatcaggcaagagagagaaataaaaggcatacaaataggaagagagaagtcaaactatttctatttgcagactttatgattctatacctagaaaaccccatagtttctctccaaaagttatttgatctgataaacttcagcaaagtctcagaatacaaaatcaatgaacaaaaatcagtagcattcatatatgccaacaacttccaattaaagaacacagtcccattgacaatagccacaaaaaagaataaaatacctaagaatacaactaactagggaagtaaaagagctctacaacaagaattacaaaacactgctgaaagaaatgagatgattccaaaaaaaaaaaaggaaaaacaacccatgctctggataagaaaaatcaatattgttaaaatgttcatactgccaaaagcaatttacagattcaatgttattcctatcaaactaccaatgacattccttacagaagtagaaaaaacttgtaaaattcatatggatccaaaaaacagcctgaatagcctaggcaattctaagcaaaaagaataaagttggaggtataacgttacccaacttcagactatgcaacaaagctacaataaccaaagcagcatggtactggtacagaaacagacacacagaccaatgaaacaaaatagagagctcagaaataataccattcacccacaaccacctgattttcatcaacgtcaacaaaaacaatcaaaagagaaaggaaaggactccctgttcaataaacaatgctggaataactggctagccatacacagaaggctgaaattgcaccccttccttatactatatacaaaaaatcaactcaagatgaattaaagacttaattatgaaacctaaaactataaaaaccctggagaataacctaggaaataccattgtggacacaggccttggcaaagatttcatgatgaagactccaaaagcaatcacaacaaaaccaaaagttgacaaatgggacctaattaaacaaaagagcttctgcacagcaaaagaaactatcaacagaataaacaaacaccctacagaataggagaagatatttgcaaactatgcatccagtaaaggtctaatatccacaatctataaggaacttaaacaaatttacaagcaaaaaacaaccccattaaaaagaaggaaaaagacatgaacagacacatctcaaaagacaacatacatgcggccagcaagcatatgaaaaaacattcaatatcactaatcattagagaaatgcaaatcaaaaccatgagataccatctcataccagtcagaatggttattactaaaaagaaaaaaaaatcagaggttggcgaggttgcagagaaaagggaacacttatacagtgttggcaggataaattagttcagctactgtgaaaagcaatttgatgatttcccaaaaactcaaagcagaattaccatttgacatggcaatcccattattgggtatatacccaaaggaatataaatcattctaccggagacacatgcacaacatgttcatcgcagcactattcacaatagcaaagatatggaatcaacctaaatgcccatcaacagtagactggataaagaaaatgtggtactatgtatatacatagtgtatatactatgtaatactacatagccataaaagaataatatgtcctttgaagcaacatggatggagtaggccattatcctaagagaactaacataggaacagaaaacaaaataccacgttttcacttaaaagtgggagctaaacatcgaatacacatggatacaaagaaaggaacaacagataccagggcctacttgatgaggggggcgggtggaaggatggtgagggtaaaaaaacaactacctattaggtgctatgcttgctgcctggatgacaaatcatttgtacactaaaccccagtgacatgcaatttaaccatgtaacaaacctggttatgtacccctgaaccccaaataaaggttggaataaaaaagtttgagagcaaaaagtaaataaaactgtactgtgttttataccataacaataaatctaaagatttagatgaaatggatcactttctaagaaaatatcaattaccaaaattaactcttgagatagagtatctgaatcatcatagaaaggattgggggaaaagtaagtctactcctaaaatgaagtactgattttttggatggtttctacctaaatctaaagaaaatataaaacagtagaagaagaaaaattttgagaaaggtaatagggctaggcttgaaaaataatgaagcatgttataaattgacagtatttaaaacaataatacatcttaaagcaaatacagaattcaaattaatacaatactatcattttgggggatcactgagattaaacaacacacttctaaataatacacaggtttaactgactgaaaatgaaaatatcaaaattttaaggaagcaggtaaagcagtactgagaaggaaatttacagcactaagcagttatattagaaaaagggaaaaagctctcaacctaagcttccatctttagaaactagaatataagcccaaagcaagcagatggaagacaagaaggctgagaacaaaaatcaatagagtttaaaacagaaaaaaacagaaaaatctattcagaaagataagctagttcattgagacaatcaataaaatttataaaccattacctagactgagaaagaaaaaaagaagaggcaagttattagggagtaaaatagatatcactacagaccatcagacattaaaaagataaggtaattactaggaacaattctacacacaccaattcaataacttgaattagaccaacttcttaaaaaacacaaacttacccaaattcattcaatatgaaataatctgaatgtcctataaactattagagtaattgaatttataattttttaaaagctcccaaaaaaatctctaggtccaaattgttacactgtaggattctaccaaatgtttaaagaattaacaccaatcctccacgaactcagaggcggaaaaaaaatgaattatttcccaactcattttatgagttcaacaatgctctgataacaaaaccagacaagacagtaggaaaaaagaaaatgacaaaccaacatccatcatgaacatagatacaaaaaactttaacaaaatcaaaccaaatccaatccagacatagagctatacatagataatacgtttggcatacggttttcccaggaatgcaagttaagtttagcatttaaaaatcaatgcaagctgggcgcagtggctcacacctgtaatcctagcacttttggaggccgaggcaggtggatctcttgaggccagcagttcaagaccaacctggccaacatggtgaaaccccgtctctactaaaaattcaaaaattagccaggcgtggtggctcatgcctataatcccagctactcgggaggctgaggcaggagaatggcttgaacccaggaggcggaggttacagtgagctgagatctgagatcacacgattgcactcccgcctggagaacagagtgagactccgtctcaaaacaaaacaaaaaaatcaatgcaatttaccacattaatagaccaattaaaaacctactagaaccaataagtgactttaacaagattatacaattcagggtcaattttttttaaaaaaccaattatatttctatatattaacaacaaaagggcaattaaaaatgtattatcatttacatcaaaaacattaaaagcttagaaataaaaatgtaataaattatgtgtaagatctgtacactgaaaactataaaatatcactaaaaaaactggccaggtgcggtggctcacacctgtaatcccagcactttgggaggccgaagtgggcggatcatctgaggtaaggagttcgagaccagcctgtcaaacatggcaaaaccctgtctctactaaaaatacagaaattagctgggcgtggtggcacatgcctgtaatcccagctactcaggaggctgaggcaggagaatcgcttgaacccaggtggcagaggttgtattattgacataaggatagacagaccaatgaaacagaataaagatccacaaatctaatgatgcatagagtaaactgattttttaacaaaggggaaaggtaattaaatgggaaattgaatttggtatttataaataccaaataaaggccaggtgcagtcagtcatgcctgtaatcccagcattttgagaggcctaggcaagtggatcccttgaggccaggagtttgagaccagcctagccaacacggtgaaaccccacctctactaaaaatataaaaattagccaggtgtggtggtgcacacctgtaatcccagctacttgggacgctgaggcacaagaatggcttgaacctgggaggcagaagttgcagtgaacaactgcagttacagttgagccactgcactccagcctgggcgacagtacagactgttttctctaaataaataaataataaaaataaatactcaaataaaactaaaaacacgtccacatagaaccataggcaaatgtttactcataatcatccgaaactaaaaacaacccatgggtctgtaagataaacggataaaaacggtactacatccacaaaacacagtactattcagcacacacaggcacacacacaaatttataacatgcaacaacatggatgaatctcaacagcagcatgaaaagtgaaagaaaccacactcaaaggctatcaactatctgattctatacatagggcttctgcaaaaggcaaaacaataagaatcagatcagtggttgccaagcggggtagaggactaactacaaaggggcaaaaggtagctttctggagtgatggaaatgtcgcacacttctcttgtagtaaaatgatcctcatataatcgcagtttcactttctctggtttcagttacccacagtcaaccgttgcctgaaaatattaataatggaaaattctagaaataaagaaaattcacaaattataaattgtactccattctaagtagtgtgatgaaatcccacaccattttgtttcctctcacccaggaggtgaatcatccatttctccagctcatccacactgtatatgctatccacccactggcgtgtagtgccatcttggttaaaggaccaactctcagtatcgcagtatttgtgttccagtaatccttattttacttaataatggccccaaagtgcaagagtagtgatgctctcatattgttataattattctattttattattagctattgttaatttcttactatgcctaaattataaattaaatcttatagatttaatttattaaaggactactgtatacattcttcaaaactcaaattatagcattttatgtaaatttaatctttaaaaatcttaaaagttgcatgtaaattatacttcaattatcatattaaaatttgatttttctaaaattgtaggtaaatgtttacatatctcccactcaacaacagtagaagcaaaaagaacttatcataataaaattgaaacaacccaaatgtgttaacaaaggaatagataattaatggtggtagaagtatacactagaatactatatagcaataaaacagaactactattatacaaaacaacatagattaaattcagagacattatgctaaacaaaagaatgctagcacagaccatacataatcaataatggtaagtcagaacagtagagatgggtaggatataaggtgtcaccataaagactgagaagagtcacaagctaaacctactgggcattagaaattttgtatcctgacctgagtggtgattataaggggagatgtatgtgggtgtgtattggaatggagctattattaaagattaatattcctatgtactttactgtatgttagacatcaacaaaaaatataatacaggaaatacttatactttatttcactttctaccttagaagaagtattgaagggaaataaaggcctcatctgctagaagagaatccttaagtcccaaagatgcactatagatgacagaatgcactgtcgtggctgtaagttcctatctcatcatcactttggtgcaactccacatctgcaactagccatgagataagagaaaaggccagatgacatatataccctacaccaagaatgcatggatgaagaatgaagttgataacaacctacaagctggttcttaggcgctgtcagaactctaggagaacaaagaagccttctattaaggcagaagacaatcctgcttcctaatatagaaaagaggaaaggattttatattcaaataacttctcccctatatccctttagtaacacattttttcccaagtagttagaaaacaagaatttttattcagtaaagtcataactggctttgagaagcataccattgcatggcagttatatattactagtaaaatatacatcttgacaatatcccagaaaaccgaggtacttgttttgatagaaaaacatgtatcaaaattcacatattgataaatcataaaattactgttgctatgctgttctacttagaatttcaaagtaatctatcatgtttctacatcactgtaaccaatataagtaatctagaacatgttaatttaagcatataatttataacttattaatgacaaaactttgacatgaacatgcaatgtaaaaggtagttataaaccttgtaactatgtgagttaatttgaagaaacaaagtatgccatcaaagtaacatttcaaaatgtgtaaaggtgaaacagagacatttttacaggtaaacattttatatatatatttagtagctgccaaactcagggagcactgggaaggcctcatttagatgttttacctaaaaatgcatatgacacactgttctctaccctaatgtaggcatgtagaccctaaccatatagatttatagacccagaaaatatacataggtacctcttcttggaaatggcagattccactctcaaaattgagtaaggatagcaggcatctacaacaatcccaaacacatgctacttagatgagatccggatactatgaaaagttgccaaaatatgtcacttaatggccaaacatgctcctaataaaagtttactgtagtgcagctgaaaatagttcaaaattctttggcctggacaaatactgttaaatttagataatccagtgctaccacacttgactggaatacaacctctgcaattcttcaagtttgttatctctccttcacttgcctttgtctctgagcttattcatcactcacaacatgtcacgtaacacagtaaatcttcctctgtttcctggaatagtctatctgaagagatactctacaagtgttttctggtaagagtcataccttaactaaaaagtaaataaattcacaaagctcagtaatgaagatgaaaataatacaaataacataaaatttaaagaatctttattcaccaagagaaggaaaatatgaattatgttattactaaaagaactgtgcacttaatataaaatctacgtcttaactaagcccatgtaattatttatggagtgcattattacgtatttctctaacaacaacaaaaaaaccattctatcagtcaccccttcctattatactgaagtctgcatcttgaccctcaaagtttatattatagaagaaactgtttttaataatctaattatttcttcaatgtgtttttgttactaactctgtaagctttttgacatcctaatatgatttactgaaataacaattcaagtaaattgagttacttgaaaggtaaaagaccctgaaaaaatgataaaaagaaactgatgatataaatatatatataaaaaacatcttaagaatgcatatgcatgaagataaagggaactcaaagtatttctgatttccaacatgctaaacaactaaattactattatctcttttcttttggagggagaaaaatttttcctcttaaaaatcaatccagtttatatatcatcggttagtattatcatgtctttaaaaaattccaacaaagaaatgagccatgcatgcaacatgatctcattacaatcatagtacaaaagtgaagagaagaaatggtttatccaagacagacagtaacttactttctttaagcaaatcaattagaagattaggtaaaacaaatgaagcttaagtattcaaattaaggttaatcatggactttacttataaaacaaatagaatgtaatgttttccaagcattttgttgctataatttactttttaaatttttagatgaaatataaacagaatttaatgaatcaatcccttgtaattaacaaaccagacaataaaaatggaaaaaaaattaatgatataattgacaatttatgaaacaggtatctatgaaactgaaataaaagaagtttatcaaaatgaagtacttaatacaatatggctctattttggatcttgcccaaggttatgaatagcaaatttactacactatataaccagcttctactaaaacaaagctatagtacaggtgctaacattttaatttattttaaaaatcagactaacaacatatatttaatcaagtctttatcatattttactctcaagggataaaaatatttgatagtcatgcactgcataataatgttcctgtaaatgctgcacccttaagattatacctcattcttactatatcttttctatagatatatttaggtacacagtaacactgtgttacaaattgtttacagtatttagtacaataacattctgtacaggtttgtagcttaggagcaaataccatatagcctaggcgtgtagttgttagtcggctataccatctaggtttgtgtaagtacactctacgatgtttacacaataaagaaattgcctcatttctcagaatgtattcctgtcattaagtgacaaatatgttaagggaccaaagcactgcctacattatcttgaaatgtagcaatgaatttttctaaaaggatataaaagaaactattttttacttttttttgttaaattttattttaagttccgggatacatgtgaaggacatgcaggtttcttacataggtaaacctgtgccatggtggtttgctgcacctatcaacccatcacctaggtattaagccccgcatgcattaggtatttatcatgatgctctccctccccccaaaaaaagaaactactaaagggagctatcttgaggggagagggagcatgcttttactttctatcaattgggatttatctgacttttcctaccatttacatattacttttttcttttctatctgtgcagttatgggtcactaatgttttcttcttttatatgttaaaaatatcatttttaaaatggtctcaggagtcaacaataatctcatggtgaaactgttgagtggagttcagacagctccctgtatatgtataggtcataaaacaggaacaagttgattgctgatgccgatgtctttttttttttttttaaatctccagagtccagttcatcactggcctatagtacacaattaacaaaaagaggatgagtagctagaacaccctagggatatttatcagccttgaaaaaaatccaaaagtatttccaacagcaaaaacaggtactgtaattagcatactgtaatagtaattatggcagtggttcctttcctgtatcatgataagttgggtcttattcatttgtgccctgatactcagcacagcacctgacaatgtttattaactactgactgatatgaaaatttggagatttctacagaaggttaccattttgttagcaatgatatgtgttaacagtaagaaatatctacacttaaaagattatagctcaaagatcagtatgcaaacctatgtttgattaaaaatcatgctttctggccgggcacagtggctcacacctgtaatcccagcactttgggaggccaaggcgggcacatcacgaggtcaagagatgtagaccatcctggccaacatggtgaaactccgtctctatactaaaaatacaaaaattagctgggtgtggtgatgcacacctgtagtcccagctactagggaggctgaggcaggagaatcgcttgaacctgggaggcgaagcttgcagtgaaccaagatcacgccactgcactccagcctggcaacagagcgagaccccatcttaaataaataaataaataaataaataaataaataaataaataatgctttctgacccttgcggtctagcctcatttcagtcagacctagggaaacttcaactaatctgcacaactaattttagtttgctattaatatagagataaatttgaaagacagtcttcaatggccatacttcgttctattttggaagtgtgaagtttcaggagcatgttttcattgtctaacattcattatacggactcatacttatccaaatattgaattttgggttatgttactttttcaagttagctaagggaaaaaaaatcaatgtattaatactggagtcaacaatcaacttttcagatatccatagtaccctcaattaagcaataagcccattgagaaaagaatacattaacggggcagccttacaaatgactttgccaaaggcatcctcttgatcctaatgttggtcctggagcccactcatcacctttgaccaactgaagggcaaattaaatcagcagatgatgagatgttcatgcccttttgctatgctatgcaagcttttaatttggagatgagttaaggatgaagtatggctttcctgaaatatagcaaaaccatgtataactctcagtagcgtaattaagttgccagtaaaaagttacaatgcttacatatcaggaagttgggtttatttccactggaacatttttacatcttttgctttataaagtaaatatgaattccacatatcaaaatctattttcataaccttctcaagaatgtatctgctgaaaaatcaaggttcagttctaattttactctacaaacttaaagagggctaactgtgtaactgaagcatagaagccattatgttttagaggttctccacctgaagcaatcaagaacctatcttaaatgttgatattatcaaagtctttaaataaaagctcagatctacattaaggtaggattacctccctcatccttagagcaggagcactgatcaaaaagccacttgatcttaactaaaagtgcaatttctttagttgcttagttggtacagtcatgtcactcaggatgtttactaattcagagtttaattctcaccccaaaaatgtataattttagctcattttctcaaagaagtttctctaattataaggaaatgtaactgaccaaatcttgaaaattattacatttcaaaaacaaatcaaattcatttacaagcctgatcagccttacatgaactaatgtttaggaataacaagtttacagaaccaagagaaaaaagagaatttaacagatttatttacatagatggaatcacagtgttgttttttaaggtttataatggcaaaaattatatcccctgatattcaataagaaaattcacaaattatggtgtattatatgccaaactcacatttacatagtaaaaataagacattaaaatttgtaacatatatttttaataaacagcacacaaaaatgcccaagcatatttaaaattattctccaatgaacaggtaatgttttagggttttttagagtttttaaaagcttaacatgcctgaagataaggactttttttttaagtgcattccttacctaatagagtgcctgacaaccagtaaaccagtagtttaaagaaatgaattaagaactggcttcttgtgaaatttacatgtttaacaaaattagctaaaattaatagctactttcaaaataaccacatttttcaagctagtttagtataatcagaacatttgggcttcaaagagactttagaaattaattcgatctgccttccatttatttacgagaaaactacagtacagaaagattcattttctgaaaatcatagagtaaggtagagagaggacaaaaaaatgagaatgacagttccaattcaactcctcattaatattccttgaccaaccttcaaccactccaaaaatctcttatattatggttacacaaaactatggaatgccattgttttggactgagacttaatagcccacgccaaaccacaatgcagtcactctggtttgttttgggctgagtcttaacagaccagaccaaacaagaatggagccactcctgctaggagccacataaccaaactgaacttcaacatcaccaagttttcccaaaaaaaaaaaaaaaaaaaaaaacaggatattcacagcaaccaatcagaaagggcccagtttacctgaattagcatgataaagaagtctgttttaaccttataaggaaagtaacttacaataaccaattcactttttgttccttctttctttagcctctttctgcctagaaagcccacctcctccacttagctcatctgatggcctatttttatagagacactgcccaattcatgaatcattaatcaaagccaattaattaaactcaatttgttgaaattgttttttgatgttacacacacgtcaaagtgtgaacaagttaaagaattaagtgcaagaaaaatctcaacttttcagaggcaatcattagggacaaagaaaattagtttatctaagtttctgagggcctttattctctcttctttcaacttatcctttttaagagttcacttgtaatagaaaaataatattctaaatatccattaagtataaaaatatcttattgagccttctaagggataaacagtgtgtagagcttaaaaaaatcaatcagtctctattcatgaagtttatggcaaggaaaataaatagacctatataatataaaaagtcccccaccaacttcagatttatctgacttttctgaattataagagatattcacttattacttgtataattagaaattaagaacaagcaaaacagggcttctccccacctacttctgaataatgaaggagttctataagaacaagacagtaaggaaaataattcggatagaagaaataacatataatggcagagttgtcaaatcgttatggtaggcatacatggcaatggacagatcaggaacgatgttttatgtaattctgtaaagagtgggtttttcatctcgaaagagaaatcaataaaaagttctcagcatgtgaatgacaatcaaatgtgcacttggatatcagagtaaaaactgagtaggaaagagtcacaacgaagggtagaaaaactagttaataaacgtctatgaaagttaagaggagagttggtcaggctatgagaacaaagacatatttcacaatctgcatttggtttctaagtgaatggggagtctggcagaagacagaaaaggtatgagcctccaatttcaattttgtatcaaaatcagtgatagtgccaccacaaagtttgcgaatgcgaggagctcaaagggctgagatatcaaccacaaagataagaaatttaatatgtctggagaaatactacaatcattaaattgaaatagaaccttcttaacaatgtaacagcatcatgatcgggaccctatagaattttgaagcaagtatttggagacctaagggttggtttttgttgttaaatttgttttgtgatgtatgtgtttccctttgttatttttggctttggttctgtccgtttcctttgtacaaaacatgcacttctcttagaagtcatactgcttattattacacgtgctcatttgactctcaattgggaatttctttttctcctggtgttatcttgcactagtggttaccttctaaatgttaaattttcatttccatattatttgtatactgataaaccataatttccttgaagccacgtagcatgctatagcatttctatcacttagaatgtttaataactttccaaaatttatgtagacctatatgagtccttttcttaatccatctggcctctcttaatgtcaatgctcttctccacccctcatcaagatgaggaaagagaatttgcccagaattcagatatttatgaaaaaataaaatgtttgggtctccaggttatctggcaaatcaagtgaaaagtgaacctacctcccccaaatgacccctaagctttataggttactttatcactgggttatatcaacagccccccaactccagttgatgagtaaatcttattttcttttccctattgccctatggagagaatttccatcctctcaatctcagaccactaattcttattcgcagttttgcttagatgttttttgaaccagtccttccctacgtagctttaaaatttaaggcagtaattatcaaaccctcaagtaccctcaagagataggtaaaatcttcttcctgggtgtctaggagatctaatctaaaaaaagctccttatctttgatgtattgtgaacattacaaaaattgattcaaagcttgcattttactgtatctctgtctaaatattaaaatgctttaatttagtcatcacttatattaacttctggtcaaaaatttccaaaaaccgattctattttgaagcttcttcgccctccggatacaccactacagactggagtttaaatgctcaatgtaaaagattactacatacatcacagtgcccttcacaaaacgttagtaatatagctgggcgcggtggctcacgcctgtaatcccagcactttgggaggccgaggtgggcagatcacgaggtcaggagtttgagaccagcctgggcaatatggtgaaaccccatctctactaaaaatacaaaagttagctgggcgtggtggcacacgcctgtagtctcagctacttgggaggctgaggcaggagaatcgcttgaacccgagagggagaggttgcagtgagctgagatcgcaccattcactcggggctgagtaacagagtgagactccgcacccccttccaaaaaaaattagtaatacttttgaggaacacatttaaaatgctacaaaactatataaaaacaaaagtaaagacatgaactcatgattcagttgaaactgaatactaaatttcatttagagcttagtaaaaataaatttgtaattattttcccatccaagttcaaagacactttacccttaagaatccaccttctaaaggaaaaaagaaaataagtgctaacactaaatgaacactgttgcaggatctctgataatcactatgtacacttcatgtcattaaaccatcacaaatactattccacagattaggctgcttaggaaagttatttgtataaagccatgtgaccaaaaatacattcaaactatagtgtaactccaaatgaagactgtgacaaagcacctcaaaaaaattttctagcctctagctgaggaatcattgaggaacactctactgataacactataactcattaatactcctattaaacaactttctgtttgggcaattaaaaacaatgttcagttaaaactaaaatctaatacttcctagagttccacatgagatcatcaccatcatcgtcatcttcactagctaacccaaaggaacaaggtaaacacaaaaactccccactcttgtaccaatctaaaaagtaaatttttgaatccattttccaactgtgtcacacacagttgttagtatccttctaaggtgtgtatatgcctatgtatactttttaagtaaacttataaacatgtggtaactagggcatattttattctgtctacggcagcttcttggtttatccaactaagtattactaattctattttcttagaatgagaagttctcagaacaatgatctatcacctaaatttcaaatgaatgtgtaactggtagacaaacttaaagcagactttctaaaactattaacagtgctcaagaatgcatctatttacatcttaaaaatttctcagttactatatgctactctaatgaaagctatattcaaattataattttttcccacagcatgccaacagattaggaattataaacagacagatctggatttgaatcctgtctattctttagcagctggttatctctgacaaattactgtaaacctcgttaggcttctcggttttgtattatcaatcatcattggtaactgatagtactgagagatcctcattatgtaaggattgaaagaaaaatggttgtagcactgagaaaagtatcaaacattattctgcaatttccttaacttgggttttacttttaagttgtaaattttcccttggcaatgttcacaggatatctttgctaaaatattatttttcagttagttttaagctgactctttaaatatcaaatgatttgctctagagatggattttctttctttggaagaagccaagatcatttccatttaagggcatgtaagcagctgctgctacacattttagttacccataagaaagtgaagtgggctaagttcactctgtcataagcatttaaaaaattaaaaattacaagtacctcctctaaaattaaagaagagatttaagaattaatattttcgagtgtggtgacttaagtaaatctaacatctaagacaacaaattagataaacagagaagaggagaatgatgcccggctttacaaaaaaattatttccccagttctactgtaagataaactgttctaggaagttcaaaatatcatctcacttactagcatctcatttttatagtaattttcaggaaagcaactgctagattaaatgaggcacatcctttcaaaaacattacaaaacttaaatttcaacacatcaaacctataaagcctcattaactgagatgtaactgatttggaatctgtaattatttcttttttgccataaagttgcccttaatactgcatcagtttattaaaaatttggtaagattgtgtaataatttaatgcaattgtttttaaaaaatcttaaatacttaaagtagcatattgctattttgggggtgttgtatgtatcagtttaaatataagtattactattcacaaatatattgttaaactgctaattgaagaaaacacaaatgaattaaatacatttattagttctttaactgtaagataaaaataattttttaaaacaaaaagcaattagcctgattttctcatactccttctcccatacacacaagaacaagaacaaaataagaaaacaggtataaaattttattgtgtaaaaatatttcactttcactaaaagctaacattatgaagacacgtattaaagcaacagcagcaagaattcaatgaaagttgttttgcttatacctgtgtttatttttctcataattaaaattcctgcagtaactattttagctcttcaacatcttcaccattaatattcaattatctctaagcctgaagatgcatgaatctttaacaaaagctttccaccacctcaagtttacttatttttttcatttatctaccatatactgttttaaattaaaaacaaaagatgaagcacaaagtgttaatgacttttccatacctaaagtaagaagttctaaagtttggttgtgataagactgagactgtggctaaccaatcgaaacttcagaattcctatgtgacatcataagacctccctagaacactttttctcctccacctactgcaactgttcccataaactgggtgacagagtcagaaaactccccagctaaacacccgtaagacttcatacaacacaatactctatactgtgatgatcacagctgccaaggtaagaaacagatttcgctgactttggtaattcttactttctataattcttaattcctataatttctataatctgaacttttaaaatgagttaattttatgaatatcagttcaatcttaggcaataaaatgacatgacaaagtgcttaaatttataaatgcttatccatttagtgacaggaaaaatgagacaactttgaaatgaaaaaggtcatattcatctttgatcctggttactggtttgtcatttaaatttatctttcacttttattttgcttttcaaatgtgaatttctgccaattaaaaaatcttccaattatgttaccatatttggtagtagtggttaatttctccatgcaaaaacaatgacttaattttgttatttattgctctgctgagaaacagtgcagaactgagctatttacatctgaactaatatgaatagtcatttgactacaacatgcacattatcagcatgcctattccaatattatcataatttcatacagtgaataatgaaatggagtttcagaatatataatacaagctacttttaaagtgcccttgaggatgtttcccctctaaagtccagtcaacttttaacaaacatttctaaaaaaattccatgctattaataaattgagttactgatattaaattcaatattgtatcataaagaagtttagaaattttaaaacaatgttcacaaacacaaaaaatctgacgttagagaataatttgatactttaaaaagttattttgacacacgaatattcttaactatcttattttcacacaaatttgattaaatggatttctgcctattaatgcctatagttttgtcaagttattatcctccagtggtactccatttcctctctcggatttagaaagaaaggaaaaaataaaataaatgccaggaatggagatgccacaatcaattttatgacttctgtttgaattctaccctattctttatgttacaatcctcaatttagtaaatgaaacgtttcctcattcttagatctctgtcagggcatacagaaaattacatatattttatttattttgattttcatatttcatatatatgttaaaataaaatttatctctaaaattctcaattcctatgacaaatgttaattctattgctcactacaaataagaactttgtaactctgtaagcagctttccttaagacataaaaaaacataatttttgtctaccactgaggtatcctaattgtgtctccatatctctatactcatatttttcctttgatagtacataaaagtcattcagtgtaggtgtcttatgttatttgtgcatttttattcaaatatctatcaaattacattctcacacttcaaattgggtgttcacgagttattttattgtatcagaattttgctatatcacatattactctaaaaagtacacatacttctggatagagcagaaattatattaaacttacccttagctcactagtatgtctcagttaacagaaattacagttacagagactgctaaaatttcaaatataatgtggtagtaccatacattgtgtcccaactagttcatctataccttaaggtgcaagttaagtattatctttgtttatgaagacatgtggtttcaaagtaagtgctaaaaaaagtgttagatgaaatcaaatggaaaaaatatgaaagatgtttaaattaagaagcattaagttttaaaaacgcatgaaagagccagagtacttgctttactaaaaggcgtgacagcactatcatttcctaaaactcaaatatcaaatccattttatttgtattttagtaggcataaaggaaaatgatcacatttgggtatataatcatatctttaattagtgagattaagaaataataaaatattgcataaatacaatagtttcagaaaattttaatgtattttaatgttttaatgtactcattacacatgtacactaaattatgtaatatattaaatttttaattaaaaaacctaaagtctagttacctctccaaattagacaatatattaccaatcccagaaatgaggagggccaatgaacacttcttttttattcttaaagagcaatttcctaatatactcgtgtacacaaatatttcatttggtcctcttaattatatatttgatactgcatccctattctacaatttaggaaagatgcaaaaaggtgaactgctcaagatcacagaactaagaaaacagggaaaccttggcagaagtttaggttttgtcactaagccacatgcacatcctctatatactgatcagcatggcttaaagtaaaccatgacactgacaaacaaaatttgaaagcccccaaatactgtaaatgatattctaaaaggcaaaaggcaaattcagagaatacaaacttctattttaattaaaagccattccactccatttaaattcaatttatgcatagcattacattcttaatagtctaaattatattctactgatcattttcaaaaccagaaatatacgaaaattacagatgcccttagttattaagcaatacctcctggaaggcaaaattcaaactaactgcacagactttaaaaaaaataacacaccccaatcaatcaaagtttccttttatttgtttcattgctaaaatactcatgccttcaattcatctgatacctaaaatccaagttaacatctcctcaaaactttcacaaaaatcacatttcgatactttattctaggttccctagaatcaagtagtctctttgtacaatttcaaagttcttacccagagtaattctgaagcatgtgttaccaaataaacacatgaaaatgaagcctggatgtacagcatactcatagtcaactgaggacctctagtgcctttgaaaaggtactccatctttagttttcaacccccaacccccgcacaaaaaaaaaggttgactaactcactcacattaatagggggtatatttattaagtggcattcattttaaatccttaagactttctcaatactacctccccatattctcttcccccagaaaagattctgaatttccaactcctacagggttaagaagaatattttacttgtaaatacacttgtaaagcattgtttcaatatttaaaaaacaataatgaaggcaaacctacagacaatatagcaacagcaataagctaaattgtcagttttagagagaaaaatatctctgtgctgttgtttaatgaattctcctcaagacagagctttaacatgagaagcacttcattatgggtcaatttaggaatgagaatatattgatttttatgcatatacaattattttcataaccagacagaagcagcttgaagattctttcaaacagccagtctggaccaacaaagctctggaatgttgctaccacaaagtaacttcaaatagaatgtccaagtttagtattaggcaatctcaaaaggaaaatgactccactggagtgaacttttgtaagccaacagattcatcgtaaatctaatgatgaactgtcctaatttattaccacaagtccaaaaaagggtatatgcacattcacttatggcttatcagtggaaatgtcagaaagtagtagaaaaataaaattccaaacaatccaaatatagacaagtcctgtttattcaatctatagaaaattctaatcttctaaaccaattagatggaaaaaacatcctagagtatatcagactgtagccttagatattacttgaattcaatttaataaagtatttcttcagtactcccatgtttactaaaagaataaacaaaattaaaaggagaaaagcaaaattctaaattctacaaacataaagaatcccaggaatttattatttcagcaaaaggaataccaccaaaaatactgaagtttgagaagttctgcaagaagtgaacatacttaaagtatagatggagattaatgctcagcatatacaacatcattaaagtatcaattgtctagcaagtcataaagcaggccaccaaaagttttcagaagactattgaggttccttccgcacaagaatgcatctgatattacattgctaaaacaggactcactgcagacaaagtaaggactcctgaaggagttgatatatagtagcttccaccaaacatgttgcctaacatggtatatgacattagtcaaaagattagagttgcctaatggcttttctatttccttcttccacctcaaaaaaaaaaccagaataccatcttgaacttgattttttttttaatttccagcgttacttttcttgaggaaaggacgacaaccaaaggatttataaatcccacaaagaatagtaaagaattctttatttttattcttctcattcccctaaaaagtagagtaatcatggatccacagacataagatactctgtggatactttcctgcctctgacatgtaactcaagagacaggagtctggcatttctacacccaaactcctaacaagcacctttcatgttttcaatactcttgattctagggcctagaagacaatttgattttaaaattcatctataaatgaataccactcttgtgtcaaaacaaccaatttatatatattgtcattcttttaataaaagggtggagagcagcttcagtttccatggttgtttaggccatatacaagttcagaaaatcccaaaactatttatgattagactaacagaatgctctaaaaagatcagataacatgaaaataaaactaaactatttttgtatgctttccatcgaaaaagtactctattaaacagcttagctgttaagaaattaaaaaaaaaaaaaaaaaggaaactcatacagtggttgtcagtgcagagaagagaatgataaacatctgacaaccatgccataaattataatgtagtaaaggtcacagacaactccaaaaataggattctgctgttcccacaacaaaggttttcaattctcaatgtatgacaggaagccccatcttctatggataaaatctggcctaattatcatcatacaaatgttggtattcagtagaactaggattccacacatttcagatgataactgtaaaaaattgagcccaataaattaaatgtatatcattaacattttagcgtgtaaagcagatttaagtttaggcataaaatcataaagtagttacaaataactttaggattatggcatatttctaaatctgacaagaaacaggatactatttttggtcatctcctttacacccaatttgtttccagaaacaaactcttctttttcaataacagttagctgttgtaggattataagatcatctttaaagtatgttaactatgctttaaacagtaaagagctcatctctttagggcatatctctgtatttcacaaatactaaaaacccatttatacaaagcctagttcaggttaatactgtgttaatcaggtaaccattaatttaggtgaatcctctaagcctcatttttctcacctgtgatagaaagagacttgaggaaaatattagagcttacatgtccaactaacaaattgttattagaactagttaatctgtcaatcacagcattatttttaaaattgtttaacttattattaaaaatgagggccaggcatggtcattcacacttgtaatcccaggaattacctgagctcaggagtttgagaccagcctgtgcagcacagtgaaaccctgtccctaccaaaaatacaaaaattagccaggcatggtggcgcacacctgtggtctcagctactcaggaggctgaggcagggagatcgctagagcctgggaagttgaggtgcagtgagccacgattgcacaactgcactccagcctgggtgacagagcaagaccctgtcagtcattcattcatccattcataaaaacaattaattaattaaaaatgagatggggtctcattatgttgcccaagctggtctcgaactcctgggctcaaacattcgtcccgcctaggccttccaaagtgttggaattatagatgtgagccaccatgccctgcccacagcattatttttaattaacaattttctaatagttttagtcataaaaatcccttatttaactttagtgatttattgaagcataccaattatgcactaagtactaggatactaaataaacacacagtttctttacttcagaaactatcagtctagctggggatacaaacatgtaaattgaaattgtgctataatctgacagatatcctcatatagataacactaaagccctattaaaaaccagtagaggtgacaaccaattccaccttaataactaatgaaaggtttcactaggaagtgatatttaaactgaaccttaagaatcaactgaagcttgcatggcagacaatcaaaaggtggagaacacattccaggcagagatagaacaacatgtgcaaagaacaaaatcacaaaagggaatggagtatttatggaaaggtgacatgtttcatgtgactgaagtacaacttaccagtgtcaacgtaggggatgactcctgtatatgcttcatgataaactcctggccaactccctcctttcccatgttttgtctcaaaataatttttaaaatttctgaccttttaagaccacttaagcccaaaaacctcacaaaaccatatgttcaaataggaattaccaagtctaattattattcctttcttaactgtattctgctacacatcttcataaaaggtgactactcggccaggtgcagtggctcacgcctgcaatcccagcactttgggaggccgaggcgggtggatcacgaggtcgggagatcgagaccatcctggctaacatggtgaaaccccgtctctactaaaaacacaaaaaaattaggcatggtggcgggcacctgtagtcccagctactcgggaggctaaggcaggagaatggcgtgaacccgggaggtggagcttgcagtgagccgagatcgtgccactgcactccagcctgggcaacacagcaagactgtctcaaaaaaaaaaaaaaaaagtgactactcaaatataaataaaatcttcccataattttccaatccactagatctacaataagcaaatatcaacataagcaaatatcaacataagcaacttaaaggatgaatctcaataaagaacaaaagaaaatctatttatattttacctgaagaattcaaacaaaagtcattaaatatatgtcaagtttaagctgctatgtcccttatttttaacttttgttttaagtttgggggtatgtgtgaaggtttgttacacaggtaaacacatgtcatggggagcttgttgtatgtattacttcatcatcccgttattaagcccagtacccaacagttttctgctcctctgcctcctcccatcctccccgctcaagtagaccccagcgtctgttgtttccttctttgtgttcataagttcttatcatcttgctcccacctgtaagtgagaacctgtggtatttggttttcttttcctatgttagtttgctagggataatgacctccagctccatccatgttcccgcaaaagacatgatatcattcttttttatggctgcatagtattgcatggtgtatatgtaccacattttctttatccagtctgtcactgatgagcacttaggccggttcatgtctttgctattgtgaatagtgctgcaatgaatattcatgggtgtatgtctttacggcagaaagatttacactcctctggatatatacccagtaatgggattgttgggtcgaatggtagttctgcttttataagctgctattttctaagtagaagtgttatagacaacctaaataacagcctttagccacctgtttagacaatgaagaatatatgctagaaaaatacaggtagttaataactctttaaggaaagaaaatttgatagaagttgagtgtttggaactccttgctacagaccaatattatgaagggggacagagtctcaagccaaaaatgcccagtctactatataattcagaatataatagacccaagttgaacactacagaatctaaacaccataaaccatatggtttctttgccaaagtaaatgccgggttctaactagtcatgcctgatacttaccttcccctttgccattctttcagcacttccttctgctcccttcagcactttcctctctcaggaatgggctaacaggttgagatgggcttttatgggatgtataaaaggacttaggagaaaataaaatctgacacctggggtaaggtagtaatatgttgattaacaataatatatcaacaaatgttaacagtcactatgtctggcagttaattactgactttttttctccgtttttcatttttcttatttcaaaattgacacataagtatactgattgaaaacaaaatgtccccaagtgttaataacgattatctctggacagttaatacagttaattttcagtctatatataatttttctgtaatgacatgtaaattcttattttattaatcatcaaagtataggccccacaggcagcaatagcttgtgggatctctgaaagaaggcatgatggaaactactactattaagtagaagtctgtaaataggatatgtctgtggtagtgagataataataattactatgtgttccaagcttgacagtcttcagtacttaacatcaaatcttattaaaatgttacttaagataacattctataaaactataaaatcataaaaaggaataacaatttgaatctatatttttggtaaaacacttcccatttaacactattttattttagattaaaattaagatccagggaacaatttgttgtatgcatttcctttttatgagattggctctggagctattaatacagtgactgatcaaaccaattacatctacagagtaacagatttaaagaaactatatgttagaacttttacccaaaagaataacccaaaacaagctgtaccttaaaccaaatacagcaggtcctcaaataacatcatttctatgtcattttgttataacatttaagtatgtgtggggcttgcatattctccccacatctgtgggactctggtttcctcccatatcccaaaacagtgcacattaggttcactggcatgtttaagttgtcctgggttgagtgtgagtgtgtacatgagtgtatcctgtgatggagtggcctcctatccaaggtgggttcctccctccttgagctgctgggattggctccagccaccagcaccccaaaccagaataagagggttgaaaaatgaatgaatggatgaatacaaattattatcgaataaaaattggtaaagtctacggtgatcatacaaatgcatgacaataaacgctatggcacaaaagcactcagagatcccaccgtatttgaattgtttttgatctgcatggagctggatgtgctcctgacaattttcatttctcaaacatgattccatgtttttaatagaccaccacaaccactgttactcactgattcaccaaatactgggtaattatctttgttggcttttttttttttttcctgggacagagttttgctctgtcacccaggctggagtacagtggcatgatctgggctcaatgcaacccctgcctcctgggctccagcgatcctcccaagtagctaggattacaggcacatgccaccagcctagctaatttttatatttttagtagagacagggtttcaccatgttggccaggctggtctcaaactcctgacctcaggggaactgcccgccttggcctcccaaagtgctgggattacaggcatgagccactgcacctggcctatctggtttttattaatctttcttaaatgtatacatagttcatatttctctcaacgtttaatattagaagtgtttggggtctttattgagaagtttggtgatgtttttgtgaccagaaatatgctataggaacttaactcttgtttacatcaatcagcctagggtaaaaatggttttgttatatgttgttttgcgtaaagtcatggtttccaggaacttatggaagacactgaggattactccaatacttgtagtaaatttgggagaaaaaggcaaggactaaagttactactcctaacacaaatgagacggtcatggtgtgccccatcaaaaaaggagagaaagagagacagacacatagaaacacgtgcacatacacacacacacacacacacacacacacacacacagagagagagagagagagagagagagagggagagagactatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattttcaatttctcctctgaccatttcagaacatcttccaataactcataaaacaactgaagtaaaattgagtgctggaaaatatattcaccaaactttggtaatttaagttgactaaagtttaaaattaagtctaaaatagtttacacctatactgcataatccaacaattttaatttcagttgaagacatgttactaatataactattattaaaagagtagaggatgtgtaattaaccatatcttctaaaacatggttactaaaagaatatgtaacatcaatattgaccttggtttcttacacaagtgttgctaactcaatagtgaaggagacactattaaattttctgaacccatgagagatactagagatggggagtggaaagtgtttggttcagggatatctgaagaacagaagggcagagatttcttaagtgacgcctcatctacaagctggaaattcctaaaaacaagtagaaagcttataaacaacaggtgatacactcacctcactggttttagtaaattaccaatacagaaagtatccctagtcttaaaaacaagtggaaaatttgaactgattagtcatattcctttgattacactgtttgttacaatatttttctcagtaaacagaaataactaatttttttgttcttcattctttgatagaaattaaaatcttattctgtgaggattacagaatactataactcaaattataaagtagaataaactctttaaataattattcttcatcataaagtgtaaagaataagatataagaaaacaatttatttttaaaatttaatatactaaatgctcaaatatgttctactatagaataagttcttatcttaatttacagggcactaaaaacaattttaaaatgcttaatgttgccttttatattttaattggttaagaatatatatttgtttaatgcaaatcagaatcactatattaaaatgaatgttcttgaaaactcagtggggctgctctataatacacttacaattgatactaacgataaaacgctctaattatagttttaattttataggggtttttttggtgactttccccaaataaaacaaaatcaagacgcccaagtccagacacacaagagggcagacgtatataagataacaaattgctactacatagcgattatttatcttttgattatttttgagacttctggcaaagtaggactataataaattttcagaaaagatctgctcttctgctaagtaacagcacacttcaaaatgtccagaaattttatgctaatattacatagaaaacttgacagatgaaaaaagtgaaacacattactaattttattcattaaaacaggtatataaaagtcctctttaactacctaatgaatgtgtcatatcctaatatagggagtgtcatagtgttcacatctttgaatatataaattatctcaaacagttaaaaaattaaagccagaacagggtacaaaaataagaataaaaataagaaaactttctgttcacaggacgtaacagaatactttaaacactctcaagttataaataaaactttttcattattatttcatgttagacaaaaaacaagtcattttactttaactcattttatcaattttttttttttaaatcaagagacagggtgttactctgtcatgcaggctggaatgcagtcacatgatcattgcacactgcagccttgaactcttggggtgcaaaggattctccaaccttggttcccaagtagctggcactacaggggcacatcaccatatatggctaattctttttattttttgtagagatggggtctcattgcccaggctggtcccaaactcctatcctcaagctatccaccccccatcagcctcccaaagtgttgggattacaggggtgagctaccatgcttggtccaaattttttgtttatacaagggaaaatctccagtaaaatatgtataggtgccaataccataactgttcaaacacccttatgactaaataggcacaaaatttcatctttttaatgactgccacctgaagttcagaaacatcctagggaaaaaaggataaacaacttcatcaataaagaggctactattatttcactactgtctgggagatccatcgtgggcttacaggaatccaaatggatactgccgttacgtgtagaagtgtttatcctccatcccttccaccctaccttccccaagaaaaggaactcaagggggccatggaaagggaaggagtcttcccaaaaagaccagactgtttttcctcctctgtcatagtccctatagagtcaggcagcttaggggttgcagggggtgggtagcataagtgtgatgtactaccgaggaaagagtcaaagactagcagtaggcattacacatggagccttctgtcataaaccatctgagggcataatggcttcttttcattcacaaaggaaaatgattcagagtactacactcctgcactcttgatgatttagcagaaaaccatggaaatcaaggaacaacacacacataagaatgtgtgtctggctcaataattattctggactaagtcctaggaagagcaaaccttcaatgttacaaattaacctggggagtggggagctgtgagaatcaaatgagataaaatactgtgaaagctacagaattctataacatataaatctaaggttttattagattatgactttcagccaaattccttttcttagttgtaaaaatattgttttttcatggtgagtgtttaggagttgtgcttgcaaatcacaatttatcagacggcctggtccttattaaggttcttctctttatgtaaaaattagactaaaagaaaatcagtgtttctatgatttttatcttttttcctttttagagacggggtctggccatgttgcccaggctagtctcaaactcctggactcaggcaattctcctgccttggcctcccaaattgctgggattacaggcgtgcgctacagtgcctggccagaagtcaatgtttcaaagaggcttttaagaaacaactatgatgaaagcttttaaaataaagataatactacttggaggctccaagaaggtatttaacaacttttttctgtagttttctaaggaggaaattagaagggaagcagtcatttaatgattacaacttagtttgtctagttttctttacctgaattcatctttctactccaaaacttaaaagcgctataaagagaccatcccaaataaagttaatcaagaagtagggctttccagggtatatgcaaattttgctctttagttgccttctctctctactatgcactagaaagaagatttaaaaacaaatttatctcaacagtgtgtccccaacctccctaccctcctctgcattgctttgaggctaagaaaaacaccttgtttaaaccagagatttgtccaagcagaataaaaagcatgaatcagtatttactccttgaaatttgcccaattatctctatcacacctactctagtttggaatagcatactcagccccactggacagctccaattctgtgtaaagacaccagctggagaaacaactgcctggatctctgttttcctataatgacaaacatttgaaaactaaaacttgacagtatttgaaaaattaggtttcctatttttcatcacttgaatggataaatcacaaatttctaattcaatcataatgattcttctgttttgattgtgttgtttaaatacataatcaaaattataagaactgtatctaaaataagaataaaggtacatgcgacatgttaagggttctcctatgaatgtagtatgttagggttctatgttttgagatcatactcatatttgtgaggttcctggacaagtgatttccttatcctttcatagcctatgttcatttattctatttgtttttattagtagtagtaatgaataccaattttacatttttactctagggaaaatttgcaattttttatagaattaatttgtttcagaaaattctgatgataaaaaacagatgacaggacttatatcagaaaattagtttccttgttaaaacaagctacagaaaattgtcttggaatagaaacattcccagattaagaaatttacacatttacatgctattccctagaccaactgggggctgtatactatttttctttatatatgatatcatcataaagcactttctataagctgattaatgaatgccttgacacataattttttttaaaaaaaagtacatctgatttataaacctaaataacatcatgtatcaccaaaactttacaaatgactgtagttccaccttctcattgtacagatgaagaaactgaggcccagagaaattaagtgaaaaagtcatccacgttctaaatctaacagaaccagacacaaaatctaagaccttgtatagccaagttgatgctctttctattatacctatgctagcttttttgtttctgtttccaagtttatttagattgagtatgttttgctttatttttatgcccatttaacaaatgaaaaggaaagaacaagctaggtacaaggttttcagattttcatgttaattagtctcaaatgctttgcaagtttatcaacaacacttttcggtttgtaacatttctgcctattaacttgcagggaaaaggaaatgcaaaacaatctgtgaacacttgttatatgcttactgtaagtgtgctactgtactcataacatccactggagggaagcaaacactagattttgcaccttacctgcattggtgtttcacttccttgtcgaaagtcttcaatttgctgctgttgccaaggagctaaactgtaagaatcctctgtatttctaccttccaaaggatttgtccgcagctgctctgtaagccacatctgagtccttacggaaggctgaatgggaactccacctactgcctgttgaccaagcattaaatattttggaggttcaaaagcctctgagcttgtcataatgggcttgctttcaggtaaggcactatatgtcatgtctacaggctgtctcctaagagtagaggaagaggctctaaagtcctccttgctacagctctcaaatttatacttgcagtccagagttgatgaccgttttttatttatttccttgtcctctaacctaagcatctccatactatcatgtaaacagctaggcccaattgtcctcagttgtgatgttaaagccttagccttccctatcttctccaaaccattccttgactcttctctgcatacagtgccaccctggccacagttatccggggcagtgagtttggataaagatgaccatttccgaagtggccggaagtccttcatgtctagggaagagtcctgctcccccctactgtggtttcccaatgtttgcatgaggcttgtactccattttgagccatctggtgtcaatgattccctaagtttggaaattgaagcgctggaattagacggcatcacatgggcagtaggaagagtaatcaatgattgactaggcttaaaagataatgtgccacttgaagttgaatgatctggaaagaaaaaagatggtcaaattagttacaattaacagacaaaagagaatgaggtaaaatgcaatatgccaaaagaaatatctgaacatggtttcatagcacaagcttttttttttgagacgtagttttagcttgttgcctaggctggagtgcagtggcaagatctcggctcaccgcaatctctgcctcctgggttcaagtgactctcctgcctcagcctcccgagtagcagggattccaggcgcctgccagcacgcccgactaattttttgtatttttagtagagacggggctttgccatgttgggcaggctggtctcgaactcctgacttaaggtgatctgcctgcctcagcctcccaaagtgctgggattacaggcatgagccactgtgcccagcccagcacaagcttttcaaaaagacgtcctcaaaatgagtaaattattattatccttttatctgaaacaagtcaacatagtttcagattggattttctaaatatggatacctaatagagtatatggcctttcaccatctactgtacttacaggtgaaaagtgatttaaaataggtttatatttaccctaattaaagtattgtacctttaaaaggaaaaatccaactccttactgagaggtgttattcataatccagcaatgaagtctcagacacaactttgtcagaaaaatggtatttttcagtgtctttcctgaactgtgaaaatctatgccagatctaaacattttagaacctccccaaactctaattcaaatgagaaatatgagtaaaggtgctcctgcaataatgaaaaatagtcccaaagggttcacttccagtctcatttaatggcatatatatatgtgtgtacatatatgtatgaatatatatgtatgtgtgtgtgtgtgtgtgtgtgtgtgtgtgtgtgtgtgtgtatatatatatatatatatatatatatatatatatatatccatattcaccccaagctagaaccttagagtctacttttattcctttctctctatatttattaaatccccaagttgtacatttttacctccaaaatagttgagtttctattactttaggtcaggccctcacatcatactcttctatacaaatgaatagttttagcagactaaatgaaaggctgaaagataaataatggcttaaatactcaataaatttaccatcaagtgccatgttatcatcatatatatcaaattaaaaccaaagactataattttgtaatcaagggatatctagaaagggggtagcaatttaaattggtgtgtggggaggaagtaagcgatggagacctttgcaatttattctgtatctccccacactgtttgactcttataccagaagatacttattacttgtattctcttacattgtcttatggaaaaagttatgttgataaagttgtaagaaaattcagattaaaacgagccaggtagactattcaaaaaataaaattccagtgggtctttgcacagaatgtgttaacttggacatgaaaagggaaaaacattacaaatgaaggaatataaacagaagtattgtagtggatagttatcatattcaagactgcctatcagcttctgaagaaacttcctgcatttaggaaaattctcacattactgactccaaccctcccaaaatatatttcagacctcaaaatcccagtacaccctgaaactatgatgcagacattcagaggcagcagcacaagattgcagttttggaagtaagtcacatgataaaatggactcggtgtggagctaccatttttgggtgatacaggcaacagcagaggcatcacctttccacaacagcagtgacagacgtggccccgtagtggctgcagaatcaaaattcctatcccagaactggcagcagctagacagcttagtggtggaagactgacagttctcatatatgatttgaggcatattacttggaagcttatccttaagcctggctctccagccttcctaaaaattctgtgaagcaccaaatatatttaagtaaatttcctatgtgctcaaccagccagtaaacaacttctgctgactgaaaacactgaatcgtccaatcatgaagccaaaagaatgtggctgtataacaagaaaaataaatccatgtatctacagtatggagttaaagtgccaagaaaagttgtcaaggtaactcttgataggtaaaggtgaagcagaattatacacatcttcaaacgctctgctaagtaaagagcctggccttcattcagcatgaaatgtggtatcactgagcttccaaacaaaggagtgaatgatatgatcaaaaaaattgtacttaagatgactgattattctgacagcagagttgccaatggattaaagcaaaacaactggcaaacacagtgattaacagactattctggtaatcaggagaacaagaaaataaaggggaatatgctactgagggttggttctaaatagaaacaggacagacgtccccaaaagtttatggaatatttgtattcacatattatagcattatatatattttacatatatttgtattaatattactaaaggagtagttatactaaaatcatcatagcctctaaaagatatctttaaattaaaaaaaataaaaaattagtcttgtatcaagttgcaggtaaaaatacagaccaaaggttaagtataacagttttaatttcaaaactattatatagagtaaaatatagggctgggggcagtggctcacacctgtaattccagcaatttgggaggccaaggcaggcggattacttgaggtcaggagttcaagaccaccttcaccaacaataatgaaactccatctctactaaaaatacaaaacttagccaggtgtggtggcaggcgcctgtaatcccagctacacaagaggctgtggcaggagaatggcttgaacctgtgaggcggaggctgcagtaagcagagattgtgccactgtactccagcctgggtgacaaggctagactctgtctcaaaaaaaaaaaaaaaaaaaaaaaaaaaggagtaaaatatacagccttttcatggcacatgtatacatatgtaacaaacctgcacgttgtgcatatgtaccctagaacttaaagtataataaaaatatatattcaaaaaaataaataaataaaaataaaaaaataaaaaacatacagcctttttagattcaaattctggctctatcactcagtagttatgcatgctcaaacatgttatttaatagttagttacctcctccatacaatggagatgacaacagtgagaattaaatcaaaacacataaaatacacagaagaattcctggcagaaagcaaaatgttagttattatgatgtcattaaaaagctacaagtaaatattaatttcaatgtaacagacaaaggctaaatacccatacatataaagagcttcaacaaatcaacaaaaaaaaaacctagcaactcaattttaaaataggccaaaaaaattcaataagtaaataaacaagaaacacaactagagaatatatattttttaaaaatcctcaaacgcactaatagtaaagatacattctctatcatattcagaaaactattaaaggctgcaaatatactacagtaatgggaacacaaactgttatagtctttgaaagaagggaggcaatttgtacatatcactgtttaaaatatgaatacacatatgtgaacatacatatctagatatgtagatgcgtgcatatctatatataaatacatatacattcattagcagagaaaagatccgaaagaatacacacaaaacttaataaacaaaggtaacctctacatagtggaaagggggcaaaaggagaaaaatacttccacattttactttatacaatgtcttattttaattgcttccaaggaatataacttgaccatatggtcaaacttctgcaaaggtattttgttgttctgtgacctcaaaagagtttaaaatacttctaaagtatgaataataaataggtaattgtctcactttccatatcacagcggaatcctctaagacccagtttggctgcttcttgtatccagtaatgggctactttccaatctgcctttactaactcagtactttccaaatgcaaagaaaaatcagcaatgagtgaaaaatcaatttcacatcagactagtgtttattccctaaatctgaaagcagctgatatatgctgtccatagactatgatactgaatatagaatttattcctaaaattcccttattacaaattctcaaatcttggcataaaaaaagttgcctgagagctggtgccctactccaagagattatgatccagtaagagtagagaagggcctaggaaataccacttctaaataagtgattttgctgcttcatttactataacatcattccatatgggtctgattccagttctgaaggctttaagcttaaatatcccaagttcaaccataaccagtatctgagttctagtgtaaaatctgattaactgtgacattcagaattcattactgtcaaaactaaggatcaaagcttagtctactgacatacatatgcacacacacacacatgcacacacaacatatgaataaatgaaaaaagaattatttgaaagaattaaatatttagtatttataagagaattaaatataagaattaaaatttttaaattaaatatttaagaatatatgaacaaagaatattttcccccagtatgaatatctaggtgggaaaagggtcattattataccttagaaatgagtctagaaaatgttaactttaacaatttcaacacttaaaaatgttattttaccctgaggaaacacagttaattagaggtagatataatgcaattcctaatgtgcttgattaggctacctaattgtagccacaaatcccaaatgcaagttattactatctatcccacatctaagtcacaacagtgatatctgaaaccaacagagggtagtccttttaaaaacaagaatgtggcttatagcattgacagtaggcatagatgagctaatggtttcagacagatttaagttttaaaggccagaatataagaaagggacgctgatatagtctgataatgcaagtgagttgtatttaagacagcatatttctcaattccaaacaaaatcccaatcttctgtttcgctatcatgttattctcatctggtattaaatgaaaacattgattctatcttctcttatatacagggatggtatctctctctctctctctgtctgctctatccttctgatagtaataaggaattaaatgcaaaaaaagaccactcccaccctccagatctacattaaagaataaatcatcagtcttcacagtttaaaaaataatcagtaaactatataaccctgtatcaaaacactgatttaaaataacattttcatacttatcagtcaacataaaatattataacaaatattttattttttaaataaaattgttaaccctaaccacaaaggcaataattttgttttgttttgttttcttggagacagttttgctcttgttgcccaggctggagtgcaagggaacaatctcagctcaccacaacctctgcctcccaggttcaagcgattctcctgcctcagcctcctgagtagctgggattacaggcaagcaccaccacacctggctaactttgtatttttagtagagacggggtttctccatgttggtcaggctggtctcgaactcccaacctcatgtgatctgcccgccttgccctcccaaagtgctgggattacaggcggaagccaccactcctggcccaggtaataatttttatacaacacaatgagttttttttcccttcctgctaacgccatgatcatatcatgttacataggaaaaaaaaaacatgttatgccacatgtaacccattctttaaaaaaaaaaaaaaaaaaaaaaggtgtattcctagcactttgggaagccaaagttgccaggtgacgaggtcaagatatcaagaccatcctggccaacatcgtgaaaccccgtctctacttagaaaaaaacaaaaaacaaacacaaaaaaattagcagggtgtcctggtgggcgcctgtagtcccagctacttgggaggctgaggcaggagattcacttgaacccgggaggcagaggttgcagtgagctgagattgcgccattgcactccagtctggagacagagcgagactctgtctcaaataaataaataaacaaataaataaatatttcaaagtattctctatatttttaggtaaatatattttaatattctaaaccacacactgctaggagtggggctatataaagtaattcatctaaagagtctcctaggaatgtatcatgtacaaggcattatgctaggtagaaaagacaatacaaacatattaatctcaataaaaatatgaggccgggtgcggtggctcacgcctgtaatcccagcaatttgggaggccgaggcgggcagatcacctgaggtcaggagttagagaccagcctggctaacatggtaaaacccatttctactaaaaatacaaaaaattagccgggcgcagtggtgcacgcctctaataccagctactcgggaggctgaggcaggagaatcacttgaacccaggaggcagaggttgcagtgagctaagactgtgccattgcactccagcttgggtaacaagagtgatactccgtctccaaaaaaaataataataataatatgaatcaggccttcccctaagggcttacatttcacagctgcagagcaggactaaagctcatgaagaaactgcaaaacatcagacaatgagaagtggtgagccatggagaaagggcaaactattaataaaacaactatcaatgatagccaacttctcaacagcaataatggaatccagaacacaatggactaatatcttcaaagggttgggtaaataactgacatccaaaaattgtttttgcagggaaactaaactgtctttccagatagaaaaatatattttcagctaagcaaaaacagaatttggagactcactgaaagaactgctaaagttccttgagtttatttcagaataatgaataatgaattctgagttgaaaaaaggaagagcaaagagacaaatggtaaacttgtgattaaatctaaaaaacagtaacaatgcatacaacaataaaaacaatatctaacatgtggttaaaagtaaaaatatatatacttagcaaccatgacatataactcacaacaggggtgactggtattccaacgttttatagtcctcatatttaccagtagagaataaagattctgattaccattatagatagatgggtatatattataccattatagatgggtatatattataatttctatattaaaaaccagaagatacgtagagatggtgtgactggatagccacaggcaaaagaataaagttagacccctatttcatagcacccatgaatattaattcaaatgaatcaataggcctaaatgtaacagctaaaactataaaactcttagaagaaactaaataaaattcataaaagaaatcttcatgaccttgtacactgtctcttagcaaccattaataacaaactaagaaatttattcttatatgcttacataaagcaagatgaaaagctggtgttaaggacaataagttcttcttcaaagctcccttggtctcttgctttgtacacagcccttcctgctcaatctgtaatgagcatgtgttcctcagcgtaatctgtaactagcaaacctcttactctgtaaacaactctttgtcagcccagacatgtccagacatgccttgaacttgttctgtaggcaactcttcccaccttagcaacaatctcctcctcccctcctctcttagcaaattgcatgttcaccatagttagaaaagtttaagtcttagccagtcaggttagtttagatggtttggtccgaccccagccaatggggaaataacacagaaacaggaactgcattagggataaaaacccttctctcctttgttcaatgtgctcttgcgatcgttactgacgcaggcaccacccttctgcagaagtaaattgccttgctgagaaaacgttttgcctgagtgctggttcttctttgtagcactgagcaaagaattacccatctgggatatcattctcctccgggaaagggtctccaatcacctctcataaggagacatgtcctgctgcctcactgcggtggcctcaggggtaaggaatcagaacccacccagtgtgaagaataaacctggactctcggcaacacaggaagaaaaagcctacagtacagataccacggcgacaaggtaactctgtgcacagaccaaagtaggaaaagccagggggcagcaggagtacttccttggtggtggggacatcctggaggttgaaagtgtgtgaatgagacatacaattaagtgcgaagcgagtgtggagtccagatccatggttccatggtcacctgatatgccttagggtagctttcctgtcgagggtttataccaacctaaattcctgcgagggaagtgaccagagaaggaagaagtgaaagcaaaggagtgcaagaaacctccagttggttggggggcgggggcagtggtgagcctctagggaaaaggtgcaagaaatctctagtaaacagaggttgagccccatacacacacaagaaactcgagttgagccgtagagaaagggtgcaagaaatttctattaggagaggttgagctccactgactcaggaaaactcaggaagcacctaaaacttccaggatgggaaataccccagacaaggcagggaatcaaaaggaaaagacagacaatataattccctctgatagctctctaggtctcatgttaaaatattggagagaaaatgaaagcaccaaacataaaaagaagcaacaaataataaaatattgttgctttatttaaaccaaagaacctactctcaaacattcagttttctggccaaggtttgaatccagttaggactggatttgtcaacttttaatagaatatgtcaatgacaaaagtcctgtttcccaggaggaaataaactatgccctgtgttggcggcaagtgcctgtcatcctatatcccctaaaaactacaggagacaagccagaaactacttaccctttagatcaccttcccccgccaaacacctctaacttccctccccacttcaagcaaatgcagaaaaaattaggagctgaagaaaacacagaaggaaagtgtgtattaccagatggaagggaaatgttgtctaaacctcttgagagaaatactgtctcagcttcatcaaggaactcattggggtcctcaagctatatgtgatgcagtccttagagtctatgggtacataggaatacaaaccctcgctaagcaagtagtggatagttgcatagtgtgcagaaaaactaatgagtaaaccctaaaaaaaaaacctcccgggggaagaaatccagggttaaggccatgccaaagcatccaagttgactatactgaaatgcccccaacaggccgcctcaagtatttactagtaatagtagaccaccttacccactgggtagaagctctccccttcccaaggacaacagccagtaatgtagtcaaagccctgttagaacatatcatacccaggcactagaaataaaatgggaatattatactccctggcatctgtcctcatcagggaaagtagaaaaaaaaatgaaccaaaatctaaaaaatcacctaaccaaattaattctggaaacctggttaccatggacaagatgccttcctattgccttaccaagaatccaaactgcccccctcaaaaagaccttagcctgtctgtctctttcctccctcaggactcaaggcctcctagcgagattacatccttgtcaaaggttggaaagagggaaagctcaaacccacctgggaaggaccttacctggtactcctaacaactgaaatagcactccggaaagccgaaaaagggtgaacccaccacacaagtgaagaaggccccacctctggcaaagtcatggaccatcactccaggaccaacagcctcaaaactaacattcaaacgggtttgtctttttcttctccccttagctactcaaggatatcttactgttaatgtaactatgcttgtctagtcttaccttgtggagatctccaaagtcaaagacagttagcttgtacagaaaagtacttctgcccctctgtggaaagagttaatactcctgtgtcttgcatatggggggaatcctcagaggaagagttaggcaattgggggttatggtctcagtgggcagttttagggcactgccctaaaaccatacctacacttcaccaaaggggccaccccttctgactgtcaatctaatcattgcaatccagtacttatccattgtaaaaattaaagatctaaagcaaaccatagccattgaaacacggtaccaagatgcaaatgcctggctggaatagattaaatattccatctgcacgctaaacaaaagcgattgttacgcttgtgcgacaggtaggccagaaacccaaactgtcccctttccacttgattgatcctctgatcaaccgggcatgaactgtatggtagccctcttccaaaatcccacagcctggggcagtaaggcatgtcaaaccctcttgctgctattcctagaagtgaaaagccctgcaggtcggcccctgagggctatccaaccccgtactacaaatatcaatttcacctcgtgtctctcacggcaaggggaaaatttggcattccttgggagtctaatgggatgcagtgaatctaagccttttcaacagctaaccaatcagtctgcccttgttcatccccaagcagatgtatggtggtattgcagtggaccactattggatactctgccaagtaactggagcggcacttgcgctctaatccaattggcaatccctttcactctggcatttcatcaactaagcaaaaaggacaatcgtgaaaaaagaagtaccccccacgggtcctttgaccctcacatttatatagatgccatcagagttccacaaggggtgccaaatgaatttaaagcccaaaatcaaatcgctgcaggatttgaatctgtattgttctcgtgggtaactataaagaaaaatgtaaactggataaattacatttaccataatcaacagcagtttgtcagttatactaggaatgccattaaaggaacagctgaacaattaagttctaccagccagatggcctgggaaaacagaatagccctgaacaaaatattagctgaaaaaggtggggtctgtgtcataattggggcccaatgcttacagagccttaacaccctagcaaatgaattagccaaaaattctaaaatagaattctagaattcttctctagtctcacggaaaaatggtttagaaaatggaagggactcataacctttactccccttgcaattattataggtgtactcattcttgtaggttgctgcatcataccttgtattcgtggattagtgcaaaggcttatagaaaaagccttcaccaaaacccctcatgattctcccctgccctactcacataagttcgtactcctaaatgaccaagaggaacaacaaatctaaaatatgttaaagaaatttgaaggggaagaactataaaatcaagagagggaaactgttaaggacagtaagttcctcttcaaagttcccttggtctcttgctctgtacacagcccttcctgcttgatctgtaacgagcacttgttcctcagcttaatctgtaactagcaaacctcttactccgtaaacatctctgtcacacccagacatgtccaaacaccccttaaacttattctgtaggcaactcttcccaccttagcaacagacagtctctccctcccctcctctcttagcaaactgcgtgttcaccatatttagaaaggtttaagtcttagccaattgggttaatttagattgtttggtccaaccctagccaatggggaaaggacacagaaacaggaactgtgttaggaataaaaaccctttggccgggagcggtggctcacgcctgtaatcccagcactttgggaggctgaggcgggcggatcacgaggtcaggagattgagaccatcccagccaacatggtgaaacttgtctctactaaaaatacaaaaattagctgggcgtggtggtgggcgcctgtaatcccagctactcaggaggctgaggcaggagaatgacttgaacccaggaggcggacgttgccatgagccgagaccgcgccactgcactccagcctggtgaccgggcaagactccatctcaaaaaaaataaataaataaaaatcctctcttttgttcggtgtgctctcgcgagcgtgactgatgcaggcagcacccttctgtagaagtaaattgccttgctgagaaaactttttgcctgagtgctagttcttctttgcggcaccgagcacttgtttctaacactggttttttgtttgagtttttttgagacaaagtctcactctgtcacccaggctggtgtgcaatggtgtgatcttggctcactgtagccccaacctcccaagctctagaaatactcccatctcagccccccaagtagctgggactacaggcatgtgccacaacacccagctaatatttgtatttattgtagagacattgtttcaccatgataccaaggctggtcttgaactcttaggctcaagcaatctgcctgccttggcttcccatagtgttgggattacaggtgtgagccaccacgcctggctgaaaagctgtttttaaaaatcaaaaaacaaaaaaacaggcattctgatctctagccagattactgccaatttaaaggacaatttgatgtatggttcaaagaggtcaacaattcaaaataaaatattttccaatttggtcaaggggtggggacgggcgggaagctggtcagaaaaaaaaaaaaacagtgactttttacatttaccaaaaaaaattagaatttttttcttgcctgccttttaaaatttcattcaactctactattttctggacatctcacactagtttcaacttaagattaagtctcatcaggcagttgacctgtagagagctgtaagtgttacttctctcctacaaaaatttttacaaatcaaactatcatgggatgtaagttttgaaaacacaaagtttcttagaaataaaactattactttatgataggacagataataaatgataatctggtccttaatctacctgcactgtttggagagatatggagtcaataatctccctatgttataggagttattaagaaattattttaggcagatagagaagacaaggggtccttggcaagtttcttttcttttaaggcagctccagatacatttcttgcatagcagaaaaatggcctgaagggcgggccagcaagctttgatatgcaaatgccagccattagaaactgggtccactcaatatggcaattcccaccttcttcttgtcactacaagtgcctagcatcatggccacccccacatatccccacgtgtgtagaacatcatggtgccctgcatttgcatattaaaaggctagggtgggaggaccagatttttgtgggctacatgaatgacatacctggtcaacccaatcccctggactctatgcaaatcagacaccagctcctccagcctcctaatataaatggctgttttctgctgcactcagggttccctctctcagcttggagccccctccctctgtctctgtatgggggagccccttccttctttcttgccgatttattaaactctctccgctccttaaaaccactccacgtatatccatgtcgtcgtatttaaactggcgtgagaaaaggaccctggtattcccctccagtcatcagagtcgtatcattttggtgcactggccgggaatccgaggtacaacattcactgaagtggtgattatacaagcgagcttaaaatctgttctatcattctgaggtgctcttggcctctattttaaaatcaaatcaaatcaatcaaaaggcatctatctgtctgctggttagctacacttatcgttggctgctgttctaaagactcagatgtgaggcttgctggtgagaacatggagaaccccccaatacccacaggtgattgggaatgttggccgtatttcgaatcagcttcctttcatggggagacctcgccgttgcgcaaggctgggaaaagttctgaggcaactgagcatctctgggcagggcacaccctggtgtgactcaaagacctctggaccagacccagcctccaacagcccatttcaggtgctggcagagaatcctcagctatccggtcatgaaactttccttccttttctatctgtggtctcttactctgtgtgtatgtgtcaactgtgtgggaatttagtaaccgggagtttaactcaagaatgccattgcaatctcctgaacagagggttcctccgggacagtgagcctctctctctcagccccttggtctggagagcacacggcatttccaggtctctctaccgcttgtctgaggagcacacagtatttctaagccaacagtgccacctagaggaaacagaaatcctctacatgaggcactttttttaatgctaacactgcagcttccttttgcactgctagaaatcaggctctaagcctcttccaggaatgggaaaattctgctttcaacagttagaaattaaatgtcttccatagccaaattttagtctcaatattgtcccatcagcaggaaaacagccatttggttcctacatttctttaagtcacctattctgtctccaacagagacagtacttaattagtaaggggattttaagtctggaagttaactgaaaccatttttctaagggtaaatgctttagcatgggccataatagcaggatatagagttcaatctagcataacccctccattaaaggggccttccccaattacacagttttccctgagatccatttttttttagggaggtacacaggtcacacaagtctaggaggtcaaagggaaataacaagcagaggactgggactacttgggtaagtgtgactaggcctcaaaagtctagtttctctggtgccatggcttggagggtcacacctacagccacaggcggcacatttaactgggtgccgggacccaggaaccagggagggagactagttagaggaatgccccctactgttttcttctccaccctgagtcatacaccaaaaggaaggagactaaaaggacacttttattctcacttctctttctagatggccaacagatcgtcttcagcatgcactcctctggaatgtattttaaagcactgggactccttcaaccctgagactttgaaaaaaaagtgactcatattctattgcacaagagcatagccttcttactatcttggggacagataaacctggcccgctgcggggagccttgattttaatattatccaacagttagatcttttctccaaacagaagggcaaatggactgagatcccctatgtacagactttctttgccctgtgaaacagcccagacctttacaagttctgtacaattgacccagttcttttagcggccacagggaatcgttccccagagctaaagcaggttccagaggagcaatctgaaacagctattgaatgtcccaatccttccagtccccctccaatcatactatcagctcctccagctccactatctccagtatatcctactctccccgcttcattcttacctctgcaggaaatggctgataggaatggtgccatgagggttcaagtttccttctcattacaggaccttaagcaaataaacagagacttggcccaattttctgatgactccgataagtatatagaaattttccaaaatttaactcaggtgtttgatctcacatagagggatgttatgttgctgctaagtcagaccctcactggggctgaaaagccagcagttccacaggcagcagaaaaatatggatataagcaacatgcctcctgtagcagaccaaggagaaaaagaggagacaaggaaggtaaggaagaagtggaaactccattcccactaggaagggaagcagttccagcggacaaccctgattggaaccccaataacgcaggaaatgaatggaaaaggaagcacttcttaaggtctatgttagagggcctatggaagaccagggccaaacctctcgattactctaaactatctatgatagaccagatgagaatcccacagcctttatggaaaggctaagagaggcactaataaaacacacctctttatcatgattcagtcgagggacagctaatcctgaaggacaagtttattacacagtcagctcccgatattggaaagaaactacagaaacaagctataggaccagatagcaccctagagaacctcctgagaatagccacttcagtcatttacaatacagatcaggaggaggcccaagaaaaggaaaggaaatataagtgaagaacagaggctctagtagcagcattgcacgcttgtaaagtccaggatccctgaggtgcatctgctagctgttatcaatgtggcaagtcagggcattttaagagggaatgcccaggcagcaagacgaagccaccttgaccctgtccagcctgtggcggagaccactggagatggatctgcccccagaggcagaggtcgctgggttcagaaccagtctcatagatggtccagcaggactgacgggtcccgaggcttaaacccccggctccagcgactcagactgccattacagcacaggaaccctgagtgattctggaaattgaaggaaggaaggtagatctccttctggatactgaagccagtctcttgctcctcctctctaattcaggcctcccctcttcccagagcacaaccataaggggtgtatcacgaaaaactctaacccaatatttttctcaaccccttttgcagatggggagacttactatttaaacatgcctttttaatcacgcctgaaagtcccactcctttattaggtagatatattctagcttgcatgggggcctgcagcatctttacagccccaggacaaactctatctccccctgatggaagctaacattaatgtggaagtgtgggcaacttaaggaagaataggttgagctataaccactacgccagtccagatctatcttaaggatcccacttcttttcctaaccagagatattatccctaaggccagtggctaggaaagggctagaagccattattaataacctaaagatgcagggcctcctcaaaccctgtaatagcccctgcaacaccccaatattaggagcacagaaacccaatggggaatgaagcctggttcaggaccttcgcctcattaatgaagctgtagttccaatccatccagtggtccctaatccctataccctgttaactcaaatacctgagggaactaaatggtttacagtcctagatttaaaggatgcctttttctgtacaccgttacatcctgactgtcaataccggtttgccttcaaatattcctccagccagacgcccagttaacactgacggtgctgcctcagggattttgaaatagtcctcatctgtttggacaggcactgtcacaagacctctctgagttctctcaaccttaagttaaggtcttgcagtatgttgatgatattctgctatgtgccccaactgaggatgcttttcaggaaggcactgaagctcttctcaatatgttagctaacagagaatataaagtttcaaaacccaaggcccagctctgcaaaacctcagtgaagtacacctaggcttagtgctgtctgaggggaccagagcattagggaaggagggagttgagaatatttcttcctttcccctccccaaaaccctcaagcaactcagaggattttggggcattacaggattttgtagactatggatacctgggtatggtgaaataggctgtccatgatataacctcataaaataaactcaaggaactaaaactcatcttttaacctgggaatctgaagctcaaaaggcctttgaccagctaaagcaagccttgcttaaggcaccaactttcacccttcctatagggaaggacttcaatctgtatgtatcagaaaagaagggaatggccctgggagtattaacacaggcccaaagaccaggccaacagccagtgggttgcctaagtaaggaacttgagttggtggctaaaggatggccagcatgcctccccgccattgcctcagtggctctgttggtcccagaagcctccaaattaactctggaaaatgatttaactatttatgccccacctaacgtggcaggactactgcacttttgggggagcctttggctaacagatagctgacttcttaaatatcaggccctgctgttaaagggttccaacatccaattaaagaattgttctcacctaaatccagccgccttccaccaggaggaaactggggaatctgagcatgactatgaacaaatcatagtacagacctatgcagccagggaagatctcaaggaaactcccctagagaacccagactggaccctcttgacagatgggagctcttttgtagaacaaggaatctgtaaggcaggatacacagtagtcactctacatgacatcactgaaagtgtgtcactccctccaggcacaagcgctcaattagctgagctaatcgctcttacagaagcaattgaattaagcaaaggaaaggtagctaacatttacacagactccaaatatgctttcctggttctccatgctcatgctgccatttggaacgaaaggcattttcttaccaccgatggatctcctataaatacctccaggaaattaacaggttattatcctcagtttttcttccatgagaaatagcagtgatgcattgtaggagacatcaaaagggaacagatgaggtagccaaaggaaacagattagctgatcaggcagctaagtcagcagcaaggaaggctcaagacaacacacttcaaacccctctaatctgggaaggctccatgagagaaattaaacctcagtactcccccacagaaataggatgggccacttctcgagggtatacatttcagccctcaggatggctacagtcacaagatggcaaactccccttgacggcctccagccaatggaaagtccttaaagtgcttcaccaagcttttcacttgggagaggataaaacttatcaatgtgcccagagattgttttcaggaaagaacttactaaaaacaatcaagcaagttgttcatgcttgtgaagtctgtcttaaaaataatcccctgaacaggcgactccttcctcctcaaacccaaagaacaaaaagatacccaagggaggagtggcaggtaaacttcacccacatgccaaagacaaagggcattcaatacctgctgtatgggtagataccttcactaactgggtagaagcatttccatgttgtacagaaaaagcctctgaggtaataaaagtattagttaatgaaataactccctgctttcatctatccaagtaccttcaaagtgacaatgggccctcatttaaggcagctgtcacacaagggatctcaaaagcactaggcatagaatatcatctccattgggcttagagaccctaatcctcaggaaaggtagagaaaactaatgatattaccaagagacacaccagaaaattgtcccaagaaactcaccttccttgggtcactcttcctcccacggccttactacgaataagagataccccttgaaaattaggtcttagcttttttgaaatgctgtatggacacactttccttaccaatgatttttctattagatcgggaaacctctgagctagttaagcatgtaacctctctggctcacttccaacaggaattagcacaattagcgaaaacccaatcccaggaaattggaccacctctatttaacccaggagatttggtactggtaaaggatcctcctctctctctcccttcctaagcccaacctaggaagggcctcacactgttcttcttccaactcccccaacaataaaaggtacaggaatcgaccgactcctggaaacatcacactcaagtcaaagcctggagagctgagggagcaacccccaacagcccagaggaacgtcctgaatagcaatgtgaagaaatggaagatcttaagctgaaaatcataaaagataagtaactatatgagaactaatcatcttattcagtctcacccctacctcaacaaatactttttgtcatttctacctctccttttgagccaaatatcagaacttctttttggtggaaattatttactactccaaccttgcaggaattgctatactcactctgctatttgcagtagaactatatactgtagcaccctcagggtggaatgtcagagagagaatctcaattactactgcattttgcttaattattaacctcacagcaggaataacagttactaacaggaagtaaacatgagcattttactatcactaaatctgttagaactctttattggacttagtaatacgtcgcaccatctagctcctacaatatctgccatggcccatttgtacagtaagactaattgttgggtctgtcctaagtggttcgctcagttcagtgacactaaggaaccttatagttacccggaactcaccatcttaggattccctttgttggctttacctttaacccttaaagacttatcaggcataaatgggacatggtatgggaacactttcaattgggtgactaactcttcccaggagaacactctgccccagcgccaaagaactttctcccaaagataagcttcacaccctcaggcttggaaaagttgatggagtaatagcaaatgcctccctctgctttaaaagtagtggggaagaaccatacttgggagtaacatcacacttgtaattgctgatagttcaaagatttgaggagagtgcaacaagggtgatatacaaggatagaagccctagtggggggctttcagaaactagtctccttctggttggaagtaccgatgggagtggcatgctctaagtaaccaacttgactataatgtaaaaaataacacatgggtctttccaaactcccccccacccatggaattccagacccttgtatgatgtttgctaacagtggcggcttactgatctgagggcgaactgaagacatctggactgacaccccttgccacaagaatcatctgagatattggccagggcatattacgtctctaatttttcaaaactccatttgtcaggtggacccttttcacttggcatgtcaaattccaaatgacatcgtaaatgactaccctaaatatggttatctttatcccaaggatgcctctattatatgtaaagaaaggaaagttctaagatatgagaaaaatctgccagtgtctctcacaagccacaacttagaaccatcccttcaaggaacagggctacattttctttgtggctcctggatacacttaatcctcccaaggcattagaagggaacttgtactatagctgcagtagttctcaacttattaaattctaccaagatgacagcatcatctggggacatccctaacttagcctcttttctagaaactgcactattctgaatacatcggacaaagggatctatcatttctatgccctcatatggagatttaactgaaagggcagcctggggagggcatgcacatgacaatctcatcttagaaaaagcatggatgggaaattctatagccagaggtatattctggtttatgggcatcccctctccttgaaagatcaatacttaatatctctattataatgcaatgaggatggaaggcaactgtatgggccatagaggcacaaccacaatctatagactctttagccttagtaggtagtagcacaaaatcgacaggccttagatgtccttacagctgaagtgggaggtacctgtgcacttttaaatgcaacatgctgcttctggattaaccctctagtagattaaggaaaatctacaggtacttaaagatcaaatcaaaattattgacaggctaagagaaaatgaaggcttcagccccaggtgactacaatccctctttaatgaattccagtcttctttatggaattggttagcccctttattaagctccctcttgcttacatgtcttacattaactcaatactataactcaatactatataacttgtataactcagtactataactagaattgtttcctatcgcctagaagcaatcaaattccaagtggtgttgcaaaccaaaccacacatggacatgccattcttccgaggatccttggatctaccccaggaggagccctagctgctgttccccattcaatgctccttttcagcaggaagtagccggaaagagtcatcacccaaaaccccctaacagcagttagggtgacatctcctccgggtagaatgttataggagttattaaaaaattatttggccactgccctcactgccgctgctgctgttgacctcgccagggctgcttcgtctccgaggtcagactgctcccaatgccatgaacggagacagcacctttgcaaagagacccagggatgatgctcagatatcagagaagaaacacaaggccttcaatgatattgccagatacttatctaataaagagtggggaaagctgaaaaactcagagaaaatcacctatgtgtatatgaagagaaactatgagaccatgactaaactaggtctctaggccaccctcccaactttcatgtacaataaatgggctgcagaattccaggggaatgattctgatatagactaaaactgcaggaatcaggatgaatatcctcagatggctttcggcatgctacaagggaactttccaaagatgatgcccaagaagccagcagaggaaggaaatgatttgaagggagtgccagaaacatctggctcacaaaacaatgggaaacagctgtgtcccctgggaaaagaaagtacctctgagaagactaacaagacatctagacccaagaaaagggggaacacgtctggacccacggactgcgagagagaaagtatctagtgatttatgaagagatcagaaaccctgaggaagatgacaaataactcccctcagggataggatgcaagcccatgatgagaagcagaaactggtgaccttctatgaacatgggcatggctgcgaacccctcatcatcaggtgtatagcaagtgaaagcaggagttcacgacagtgaaaagttgagcgtcatttttcttacagtgtgccaagagttagatattagcattttcattgtattttcttacagtgtgccatcctgttagatatttgcatttttgttgatgaatgagacatagttaatgcatatttctgtttgtgtatccatgcacctacctcagaaaacaagtattgtcaggtattctctgcatagaacagcactaccctcctctctccccagatgtgactattgaggccagttctgggtgtttcagattttttttctctgcatttacacacacacacacacacacacacatacacacgtggaataccactataaatatctccatctgcttttccccatcgctaatgagtcctggtcaagcccccctcactctgtttcctgttcaacatgcactccctgctgcaaactcccctcatctgattcccctgtgttggtcactgccagttaataaacatttacaaacttaaaaaaacagataggacaaggggtccttggcaaggtttttttcttttaaagcagctccagaaactttattgcctagcagaaaaacagcttgaggggctgagccggcaagctttgatatgcaaataccagccatcagaaactgggtccactcaatacagcgattcctgcctcaacttcttgtcaccacaagtgcctagcatcatggacaccaccacatatccccatgtgtatagaacatcatagccccctgcatttgcatactcaaaggctagggtgggaggaccctttttttggcgggttaagtgaatgatatacctggtcaaaccaatcccctgggcctcaaatcagacactgcctcctccagcctcctaatataactggctcttttccacactcggagttccccctctcagcttggagcccccctccatctctgtacaggagagcctcttccttctttcttgcttattattatttgtgtatccatgcacctaccccagaaaacaagtattgtcaggtattctgtgcatagaacatcactaccctcctctctccccagatgtgactactgaggccagttctgggtgtttcttggtattaaactctctctgctccttaaaagcactccacatgtgtccgtgtcgttttatttaaaccggcgagacaaaggaccctggtgttcctccggtcatcggagccatatcacctacattcacgattgtgtgacaagagcccttccaggtccatgggttcttcacacatctctaaaatcaattcagttcagttcagctgggtaagggtccagcaatcacactctctctaccaggctgagaagcaaaatgatggcaaaaatgaatgaatgaatgatatatactgaaggtaaaactgaggtccataaagatacaaaaatatgcctccaacaattttaatttctgcaaacttactagagctgaggcaggagaacagggtctggaggcagggaacctaaggccaattcacgctgacttcctagaactaaattaagatgaaaaccccaacttttcacacccaagtaacaaaagtaccagaggctactactccctttgcaaaggccccctcccaccctgccttttctgtgtggcagatgaaaaactgaacgtacctctgattggtcccctcctgcaaccaatcaggctggtcatgggccaagtcttcatttgcatagaagtgtaattttgtaacttcacttcagcctctgacaggtcactttccacaaccaatcagacgtctgcatagggtgtaactttgtaacttcacttcagcctctgattggtcactttctgcaaccaatcagactgatcatgggacactacttcatttacatagggtgtacacgaagtaacaaaatgggaaacctctagagggtatttaaaccccagagaattctgtaaccagattcttgagctgcttgcttgagcccactcccaccctgttgagtgtgctttcattttcaataaatctatgcttttattgcttcattctttccttgctttgtgtattttgtccaattctttgttcaaagcaccaagaacctggacaccctccaccggtaacagagctataatgacattatacatcatgtttaagaatttatgattcaaatatttaattttcagcaataacataaattaacgagaatttagagataaggaacaaagttacttgatttacaaaagaatgtaaatcaaattgttttgaatactgccttgaaattacgatttcacaagcaaaaaagttctttgtataacctctgacctgctaccatctataaataaagaactaaagtacaaagaggttaaattacttgaccaagaacagagctcaaaataaaatcctagtatcctgtttctcaatctagtgttacctatattatcctacactatatctctcagggcttttctccctttggattctgccttccaaatacagacatctagcaccaatggttaaagaacagggcttggggctaaacaaacagactaagagaaactcgtctccaccacttgaaaagctatataaccctgaatacattaacatcctctaggtctttttttttttttttttttgatcagtaaaaaggagataattgtattttacctcaaaaggactccataataaaagaattttaaaataagttatatataatgtgtaacatattgcaaaattttatgagagatattttctgttaattttaaggctaattgaccaaataattcactgtcatatctggaagtgatgttatttgaatatccattatcagagtcctgaaagtttcaaagttgcaaaaacatagtattattcaccaatgaattgactgttaataaaaagcagaacaggctagaaaatggttgaaatatcacctaccttatatataaaatgggtttataattgtaccacattaaattttttaattaaatgaaaaatttatgcaaacctcttatcatgatcatgatgccctgtaaataaatagtaaatgctcaataaatgttggtatcattattaccaaaaggttaaaaaggagttctctatttgcttaaaaatagtaccaagggtatacgtggatgagcagaagtaatggctgaaataagattgtcatgtattataattgtataaatttggtgtgtacaaatataggttaccacttttgccttctttctactttggtgtatgtttgaaattttatggaaaaaaaagaaaaagatagtgagaacaagaagatattttacattaagatgagttgttttaaagaaaccattcagcaaagtaaactaatgaacaaatgaaacctaatcattgtaataaaatacataagcaaggaaaagagacagagcccctgggaagttttcatattgtccttcaaaattagtagttgcctacagctgggaaaatagagggtttgaaggataatggctaaaggggatataatttctttttggtgtaataaaaatgttctaaaattgacagtggtaatagatgtatgactctgtgaatatactaaaagtcattgaattgtacacttcaaacgggtgtatggtataagtccattactgtactgctataaatacctgaaaaagaatttaaaaaaaaaaaaagaaaagaaaagaaatatcgagcctgaggtttttataaaagaaagaggtttgattggaaggcaaagcaggagtaggtgtcttacatggcaggaggaagagagagaggagagaggtgctacacacttttaaacaacctgatcttgtgagaagtctatcacgagaaccgcactagggggatgatgctaaaccattcacgagaaactgcctccatgatgcaatcacctcccaccaggccctaccaacattggggaatacaatttgacatgagattggtggggggaggggcagcgcatcgcaataatgctgtttaaaaaaaaaaaaaaaagtatggtcttgatttcccaaatatctccgaaatcatctagttgtctttttcctgtctctttttatgaacaagtcaccaccagcttctacttcaacagcaagtggtctcctaccttccagttttgttttctgggatgtgatccatcctcaacacatcatccacaatgttcttttacttcccagcctttgaccaagctactctctcagcctagactactctcctcccaaaccccttttaccttgctggttcctactcacctttttgggcctcaacctaaacaacatttctgccaggagtcttttccctaatcccctggacttctgtatgtccctctgttgtctatccctaccaccctgtgtacttcgcctatcgtaacgctcctaactatttactgtcttctcctctagacttcatatatacaatgattaggggaaatgtctaattcatacccccagcacagtgcttaacatgcaacagacattcaattaatattggctaaacaaataaataatccaacaagtccttatctttataaggcttttgtttttacacaaaatgaagatagtgtaccaaatgataacttgtttcttcctttctgatatatatccacaggatgacctcaaaatttatagtattcaagagccctacgatttctcagtaaaaacaaccaactaatgaagatatgattaaattgaagttcatttttatcagcccctatttaaaataaaataggttaattagataagaaaattatctctaatacaaattagctgttgggaataatcaaaagaaaaaacttaacactatctgtacctttttaaaataaaatacataagtacacttaaaaatcagcccaaaacagacattaaaaactatatttaagaactcgccgggcacggtggctcacgcctgtaatcccagcactttgggaggccgaggctggtggatcacgaggtcaggagatcgagaccatggtgaaaccccatctctactaaaaatacaaaaaattagccgggtgtggtggcaggcgcctgtagtcccagctactcggtaggctgaggcaggagaatggcgtgaacccgggaggcggagcttgcagtgagccgagatcccgccactacactccagccagggcgacacagcgagattgtctcaaaaaaaaaaaaacaaacaaaacaaaacaaaaaaaaaaaacctcaaatttttgaaaaagataaatgaattgcctgagagcctgcctatcaggagccacatgatacaggagagaaagactgtcctgaggaaggttacgagccaagcctaagcaaaaagtaagtttcttttttttgcctcaaggtcctatactcccagtttcctcttacaatccctctgtcactcaactctggtcccacagcaagattatgctatgtacaacaagtgctgcatacttcaaaaacaacttcctcaaactaatatctgtggcaacagtagctatttaatggcctccaggtctcagcaaagaaatcctaggaaaacactggggatcagctatgtaccttatgttacaatttggtagcctggtagacacatctatcctcattgtcgtagatctatttccttccaacctggaatttgaaactccatgaacaaattacaacagctaaaaagtggtgctgctaatgttagtgtctcaatttagcattatttgaaatctcaaaataccctggctaaacgaaaattcctcaatggtaagtctagaataattttctgtactagaatcccttcgctgctgagattctcatgtaatcctctcctccatgtttatctccctgcaattctgccattcttggaacacagtaagtattcaataaatatatataagtgaataaatgaatgaaccttctaaaagctccaggttaaaaaggaagaggcaaccaccacctcaaatatctcctaaaagtaactaacagtgtcgtacatataatgcatgaagtataataagtgtgtaaattataaggtatatttgtcaactcccatgtagcatgtaaattgtgtcattatttaatatgtacactgaggtttttacaataatcagtcttttaagaatttaagtgcattcacacatttcacctaaaaattatcacaacaaaccaaattaatgcagcacttcatgccacagtctcaccaatcaagaagaaatgcttactccaagccaaatagtaatagtaataaagttgaaggcagctaactaaaatatgttgtagatacaatctaaaagtaaaattatatttgataatacacaaatttcatgtacattatttagaaattaatataattatgtgacatggtaattctcagctgggtgttgtaataaaaggagataaacacattttaggttattctaaaatgtttggaatttagctagcatagatttgtttaattttataaatgagaaaaaaatgaacatcttatagacctgtggttaatggatgaccccaaaaaattatataatcaaagaccaaaggataaaaaacatatctgcttgacacggatatgacataatctgatatatggcatgttttaaagttgctattatattataaatatcaacctattccttatgttctgatgcaggttattcccaatattcagtaatcttccacagtggttattttcctgagtgctttacaataaacagataagccatgaggcaaacccaacaatgaaaaacaatgtttatcaactacaagactcaggacttggtaagcacacttaccaaagaacagataaggtaaagaacaaatagctcccataaattaaaaatcatgaaaacttcagaaagacatgaattaaggaaggaaagcacacactaattggaaccaagcgttacatcaacacacatagcaggctttccttctaaatagtctttattatgcctgctaaaactacttatattcaggtaatatcttaatacaactgatttttttaaaaaaaaaacaagagtacctttccaggcaataataaatgcaaccagtatcattcattaccagcaccaatcactcaaaccacaattctaattcattttccacagaagtctcgatttcctgttatttattgtaagtcttccagcagtcttactattccttcttatttttatccaccattccttatgcctctttcctagaactatttgccctttgatatggtttggctgtgtccccacccaaatctcatcttgaattgtagttcccataatccccacatgtcgtgggagggacccagtgggaggtaatttcatcatgggggcggctgccccatgctgttctcatgatagcgagagagttctcatgagatctgatggcttcataaggaaatttttttccccctttgctcgaaacttctctctcctgacaccctgttaagaggtgctttcccccatgattctaagtttcctaaggcctccccagccatgtggaactctgagtccatttaacctcttttctttataaattacccagtcccaggcatttcttcatagcagcatgagaacagagtaatacacccttgatcttgaaactctgacactgctttatctatgtagaatagcttctaaataacagtacctactaatcatgccttaaactcaggattcttttccattagaatattctgtattctgactatataacataccagtgcaatcactcactgtttcatacattaataaaaaattgttggggaaaaagagtcaaagttcagcttggaggtaattgcaagaactaatgaaagtaacaaaaattttaacatatttacatcaacccaattcaaggaaaaagtgaaaatcatactctcccatctctgaaagattatagaaacttatatttaacatttgatgaattactcagtgagaaaaacaaggatatttgctactgctaactaaattagttttaaattaattcaaagaataaaaagaaaagacagttttctaaatagcaatagaaaaggtgagtataaaacaatgcacaacaggatcaaagggtttctggagacttatgaaaaagataacgactatagtcatctattcagtggtgtttttcagttcttcagctagccattgtcatgaaaaaggcagcataccagtctggataccgtgtggggcctagtctgagaacaggagagagttattttttaagctctcctcagccaaactgaggaaggctagttcctgactggacccaggttaataccgtaatactctattgaggttgaagtcagtgactataagaagattattgagttttgaagccaaagcttcaaaaaataaaagagtttgtctgtgaatctcaagtaaatttttgagaagtcatgacacaggaacacagttttaaaaagagtatgatttgcttacagcagctttacaataacactaagaaaatctcagagcatctgttcttcaacttctcaatcctcattccccacatcattcttccctcaaaaagttaattttaatgtttattaatgagaccaaacagctagaacacatttttaaaaagatctccacgcacttctgatttattctcaactcaactttgttcaattactgtccagcacttttttaatgattttctgtttaaccacgtagtgtgtatagagggtgctgtgggttgaattatgtcctccataaaaatacattaaaattttaacccctagaagctgtgaatgtgaccttatttggaaatagggtctttgcagatgtaatccgaggtaaaatgaggtcatgctggttcagggtgagccctaagtccacttactggtatccctatatggagagagaaaagatatgaagacagaaagctcagggaagaaggacatgtgaaggtgacaaagactggagttatggtgccacaagccaatgaataatatactaaggactgccagtaagcacccgaagctagaaaaggcaaggaagaattcttccctagacccttcagagggagcatggccctgccaacaccttcattttgaaccttatagtctccaaaactgtgagaaaaaatatttttgttgtttaagtcctctagtttgtggtaatttgttatagcagccctaggaaactaatacaggggagtagaggttaacagttctgaacctgctttatacacatatactggggactgagcaaacaagtaaatggatggtagatggtgggaggcttctaactgttggagagggaagttatagataagcaagggagaagggctaaaataaatcctgctgtctggattagagtcaaagacatcataaggaactcatgtttggctcaatactaatactgacgaataaacagataaataattctagatatatgtgtaattataggctaatatacatacctgcataacctagccctgtcctctgaaagggcctaaaagcaatgacaacccaataataacaagtatgtccagcacccagatcttggtttctgaataccactctccaataaaaagaaccagagctcattggtgaaatgattgattcaagggctaaggtaggactaagatgaacatggagcattttgtggtacccaaaagtaaggaagtgctcaaaaaacaaaaggatggcagggtggtgtccatgtcaaagtgtcaccagaacaaccctgaaagagttctcaatggcaaaatttgaacaacaaaatattattactaagtcataatcaaaaatataaaacaaattcacatagtctatactggcataaataaatgattgaataaataaataaatgagagagaagaggttactttcttacagaagaattccaaatcatatatataagtatttagtcctccaggatgtagaacttagtgcctctaactcctattttcagtgtgggcaggactcagtgacttgcttccaaaaaatagagtatgattttaaaaaataatagaaatggtaaaatactgttttatagaagagaaacctggcaaacatatcttaaacaagcgaccaaggtaaatatcactaatgatgtcgaattattattatgtacccctgatatgatatgatgaaaagaatattttcatatctgtagtattcttgccaaaaacttacaaccacagtctaatcatgagaaaaacgtaagacaaatctaatttgaaagacatctataaaatatttgactagttctcctcaaaactgttaaggttatgaaaaataggaagagaatgagaaaccgtcacagaccagaggagattaagaaaacattacaattaaatgtaatgtggtgtcctggataggaaccaggaacagaaaaggacattcatagaaaaactggtaaaattctaataaagtctatggttaaaaaataaatgtgtacatataggagtccacattgatataaataaacaattaaataaatggaagagaagtggaagtggcaaatatgtcttaaagaagaattccaaataataaattcacatattctccctcacaggagatggagttaaaccctccgttcttgacttgcctccaaagaacagaatatggaaagaagaaaatttgttactatacaatgcagagaacttgcaaacctagtactgcctgtccctgagccttcctgggggtgtgtgtgtgtgtgtgtgtgtgtgtgtgtgtgtgtgtgtgtgtgtgtgtgtgtgtgtgtgtgtgtgtgtaacgccatggagcaatctcagctcactgcaacctccgccttccaggttcaagcaattctcctgtctcagcccctctgctgtaggtgggactcaggcacttgccaccaggcccagctaatttttgtattttcagtagagacggggtttcaccatattggtcaggctggtctccaactcctgacctcaggtgatccacccaccttggcctcccaaagtgctgggattacacatgtgagccaccacacccagccctggggtttttttaatgatataaattaccagtcaagctaccaacctggtccttaatttctctggtgctggctgaaaattcagccccttggggtctgctaacaaactttcttacatattgatctgacaccatttctagaattttgtcattttctccctgccttcagagggttgtcttttttaaaaaaaaaaaaaatcttgagttttagtgggatgccataaaggaataaaattgaggcgtgtgttcaatttgccatcttaccctagaaatttgcttgaatttctttctaggttggtacatatatagctatctaattagttttaactggatataccgtggaataaccatttctccattggtaagcatataaagttgtttcttatttttcactaaacgatgttgcagtgaatattcttatacatattatctttgttcatctgtgtgcctgtgctgagttaagaacatatacactttatgtaagttattcatggttaagctatttagcctcttagtctcactttcctcatttgtgaaatgcagagaacagtgcctacctcatatggttattgtgaagatcaaatgagttaacatgtgtaaagtgcctaaaacatagtaacagctatataggttgttagttattgtcaaattgccctctgtaaaggctatcagttattacagagccgcatttcccacctttgctcaaaccctggttattacagtctactttttgagaaggaagggcaattttattggtaaagacagcatcagcacctcattgtctaaactgtcgcttcactgtgactgagtttgataatcttctttccaatgtttatcgatcaatttcccttttccccatgcttatgtatatcttttacttataaattatgaaatatttgaaatgatatacatgaatatctgttttggggtatcatccttatttatttgagctttttcttcccaaagtgaaagcaagtttattaagaaagtaaaggaataaaacaatggctactccacagacagtgtagtcctatgggctgctggttgcccatttttatggttaatttttgatgatatgctaaacagggggtggattattcatgcctcccccttttagaccatatagggtaacttcctgacgttgccatagcatttgtaaactgtcatgacgctggtgggagtgtcgcagtgaggacaaccagaggtaaatctcgtcgccattttggttttggtaggttttggccagctcctttactgcaacatgttttatcagcaaggtctttatgacctgtagtttgtactgacctcctatctcatcctgtgatgtagagtgccttaaccgtctgggaatgcagcccagtaggtttcagcctcattttacccagctcctgtttaagatggagttgctcaggttcacacgcctctaacatttcccccctcccttttataagagaacccttaatcctaatgattgcagagggatgaagatccatcttcttctgtaacttcttcaggctgaataggggcaatgatattcctgcctaagtatgagggtctcttgcactcagggtagagaggagctcagtcagaaagcaccagtatggtaaggtccattcataactctttaagtttcaacagaaggtaaatgtttaatttatgaaaatattcagtaagcttctcctatattcctacacaaagagtgtaacagcaatatattccacaagagtacagcaaaataagtaaagttattccaagtaaactaaactagaaggttttccatgaactggacaactgttgaaaccaagttgatatggggttgctagctgattgcaatgtgcccagaattagaatactgattcagatttttacattacccatcccacttgttctgagcaacagtcagagatcacctggttggttcacaggaattagttcacagggttagcctacgttgcagaaacaaacttaaaaacaattaatgagactagaatttaacaacaagtgtaccatagtttttgaaacatagtatttccctctccagtttctcatttttactaaagacaaattatggtaagaccgatatgctttataaaacttggcctgattatttgcataaagtgcagcaagaataattatttttgacataagctcttttttaaattggctttgatggaactctgttccatagatggaatttcagataagactttttttttttttggagatatagtctcgcacggtcacccaggctggagtgcaatggcacaatctcagctcactgcaacctccacctcccacgttcaaacgattctcctacctcaaccttctgagtagctgggattacaggtaccaaccaccaagtccaactaattttttgtatttttagtagagatagggtttcaccatgttggccaggctggtctcgaactcctgacctcatgatccacccaccttggcctcccaaagtgctgagattacaggtgtgagccaccacgccaggccccagataagactttttaaaagccaagcccagccttgggtttctaccctcaagtagctatgaattgggtaaattcctctcctcttggggtcccaagataacttggagctcctggacctgatatgaaagtgacactctttacttaccacaggtcagaaatcctgtttacagggactgtgtaggcaaggaatgaggccatttcctcaagggactttaattggctctgtaagtcaagtttaatttcttaaaggaaaacacaccattccagtcaaagccttggtaaaataaccaatttacccaattgtgtcctgttacaaaagaaaacagattcttactgcacctatgcaaataaccatattgccataagttaagaatactcgcaactagtttccaaattctggagaaatcaggtagagagaaataaatatgctccaaagtttgttcataggagtacactcaactgttaaaagctgtaaaaagctcaaaagaagttttcttgactctgaaaaacaaaggatcagcaacattttaagcaaagttaaaaagactaggcttcttcagtttagtccatgtcgttatcttctgttggatagttatgaacattttagctctgagagttctgaaagttttttcctttattctgatgtcataatctccaaagctatcagaaaacttgcacttaagaatacctgctagagttctatagttgattataaatcgccttctaaagaggactaaaacaagacaacaattgtctgtggatagtaaaaagttttaggccagcccctattaaagccacagtagataaggaaatttggttgattttgtggtacacagaattttacataacaattataaataacatacattaagtcgtattagaattataggagtttcccataactttggaacatattccaataacacatttatgcaaatatagtacaatgcaaacaaaacaccattttacatttgataatgcttcctgtatgacttttacaccaaataagccaaatttcacctttatattaatgttctattaatgttaaacccaattcttaataaaattttacaaatatgtctatccaatcttaatcggtttgaccataaggtaagattcttataaccctttacatttttttgtgaaagagcagattagtgctctaagaaaaacctgttgtgcttttattccaatgtttaatttacggaaaaactgagtaacacccctttaactttagtcaatatgttcacacacagaatctctctcaatttttttcacaccatccacaactgttcaaacttttagctttattctaacttaaaataattatttaactctttaggcaaaaaaatccacattcccgtgccttcttataatcttttaccaaaagtacattttattttccttacacaccttgcatatagaactgtttcttcaatagtctcaattacatgttacgatgttaacttttacgtttggtgaaaaccctggttagtaagcaattttaattgtgttactaggacacaccaggcagaactgcagataagaactgactctccagcatagctagggggcatggctaactccacatgtccccaggccttatctagaatctaatggctttacggtaggcaaattgaacagtttccaaagtcaaccagtttgaccttaaagcatttagcaaatctaatatctgaccttaatttagaccaaatgtctacattttcaagacattttattttacctataatttttaaaactgtctttatttccaaaagattactaaagtcacgtgaacaaaaaggcattaaagtttccatttttctgaaaaaatattaagtgcttatttttctaagccaatcaattagagctcttttatacataaacatacaacacatattaatacatagaagattccgcacgtgtaagatttttcattgccagtttcttaagtggattactggcttcagggtggagcccttggaggaaaagcgccaggaaagcatgcgtttctggggccaaataagcagctgaaggcaaagacagatccccaaaattaagggtgccattttatgctggttcctggatccccaaaaggagggaaatactacagaagacagtacagtgcttctactctgcatttcactgcaaggcaacccaaagccaatcagcccatttcgtcatcagcccatccttcatggaagtctcatctcccagtggggggtggggatgtttccttatcttccaggtggccaagagcatacttctccgatccaagtgtgcaaagagtcaagtgcccctccctaactactattagccatcccttaaagtatatttcctacctagttattacacaccaaagctctctcataatgcaaagtaatttctgatacccccaaaactcaaaactgtcagataacacaatgcaaaacagaacacagcctttgattttgagagggatccatgtgcttttaattcctggggtttcatgaggaaaagagggttttttccctaaacagggtctgtggcacttcctctgtttttcccaaggggtcttaggctaccagaagttatcttagggcctctcatgtgtgcattaagagtggaaagacagctgggcaccatggctcgggcctgtaatcccagcactttgagaggccgaggcgggcagatcacgaggtcaggagatcgaggccatcctggctaacacagtgaaatcccgtctctaccaaaaatacaaaaaaaattagccgggcatggtggcacacacctgtagtcccagctacttgggaggctgaggcaggagaatcgcttgaacccgggaggcagaggttgcggtgagccaagatcgcgccactgcactccagcctgggcaacagagcaagactctgtctcaaaaaaaaaaaaaaaaaagtggaaagccaaaaaacaaatggagaaaaataatttagtcgactgaaaagaaaaaacctttttccataaaaacaagttccaagaagagaaaaaaataaaggcctgttaaatatatctatagcttgtctatccatttttacgtaagctgacttttaaccatagtgctctttaaaaaaacaaatcctttcagatctcttattacctgactttagccttcccaaatgaccaatatttctagcttctgaactttatcaaaggtgctgagagaaaggaaaatttaagacagtccacggaggagaagagaatagacaagatcacacagatattaaaccacagaaatgacttacttcctagtggagaactgaaccaggactgccagtgtgaaagtgcaaaatgtcagctactgagctacatacagtaaggggtagtccccatttcctttcccagaacaagtctacagtagttaattttgagcttgcagaggcttttaactatttaatatgatttttagagctaactatgacatgaaccctaaaattcctgttccctggaaaggggagaccaaaagtactgccacgtggttacaaggtcaagctcccaaggacgtaaaacaaggtggagacttcatccagtatttgtgtttgtttcagagacctgcagccaaatttgttactgaccagcttgctggttattcttgaaaagcgggcttacaggtgttctaagcccgtgttttatcctgaagtacccctcaacacagaaaaacaaattcatagcacaaaatacaccagcttaagactagccttagaattcttttttgcattaatcaaaactttacagaggagataaacactgatttttttttttaaccattcagtcaaccgtttgcacagagagagagagaagcctgaaatctgactggtaagaaattcttactcttttgccggcatgccaggcttctgggttccctttccctgagcagccctagtgatccagcttgtggcaccatagccatgggggccaagctgcatcataaaggaaaattttttttttcgttctggccagagcaaagtccatgtgataaaaacagagacattagccactctgcttagcacccaatatcaaactggcaaggcttaaatttgtccccagatgggccccatcatctttaatccaaactccgacttaagagtttcaacacgtggtctctgggcaagatggtcaccctgagtaatagaaaagataggaaaggaaaagtagagaaggaaagtattgcctgtggcagggtggggaaggtgaacagcttagggaggccagagaaagacccacccattgcagcaacactgaaaagttcaggcggctgtttctcagtaccaaagagatcttttccagccagtctcatcagctctcatttccccttttagggaagaaaaacctccccatgtcctacgatcctgtacatgcctaatcctgccacccacagccatagcaaagagtgcaaggcagattaatccaaagagaatagcagttaacatccaatagtgacgagaggggactctaatcctcctaagttgggcctctaacccaaggtcagtcaagcatccttgccttttattaagaggggctccaacccactgtgtcttaggagagactctaactcccctaagttgggcctctaacccaatcccatcctttacccaggtaccccactacttacccaaagttgtccaatcagtgctgcatctatttcctttgggtcgggggtctcaatattgtcccttttgtggttcatgagaaagatgttactagaccccaccacttacccaaagttagcctttgggtcaggggtttctgcagtatagtcccttctatggtcgccagaaatatgttacaggaacgaggtcctgatccagaccccaagagagggttcctgtatctcgtgcaagaaagaagtcagggcgagtccacagtgcaaaatgaaagcaagtttattaagaaagtaaaggaataaaaggatggctgctccacagcctacaggagctctttaggcactagagatactatttcctggtcaattatattacaaatatttgcttccagtatgtgtcttttttattttgcatcttttgtcaatgttcaatttctttaaatttttattaaatgttttgtgacttaagaacatttctgctgggcacggtggctcacacctgtgatcccagcactttaggaggccgaggcaggcggatcacgaggtcaggagatcgagaccatcctggctaacacggtgaaaccccatctctactaaaaatacaaaaaattagccaggcgtggtggcgtacgcctgaagtcccagctactcgggaggctgaggcaggagaatggcatgaacccgggaggcagaggttgcagtgagcggagatcgcaccactgcactccagcctgggcgacagagcaagattccatctcaaaaaaaaaaaagaacatttctgacctaagaatataaaattaatctcttatctcctagatttttatgatttttaaaagaaatcaaaagctctttattccatctcaaatctgaggtagggatctactaccacatttttcaggcctaatacttccctgctgctttaaaatgctgtctttatatcatgtattaaatttccatatacgcatgtgttttaaaaaagtacttaagttaatatgcttgctacagaaatgtgttatacatataaacatgtatgtatgtatatgggggtatttttgccaaatagtggaacagaaattctaggtttttgttttattctctgatttgtttggctcatataccataaattggcagggattttattaattatgtgtgttctttccaacacagaaaaaaggcccccatagaagccttctttactcttaaatgcccatggagatcaaacctaatcctaggcttatcttaatggctaaatctccttggagaataaactaattctaggagcttcaggtggtgtgaattagactatgtgaatcatttcaaaataaaaattattttttaaagaaatccaatatatagatgtttttaggaaaagaaagcaaatcataaaacatgtatgggatgatcagtttatttaaaagcctgtgtgtatgtgactaaatgaacagcaaaaggtctggaagaacatagaacacattaataacactggggacctcttgaaaagcaagaattaaagaaggaaacgaaataaagggagacttctttttttgctccatataatttttcaaaataattgtatgtggagtcaaatttttcaaatccatgaataatatctgaaatatgaatttgcttttaaaacaatattcatctttatgctcttgtaaatgtgtatttattacctttataaatcagaaaaaataagaagaaatacataatagtagttgacattaaggacaagtttgacaatctctttttaagttctttttctcttcattttctttttcacttacacctatatgacaacaggacttctggttcaagatcactgcctgagtatacagacatatattccctccctttcaagacccagtgaaatgacaaaaagtaaagcatggaaaccacaccaatgaacaatatgggaccatcaagcaaaagagatcagaacaaaattcctgacaatagaaaacaaagggcgttaaatattgaagtagaatgtacactacaacctcagaaataccaggtacaaaaccaggattgaaaaaaaaacgtaggtggaaacagaaaccttaactgacagtctacatatccattgtttcattcaacaaaattgaacacccaggacataccagttcctgtcctatgatacaaacaataggcaaacccaaaataaagcagggggcacaaaattgtgagggtggcagtagaaatatcacttcagataagtcaggaaacatttctagggaaaaaaattgagaagagagacgcaaaaaaaaataagggagcaaggaaggagaacaagaatcatttcttaagcaatgataatgatgtaaactgtgctaagatatttaaaaatcatcgtattaaatcatcaccacacatagagttacctccaatttagagatttttttaaaaaatgaggctcaaagaagtcagaaattattcaaggttgtacagataactataataagtaataccaggttttaaatgcagctcaagctcttcaccaaattaataatactaattttatcttctgggaacctacacccatgctaacaaaagccaagtggggtacctagacttctaaacttgccaggctgtaataaagcaccctaaaactgccaccatagtagtatccaagaagcccaagtagggagatagggcctttactcctgtccagcaatatggtgacacctcttcccctcttccccttaggtggtatcagaggaggcctggtagagactgaggactttcaccatcactgagtagtaacaaggcaacccacactgtggtgtcaatggtgataacctgggaatcctggacttccatccctacccagcagtaacaaggtgctcttccttatccctcaggtatcagcaaaggcctcacaggaaattgggacttctatcaccacctggcaataaggagacagtgccccataactttcaactacaagacccaaagaaatccaccgaaaggcacatgataattgaatttctgaaaactgaagaaaaaaaatattgaaatcagccagaaaaaaaaatgacaacttatcaatgggggagggagggcacaaaacaattcaaatgacagcagatttgtcatcagaaatcatggcagccagaaagaagaagaaaaatattttcacgtgataaaagaaaagaagcatcagactagaaatgtgtatccagtaaaattgccctcaaagaatcaaggggaagtcaagacattctcagataaaagaaaactaagataatttgtcattggagatctaaaagaatgaagaatgactattggaggttctctaaacagaaaggaagcaataaaaaaagaaaccttggaacatacaaaggaagaaaaaacacaagaaacaaaattatgaataaataaaataggctttccttcttctcctgagtttcttaaattatgtttgacagttgttggaagtggttttaaatgtatgtagaggaaatatgtgaaactcttttatcataaatgagggacggtaaaggaatataaaaacaggtaagatttctctactccactcaaagtggtaaaaaaaatcagtaaactgtgatacatatgtatatataatataccaagagcaatgtatataaaaatacctaaagcaactactagaagaactatacaaagagagacactgaaaaacacagatgaatccaaatggaattctaaaaatgttcaagtaacccataggaaggcagataatgaaaacagaaatggagaacaaatacaaagacttaagtattaacatataaataattacattaaatgtaaatggtctaaatataccaattaaaagatagaaattggcacagcagattgatgagaaaccacgtcccaactatgccgttacaagtcatttacctcaaataataacatagataggttgtatgtaaaaggatataaaacatatgccatgtgaacattaatgaaaaaagcgtgttagctatattaacatcagataaagtaagctttggagaaaataaaattaccaaagacagagagggacattatataatgataaaagggccgacagaccaagaagtaatagcaattctaaatgtctacacaccaaacaatgtggctgcaatatataaagcaaaaacacagaaataaaaaaatacacaaatctataattatatttgtagactttcaaacactcctctttcaacaactgatagaaaaactagacagaaaatcatcaagtatacagaactcaacataaacaagatctaatcaacatttataggacactcccccactacaacagcagaatacacattctttccaagtacccacagaacatacatcaaatataccatacggtgggccctaaaacaaatgtcaacaaatttaaaggactgaaatcacatgaagagtttctggctacaatggaaaaaactagaaattaataacagaaagacagcaggaaaatctccaaacactttgaaactaaacaacacacttacagtcctgagaagcaaagaggaagtcataaggcaaataaaaaaaaaaaccacactgaactaaaatgaaaatataaaatatcaaaatttgtgggacacagctaaagcagttctgagaggaaaatttataatagcatattttaaaagtggcaaacggccaggtgcggtggctcacacctataatcccggcactttgtgaggccgaggcgggtggatcatgaggtcaggagatccagatcctggctaacatagtgaaaccctgtctctactaaaaatacaaaaaaaaaaaaaattagccaggcatggtgacgggtgcctgtagtcccagctactggggaggctgaggcaggagaatggtgtgaaccaggaggcggagctggcagtgagccgagactgcaccactgcactctagcctgggcgacagagtgagactctgtctcaaaaaaaaaaaaaagcgggggggggggggggggactctcaaatcagtaatctaatctgctaacaagaacctagaaaaaaagaagagttcaacagacccaaagcagaaaaaaaggaagcaacaaagagcagaaattgctgaaattgaaaacagaaaacaaatgagaaaattaatgtgatcaggagatggttctttgtagagatcagtaaaatcaacaaactgctaccaaaactgaaaaacaaggcaggaagacacaaattaacaataactgaaatgaggccaggtgtggtggctcacacctgtaatcccagcactttgggaggtcgaggcgggcggatcgcctgaagtcaggagtttgagaccagcctgaccaacatggagaaatcccctctactaaaaatacaaaaattagccaggagtggtgggcctgtaatcccagctactcaggaggctgaggcaagagaatcgcttaacccggcgggcagaggttgcagtgagccgagatcgcgccactgtactccagcctgggcaacaagagcaaaactccgtctcgaaaaaaagaaagaaaaacaataactgaaatgaaacaggagacatcaccacatagcctgcagacatctaacaaataataagagaatgttataaacaattctacacacataaacttgataatttaggtgaaatcaaccacttcctctaaaaaacaaatgcaacgcatccaatttgaaacagataatttgaattactttataactattaaggaaatcgaattcataattttaaaatttcaaaaattaaaaatctctgggcccactggccaggtgcagtggctcacgcctgtaatcctagtactttgtggggccaaggcgggtggatcacctgaggtcaggagttcaagaccagcctggtcaacatggcaaaatcctctctctactaaaactacaaagattagcccggcgtggtggcacacacctataatcccagctactcgggaggctgaggaaggagaatcgcttgaacccaggagttggaggttgtggtgacccgagatcgcaccactgcactccagcctgggcaacaagagcaaatctgtgtctcaaaaaaaaaaaaaaaattctgggcccagagtgtttcactgaaaattctaccaaatgtataaaaaagaatcagcaccattctatacaatctcttccaaaaaataagagagaacatttccccattcatttataaaggtattatagtattaaccctgatatccagagagtacctgagaaaaaaactacaggacaatattccttatcgatacacgaaaacaatccttaacaaactataaacaaaattcagcaatatataaaaagaattatataccatgaccaagtggcgcttattccagggataaaaagttcgttaaacattttttaaatcaagtaataaaatgcaccaccatatcaacaaactaaagaagaaaatcataaatcaattcattgaggaaaaaaaattgacaacatctaatacctattcatgataaaaaccctctgcaaactaggaataagaagtgccctcaaattgataaatggtatctacaaaaacctacagctaacagctatactactgctacttaatagtgaaaagactgaatgctatatctgtgtaatcagaaacaaggcaaggatatccacttctactactcataaacattgtgctagattcttctagtcactgcagtaagtcaagagaagaaaacaaaaggcacacaaatcagaaagaaaaaactccttatttatagacaatgtgattgtctacattcaaaattccaaggtatctaccaaaacaaactcttagaactaatgcgtgagttcagcaaggtaacaaatacaagataaatatacaaaaagcaaatgtggccgggcgcagtggctcacacctgtaatcccagcactttgggaggctgaggcaggtggatcacctgaggtcaggagttcaaggacagcctgaccaacatggagaaaccccgtctctattgaaaataaaaaaattagctggtggtggcacatgcctgtaatcccagctactcgggaggctgaggcaggagaattgcttggaccccggaggtggaggttgcagtgagccaagatcgtgccattgcactccagcctgggcaacaagaacaaaactccatcattcattcatagacagacagacagacagatagatagatagatagatagatagatagatagatagatagatttttttaaaagcaaatgtatttctatattataaatgtatttctaaacttatttctgtgttctatgtcttaaaacttgaaaatacaatataatttacaatcactccaaaaacataaaatattaagtgtaaatctaacaacatatgcatagaaaatattaaaaactatacaacgctgatgagcaaaataaaaaatctaaataaatgaagaacataccatgttcatagactggaaaactcaccaagaaaagatgttatttctccccaatctgatagctaaacaacaaaattcctatcaaattcctaggaagactttttttgtattcttttttgtgcaaacacaatttttaagagttttacttacagtagcttgattattctaagcttatttttctctttcttcctttttttaaccaaatacccagacttcaatattctaagcttatacagaaaggaaaagaaactagaagagctaaaacaatttgaaaaacaaaacagtacacataataactctacccaaaaagtaaatgggaaaaaaaaaaacctcagtctatgtctcacactgtgcaataaggattaattaactcagcaaaagtctgggtttcccacaccgtgcacgttccgagaaagatttggcccttgcccagctcctaggaagtaacctctaagcccttggaatgtccagcctagtaagaaagtctttctttacctgggggttttaggccactccatatagtctatgctaataatgtgattaatggtgggggccttggaccaaatggtatcagcttgagggctgcagacggaggtcatccatgagggcagtcaaccacacctacataccgacctaccaaaaaaccctggacaccagggctcagctgagcttacccagttttcaatattccacatgttctcatacatcactgctagaagaaacaaactgtgcacatgacttcgcagtgatagaacgactataaatttgggtctggtgtctcctggaccctgtcctttgcttctttttccatcactgatttaaatctgtatcctttagctgtaacaaaccatagccgtaagtataacaactttaagttctgtgattctttatgagaatcactgagtctaggagaagccttggggactcctaaacacacatatataaaaaattaactcaaaatggatcacaaatataataataaaatatttaagaaaaaaatgagaaaatatcttcaagatgtagaaccaggcaaagagttcttaaacttgacataaaaagcacaaaccataaagggaaaaaaccagtacagtgaatttcaaattttaaaacttgtgctctatgaggccagatgtggtgggtcatgcctgtaatcccaacacttagagaggcagaggctggaggatcacttgagcccaggagttcaagaccaacctggacaacataataggaccctgtccttacaaaaaacaaaaacaaaaacaaaagccaggaatggtggtacaagcctgtaaccaaagctacttgggaggctgaagcagaaggatcacttgagaccatgatagaaggatcacagtgagccatgatagcacaactgcacgccagcctgggtgacagagtgagactatcttcaaaacaatgaaaaaaaaaaaacagggagtatgggagggaacctgtgctctgtggccaggtatgacggtatgcaccactacactacagcctgggcaacactgcaggaccctgtctttaaaaaaaaaaaaaaaaaagtccaggtgcagtggctcatgcctgtaatcccagcactttgggaggctgaggcaggtggatcacaaggtcaggagttcgagaccagcctggccaacatggtgaaacgctgtctctagtaaaaatacaaaaattagccaggcgtggtggcgtgcacctgtaatcccagctactcaggaggctgaggcaggagaatcacttgaacccgggaggcggagcttgcagtgaaccatgatagtgccactgcactccagcctgggcaagagagcgagactctgtgtcaaaaaaaaaaaaaggctgaggtaggaggggatcacttgagcccaggagttcaagaccagcctgggcaatgtagcaagctccagtctctaaaaaataaaaataaaaaaaattttaaaaatagtaaaaccttgcgctttgcaggagatacaattaaaagtgagaggtgatgccagctgggcttcctgggtcgagtaggggcttggaaagctgtaaaactcactcatttcctgcatcagggattacttcggttctggataaataatattgaggtataatatatgcttaaaatattcctaacaccaggatttacttatatgttttcttccccaagaaagctataaacagcgagaattttaggtgtaagttttcctgtgtgccctcccccgaaaccagagttaaagaaaagattaactgcccatttttctgtgatcagtgggccttatctatcctcccaattccttgtaaacactgtttgtaagttctataagatcctgcttttttgctgtgcagctgcaaggccataaatcaggtaagcgtaagtcgcaatttcagtttttctcaaaatctaaagcatgtcacaaaataatttactgcctttgtttctcgctcctgtactggaacatacttcccgcctcacatatctcccgccttaaagagtttaaaaggcaatcacccgagctagcagtggcaacccattcgggaccccttccatgctgtggaagctttgtactttcgctctgctcaataaaacctacagctcattctctctcttggtccaagtatctgtcactcgccatggtcagccgccacaccaattctttggcgtggctaggcaaagaaccttgggtgttacatcttagtgagccagccaggagactccaggaagagcatcccaactgccacgcagtgagtaccctcggacctcttttgcttgctattctgtcccatccttccttagaattcggaggctaaacactgggcacctgtcagccagttaaaggcgattagcaagaccactggactaaaaacacgagtgtcagcctgggaaagggctctctgacaatccctgaccctttggagttgggagcactggtttgcccggaaccagttttaagtctttcactttctgtagtggtcccgaagtacacccgggagtgctcagcaaatgtcatggtctcccagatatccaggttgagaccatggccccaccagaggctcccacagcatgggttactaagcgtgagacagccacatcttctgactcctgcgtcctgggttcaaataactgccggttagatttctttcctcacctggtaagcaagattattcccactagacaggaccaagaatccctatttaggagacttaagtttttaaggtggtgttcagaagttccttgttgatggtgccctctggaatttaggcaggtgttgccatctgatggccactttgaaaggccagttccccaccatcgtgtatggtctcccacatcaggacaatttgaagacagatctgtaattttcatgtggatggtagaggccctaggacattttcttcattgttccccagatgaatttcctttttttggtgcctctcaagtataatctgtggtgtatgggtacggcccttagagcagttgaattgctttttcaaccattcaatcatggatattggaagaaagaaaatatagtcaattgagacacgggatactggtaccaccttaagatgggggcttactcctttgatggaaagtggggacaaaaggctagagtgcagcagttgttctctcagccctggcctagaggacatcaaccatcccctttgagcttactaagcctcctgtcactaattcagagattcctccttgaagggcagttttatggccaggcccacgtaaattgggccttgacatgcaagcatcagtggtgcccccgacccaggccttgccaccccagaacagataggacgcgttggcaaagggaccacaataaatccaacagtcctcatgccccatctagtggtcaatgggtgcacggcagagggcaaggatgatttccattctgccggtaagcgtggttaaatctggtaaatggaaggctcaaggacgatcatgcgctccgagcacaattggactggacccttgggggatgccctaaggggaagatgagtccctaagactaaccaggggtgcgggcatacctgtgtttaaaattccagttgggcaccacgccttcaaaactggacactcccttgagatgtatcctgaataactgggacaagttcgaccctgagaccttaaaaaagaagcgactgattgtcttctgtaccaatgcctggccacagtactccttacaaaatggagaaacttggccccctgagggaagtattaattataacaccattctacaactagatcttttctgtaaacgggaaggtaaatggagtgaaatcccttatgtacaggctttctttgcccttcgtgacaatactgctctatgccaagcctgcaagatttgcccaaatgacaaaaacccacaattgcctccatactcagggcctccttccttagccccactctcttccctcactgactctcctccatccagccccaccaaagtgttagaggcacaccgaaaagaaaacgtaaactccgcgaaccaggcgcccaaactaagtcccttacaagcagtaggaggagaatttaggcccacccatgtgcatgtctctttctcactctcagatttaaaacaaataaaggcagatacagggaaattctcggatgatcccaataactatatagatgtcttacaagggttaggacagtcctttgatctagcatggaggggcatcatgttgctccttgatcagaccttaagtcctactgaaaaggagggagctttagcggcagcccagcaatttagggatttatggtatctcagccaggtaaacagatcaaatggccccagaggagaaggaaaaattcccccacagggcaacaggaggtcaccgctgtagaccctcattgggatactgactcagatcatgaagattggagccgcaggcatttgctaacttgtatcttggaagggttaagaagaagtaggaagaagcctatgaactactcaatgctatccacaattacacagggaaaagaagaaaacccctcagcttttctagaaagggtatgggaggctctaagaaagtatacctccctaactccggattccctggaaggccaacttattctaaaggataaatttatcacccaatcagcggccaatattaggagaaaactccaaaagtctgccttaggcccagaacaaaatttggaggcattattaaacctggtgaccttggtgttctataaaatggaccgagaggaacaggccaaaagggaaaagcaagataagagaaagaccgcagccttggtcatggctctcagacaagcaaacattggaggttcagaaaggacaaaaaatggagcaggacaatcacctggtagggcttgtgatcactgtggtttgcaaagacactttaaaaaagattgtccaacaaaaaacaaactgcccccttgcccacgtccaatatgccaaggaaaccattggaaggcatgctgccccagatgatgaaggctctctgggccagaagcccccagccagatgattcagcaagaggactgagggtgcctggggcaagcgccagctcatatcaccctcacagagccccgggtaagctcaaccattaagaaccaggaaatcgatttcctcctggacaccagcacggtcttctcagtgttaatctcctgccctagacagttatcctcaagatccattaccatccaaggaatcctaggacagcctgtaaccaggtatttctcccacctcctcagctgcaactgggagaccttgctcttttcacgtctttcttatcatgcctgaaagtcccacacccttattaaggagggacatattatccaaagctggagctattaactacacgaatacgggggacaaattacccatttgttgtcccttacttgaggagggaatcgaccctgaagtctgggcaatggaaggacaattcggtagggcaaaaaatgcctgtccagttcaaattaggctaaaagaccccaccacttttccttatcaaaggcaatatcccctatggcctgaagctcataaaggaccagaggatattattaggcatttaaaagctcaaggcttagtgagaaaatgggacagtccctgcaacaccccaatcctacgagtacaaaaaccaaatggtcagtggagaccagtgcaagacctcagaatcatcaatgaggcagtaattcctttatatgctgctgtacccaacccctaagccccgctctctcagataccagaggaagcagaacggttcactgttctggacctcaaggatgccttctcctgcattccccagcacactgactcccagttcctctttgcctttgaggatcctacagaccacacatcccgactttcgtggatggtcctgccccaggggtttagggatagccctcatctgtttggtcaggcactggcccaagacctaggccaattctcaagtccaggcactctagtcctccaatacgcagatgacttactttgggctaccagtttggaagcctcacatcaacagactactctagatctcttgaattttctagctaatcgagggtacaaggtatttaagtcagaggcccagctctgccaacaacaaattaaatatctaggcttaaacctagccgaaagaactagggccctcagcaaagaacaaattgagcctatactggcttatcctcgccctaagacattgaaacagttgcagggattccttggaatcgccggcttttgccaactgtgaatccctggatacagtgagaaggccaagccactctatattctgataaaggagacccagagggcaaataactcatctagtagaatgggaatcagaggcggaaacagccttcaaaactttataacagaccctagtacatgctccagccctaagccttcccacgggacaaaatttatctttatatgtcacagagagaccaggaatagctcttggagttctaagtcagacccgtgggatagccctacaaccaggggcatacctaagtaaggaaactaatgtagtagcaaaaggctggcctcactgtttatgggtggttgcagcagcggccatcttagtatcagagactatcaaaataatacaaggaaaggatctcactgtctggactactcatgatgtaagtggcatattaaatgctaaaggaagtttgtggctctcagataaccacctactcaaataccaggcactaatccttgaaggatcagtgtttcaaatatgcacatgtgcagccctcaactctgccacttttctcccagaggatggggagccaattgagcataactgccaccaaattattgcccagacttatgccgcctgggaggatctcttagaagttcctttaactaaccctgaccttaacctgtatactgatagaagttcatttaggtacaaagggcaggctatgccatagttagcaatgcaacagtacttgagagtaagcctcttcccccagggaccagcacccagttagcagaactcgtggcacttacctgagccttagaactgggagaaggaaaaagaataaatgtgtatacagatagcagatatgcttatctagttctacatgcccatgctgcaatatggaaagagagggagtttataacctctcaggggacacccattaagtaccacaaggaaatcatgaaattactgcacgcagtgcagaaacccaagaaggcggcagtcttacactgccggggtcatcaaaaagatgaaggagaagcagcagaaggaaactgccgaggagatgctgaggccaaaactgctgctaagcaggacttccctttagaagtgcccatggaaggacccttagtatggagcaaccccctccaggaggttaagccccagtattccccaagcgaaacagaatggggactctcatgggggcatagttttctcccctcagggtggttagcgacagaagagggaaaggtgctcatacctgaagccagccagtggaaaatacttaagaccctccaacaaacctttcatacaggttttgaaagtacccgtaagatggccaaatccctatttacagggccaaaccttctccaaactatgcggcaggtagtcaaggcctgggagatgtgccaaagaaataatcccttggtccatcataaggcccctctgggggaacaaagaatagggcactatcctgtagaggactggcagttaaacttcacccacatgcctaagtcaagaggatttcaatacttgttggtctatgttgatacctttacaaagtgggtggaagccttcccctgcacaacagagaaggcccaagaagtagttaaaatcttacttcatgaaataattcctatattcggacttcccccaaagcttacagagcaacaatggtccagcttttaaagctacaataactcaaggaatttccaaggcactaggaatacaatatcaccttcactgtgcctggagaccacaatcctcagggaaagtcgaaaaggcaaatgaaacactaaagaggcatttgagaaagtatctcccatggccactctcttgcccatggccttgttaagaatccgaaattcccctggaaatttgatccaaaatcaaagggggctcagtccatatgaaatgctgtatggatggccttttctcacaaatgacctcctgctcaatcaggaaacggccaatttggtcaaagatataataacttctctagcaaagtatcaacaaaaccttaaaactttacccaaagggtatgacaggagaaaagggatagagctgttccaaccagaagatctagtagtggtcaagtccctcccctctaccttcccatctatggatcccttgtgggagggaccatactcagtaatcctctctatccccactgaggttaaggtggcaggagtggaatcctggattcaccacacccgagttaaaccttggacaccccttgaggaacttacaggactatcagctcaggagtctgaagatcagccagaccagccttgatacacctgtgacccacttgaggccctgcttctcctatttcggaaggaagcatcccaggctaaaaagactcctgcagttaatcctaaagaagaaaaactcatctctacctaatagaggataagcagaaagcctacatggatctttgacatctctccttgctctctttaatggagtccttatactgtttcatcatattaaacagtatactaaccataccctttgcagtaggattatatactgtagctcctgccaggacaaaaatcctgaccacatcaaccttttttctatcgtccttccttttaacaatttactccttcttccctcctcctttctactaccgctccacctacagagcaccatgactccctttataaggatctcctaagcttcttttaactctcctaagtattctttctgccacctcttcatccctccccaactgcacttgcttctctagtgcatactctcctccccttcccagaaacactgatgtagtctacttcgaaaggatattgtttaaaactaaatcagggtttactacccacacctatatgagaaaggaatgttatagtgctgcttctctctgctcccacaatggccatacatatcaccaaggacaaatgacccagtccaactgtcccgatgccctagggactacccaatgttggacatattacacccatgtgggtataactgatgagagaggtgtccaggataaagccaaaaacaacatgtccaacaagtaattaaaaacttgatccaaccatctaacactccaagtccatataagaaactagacctttccgggttacaaaagactcttgactctcattcccatctctagagtctatttaacaccacattcacaggaatgcaggaggcctctcctaacaatccaactaactactggatgtgtcttcccttgcgtttccaaccacatgtcccagtagtccctgtcccaggacattggaacctatccacctcagtcctaaacaccaccgggataattggctccccagtcaccaatctgccagccacacaggcctcaaatctcacatgtataaattttagcatgactcccaatagaaacatctcccaaagtcaatcctggataccagtgacctcaggtttcacctgtctaactccagacatctttttcatccgtgctaacatagcttattgatgtctaaagggcaccccaaaagagttatgctttctctcatttctagcacccccatgtccatttataccgaacaagagttggaaagtctccttataccccagtcccgccacgcccgagcgcctattctcccttttatggtaggagccagaatactgggtgggcttgggacaggaattggaggtataacctccttcacccaattctattataaaatatcacaagaattaaatgatgatatggaatgggttgccaattccctgatgaccctacaaagccagcttaattctctgactggggtggccctccaaaaacgaagggccctagacttactaacagctaaaagaagaagaacctgcctcttcttaggagaagaatgttgctactttgtcaaccagtcaggaattattgccgaaaaagtccaggagctaagggaatgaagagaacgtagaaagagtgaactccaactctcaggaccctggagtatatttaaccaatgagtaccttggcttctcccctttctaggccctgtaacagccatcttgctatcactcgccttcggtccctgtatttttaacctccttgtcaaatttatttcctctaggataaaggccatcaagctacaaatggccttacaaatggaacctcaaatgaatttaactcaagcttctaccgaggaccccaggatcagcccactggtctcttaactggcctagaaagttcccctctggaggacaatacaacagcagggccccatcgtcgcccctaaccagcaggaagtagctagagcagtcatcgcccagttcccaacagcagttggggtgtcctgtttagaggggggactgagaggtgatgccagctgagcttcctgggttgagtaggggcttggaaagctgtaaaactcactcatttcctgcatcaggacttacttcagttctggataaataatactgaggatatatgcttaaaatattcctaacaccaggatttgcttatatgttttcttcccaagaaagctataaacagcgagaattttagctgtaagttttcctgtatgccccactcctcccctgccaaaaccagagttaaagaaaagattaactgcccatttttctgtgatcagcggaccttatctatcctcccaattccttatgaacatagttcgttaagttctataagatcctctttttcttgctgtacagctccaaggccacaaaacgagtaagcataagtcgcaatttcagattttctcaaaatctaaggcatgtcacaaaataatttactgcctttgtttcttgctcctgtaacattcttcccgcctcacgtatctcccgccttaaagagtttaaaaggcaatcacccaagctagcagtggcaacccatttgggaccccttccacactgtagaagctttgtactttcactctgctcaataaaacctacagctcactctctctctcagtccaagtctctgtcactcgccgcagtcagcctccacaccaattctttggcgtggctaggcacagaaccttgggtgttacaaaaggataaaaagacaagatacagagtgcaagaaaatatttgcaaacaatgtatcaaacagagtagtatctaaaatatataaagaactctcaaactcaacagtaaagaagaaaacttctgggcacagtggctcatgcctgtaatcccagcagtttgagaggccaaggtgggtggatcacttgaggccaggagttcaagaacaacctggccaaaaggtgaaaccccatctctactaaaaatagaaaaattagccaggcatggtggtgggtgcctgtaatcccagctactcaggaggctgaggcaggagaatcacttgaacctgggaggcagaggttacagtgagacaaaatcccgccaccgcactcctgcctggacaacagagcaagactccatctcaaaaaaaaaaaaaaaaaaaaggaaacaatacaattaaaacacaggtaaaaggcatgaagagacatttcactgaagaaaaaagaaaacagacaagtgggaaaataagcatatgaaaaactggtcaacattacagtgattaagacctggttttcaggccagcatgtgagaagcctgaaagtcattatctaacaagtaaaaagctgaacaaagtgaaaaagcaacaactcttcttagatcccaaagagaactgaggtcacagtgcaaacagctgctcccaaaacagaagagagcaacatggcaaatgcatagaatacttattagagcttgaaacttgtgtgggacacagcacctaggtgggaaaacttgaattgtattaattgctggaggctgagtatgaagaagtctgagagttaaaaattccaaaacgaccccgtcatagggagactaccagacttttacgagttttacttccaggagtttgacctggttctcacagtaagtatcagagaaaaatcccctcatgactccagaaaagggaagataaaagggtccattttgaaatataccagaacattctattcttaataaggtctgccctcaggagaaactatttaaccagagcctaaactctttgtagttttaacagagcctaacttaccttggggaagagaaataaccaactccagtcaattctagtcttccgggtggttaaagggaaatacccaactaaagctccctgtagccatcctgtcccactcaagttagtaaaaacagaaaaaaactgagaagcatctgtgaagttacaacccaggggcaccggctcactaaaacactgaggccaaatcgtaggacacttcccctccccacacaccttaccaccacattactaaaggtctgctcaccagtttcttttacccagtatatcacgatcagctttcaaaaaataaaaataaaaagtacaaggcatactgtaagacaaaaaaaaaatagtttgaagaaatagagcaagcttcaggactagactcaaacacggcagggatattggaattactagaccaggaatttaaaacaactatgataaatagggtaaaggctttaattgaaaaagtagacatcttccaagaacagacggataatgtaagccgagggataaaaattccaagaatcaaaaagaaatgctacagatcaaaaatactctaatagaaatgaagaatgcctttgatgggatcattagtagactggacttggcacagaaatctctgagcttgaagatatgtcaacagaaactcttaaaactgaaaataaagagaaaaaggctggtaaaaatggaacataattatttaattaaaaaaaaaaggagaagaaggcagaggctgcagccagccaagatcacaccactacactctagcctgggcaacagagcaagactccatccaaaaaaacaaacaaacaaacaaacaaacaaacaaacaaaacacattatatccaagaattgtgggacaactacaaaaggtatgccttacacccttcacaaaatttaactcaaaatagatcacaaccctaaatgtaaaacacaaaactataaaactcccagaaaataacataatagaaaacctagatgacattggttatagcaatgattttttagataaaacggcacaatccgtgaaagcaacaactgataagcttaacttcattaaaatagaaagcatctgctctgcaaaagacaatgccaagagaataagacaagccacagaatgagagaaaatacagtaggccctccatatccgcaggttccacatctgcagactcaaccaaccgtggatcaaaaatattaacaataaaaataatcaaactttaaaaacaatatagtatggcaactatttacacagcacttacattgtattacgtattgtaaggaatctagagatgatttaaagtatacagaagtaagtgtgtagattatatgtaaatactacactattctatataaaggacttgagcatcctcagattttggtatcaggggtcctggaaccaagcctccacaataccaaaggatgtctttatttgcaaaagacatgttcgataaaggcctctcatccaaatatacaaagaactctaaactcaacaataagaaaactaacaacccaattaagaaatgggctttataaagacctttacagagacctcatcaaagatgatatacaggcagcaaacaagcatatgaaaaggtgttccacctcatacatcatcaggaaaatgcaaattaaaacaacaaaatactacacatttattagaaaggcaaaatccagaacactgacaacaccaaatgctaagtaggatgtggagcaacagaaccctcatgtattgctggaatgcaaaatggtacagcctctttggaagacagtttggtggtttttttacaaaactaaatatacaaaattaaatatatagaaaactaaatatactcttaccacatgatccagcaattgagctcctaagtatttaggcaagagagttgggaaccaaaataaaagtcctaacccttccaacagactactggaccctcctttagctaaaagaccccaaaattttaagttagcagccatggcaagacagtaagctgttcatgatccatttgcttccaacccacttctctcctttctaatcactggattttctcaaaagccagtgtgagaaaacaaaagtccaaaagaccccttcgttcaagtcatctaaacacaccccctcctgtttttatagtttcaacatgacaactattttaggccacaaagattttcttcttgataagtggcttttggaagggactggttctggccagtcacctgaggatgcagtttatggacttcttccctacatttcaccttttacatatagaacctaactacaatgcatttaaatattaaatctccacctcaaagtgattatgggaggtattttacatatgagtaaacctaaaacgcatgtgtgtgggtctccttcatgaatattcatggttccttctgtaacctgttgaatatagctgtatgcctagccaatcatcagcataagttcttatcttaaaccctcaccttactggaccccactctgcctggaaatgcctctcaatttctgctgagactatgcctcccagcctgtcagaatggcctatacaagctgcaaacctttgtgagaaatgaagctctcctttccaaatctatgaacctcatcattcttcagctgacagagttgaaagctgacatccacacaaaaacctacacacggctgtttacagcaactttcctcataattgccaaaacctggaaacaaccaagatgtccttcagtaggtgaatgttgataaactgtggtacatccagacaatgggatattactcagcactaaaagcaaatgagccatcaagccatgaaaagacatggagaaacttaaatgcatattactaagtgaataaagccaaacccacagaatatacaacaccaaaagtgaaccctaatgcaggggtccccaaaccccaggccacaaaccagcaccggtcagtggcctgttgggagcccagctgcacagcaggaggtgagtggctgcaggtgagtgagggcagctgagcaccacctcctgtcagatcaatggcagcattaaattctcatagaagcacaaacccactgcacatgcaagggatataggttgtgcgctccttatgagaatctaatgataaatataatgcaatgcacctgaatcatcccaaaaccaaccaccccactccaccctggtccgtggaaaaactatcttccaccaaaccagttcctggtgccaaaaaggttggggactgctaccctaatgcatgaacactgggtgataatagtgtgtccatgtagttttatcaattgtaacaaatatactacactagtaggagataatgacattggaggaggctgtgcatgtgtggggacaagagatatacaggaaatctctgtacctcccaatgaattttcctgctgctctaaaaaaactgctctaaaaaatacagtctattttttaaaatgagacatcactaccacaaggaaataccattatactatcaaaatggctaaatttttttacactaagtggtagcaaagataaaaagaaaactagatcacttatacatacattgctgatggaaatggtacagtcactctagaaaactgtgtggcagtttctttaaaatctaaatatgctactacacaatccagctactacactcctaggcatctactcacccaaagaaatgaagacataggttcacagaaaaacctatacccacatgtttatagcaactttactcataatagtcaaaaactgaaaacatcccaaatgtttttcaataggtaaatggttaaagtgtattctctccaataccaccattactgaatgctactcatcaataaaaaggaatggactgttgatacatgtaacaactggatgaaaatccagagaaaaaagccactttcaaattccagttatgattccatttataaagtattcttgaaaaacaaaactatagaaatggagagtaaatggcttccaagagttaagagataaaggagagggggcagagagagaagtgggtgtgggaaacatgaggtatgtggaaatgttctgaatctcagctctatcaatgtcaataccctggttacaacactattatttcttaaaactgtatataaatctataattatctcaaagtaagaagtttagttaaaaagatgaaggaaaaactcttatgactagagggacaattttctttttttgagatggagtctcgctctgtcccccaggctggagtgcagtggcacgatctcagctcactgcaagctccgcctcctgggttcacgccattctcgtgcctcagcctctcaagtagctgggactacaggcgcccgccaccacgtccagctaattttttgtatttttagtagagacgggatttcattgtattagacaagatggtctcgatctcctgacctcgtgatccgcccacctcagcctcccaaagtgctgggattataggcatgagccaccgcgcccggtcgattagagggacaattttatttgatatacagcaacactgaacattattaaatattcaaacactataattttcagtatgaaacaataaaacatatcccctgaaaattcttgtaccacaaccactcttcaaagattcatatataaacaataagaattttagctcaccttccacgctatcagaacaggaagttccaatgccagtgtctccactgtcagaagctatactgtgtctcctgatatggttatttcgatggttagatggaacagttgtggcctgccacaatgattcattagcaggtagccatgctgatgaataatctgggcctaaaaagggaaatatgtaacagttaacacatatatctgagtaggcagaagattttttttttaccttgtggaaaatacacatagggtataaaaggtataaaaggttcttttctgcccaaaataatttaaaatgatcaacaaaattaaccaaataaatgtatatatcacacatatatcaattaagtgtgattacatagcttcctctagctgaagaactctgttttctgcttccgggcattaaacttttaaagacgtactgctgtgttattaaaaatgttggaactatccacttatcttcaaatgtcagtactctgctctagaataattgataggtggcatctgtgattatacatacatgcgttagctgaaaatcagggctcaggaaaattcaataataatgcatgataatataaataggatatccacatggaatatgaaaacaatccatttttttctgctatatatctactaaattttttctacaatcatcacttaaaatttttaaattttacattattttatttgaattatttccttaattattatttaataacagtttaatagcacagcattttcctactcttagcttgatttgtctttttttttttttgagacgagtctcgctgtcacccaggctgggtggagtgcagtggcgcgatctctgctcactgtaagcgctgcctcccgggttcacgccattctcctgcctcagcctccggagcagctgagactacaggtgcccaccaccacaccccgctaatttttggcatttttagtagagatgaggtttcaccgtgttaaccaggatggtctccatctcctgacctcgtgatccacccgcctccgcctcccaaagtgctgggattgcaggtgtgagccaccgcgcccagctagatttgtccttttaatttaaatactttttagctaatttaaggtttttcaatgttctttcaatgtttatttccacttactcacttttacttaacttttatttgactttttctgttttacccatcacttattttattgtctagtacagtgctactcaaaggatatcaatggaccagtgccaatctgtactatttgttacaagttagatgcagaaataaataagcatctagaaatgttattgtactataattagaaagagaaattttaaattcgttcaactttacataaaacctgtagaagcacaaatctttactaatgcctaatacagtaagtctcaattcagggcttacagaattattcataaaagttaagaagttcccctacatgaattttaggctctcatttcaatgacagttcttaaaaaattaataagcacattacagattatctgaacagccaacttaaaacattatttccacataatttcaatgctcccgtatctgtatagcagccttaaaaagatttatcacataattcaatgtccccatctgtgttttgcggttgaaatagcagttgcttctaagtaaagagcaaatgacatcactgggtatttaccattatttgaaagaagatagctttacagaattattcattgataccctattgaaaccggcatgcaaggaatgccttctggcagtttaaacataagggtaacaaaacaacaaacgtgcataaaattaattataccagtttttttaaccacacttttaggattagttgttctctatgtcagtattaaaatcaaaatatataaacaaattaataaaaccagacctaaagctacctctatcatactaagctcaacattaatgattcacttttaataaaacattgtcacattattttatttaatgcatttatttatttaaatgcaatttatcaattaaatttaggctttatacatgtataaagtatataagcagccttaaaagccttatacatttaaattaacaaatcaaatttgaaaaacagtggccaaagagacacttttaccagctttgaggttcagaacaaccacttaaagctttgtagattctagacttctctcagaatgagacttttcaattcaagtgattcaacactcacattaaagcaccagaagaaggtgttctgtcaccagatctattctaattctgatctgtggtctgtaatctataccaaaattttttttcaatcaggtaacatcccatctaaatgagctcaaagtcctgcctaaactattatcaaaaatggcaaccagcctagtctcacaagtgcaaacctattagctggataattatttttttttaagaatacccagcaaatagcataaataggctgggactatatgtaaatgaaaaaataaatataagaaacgatgccaaatctcactaatggtgggagaagtgaaaaagacaataaattttctggatttttaaaactatcaagttgataaaagaaagactggtgtcaaccaagtgaggggaatgttcgtatatttttgtggccttgcaaattggtacaacctttctaaagggcaaactggaaagtggtatctaaatgtcaatatagacatgaccttctactgagaatttatcctaaggaaatatcagacaattacaaataaatatgagtataaggacattcctgacagcactgcttaaagtaaatgcctatgaacaaaatataaactgttaattagttgataatgtttaagtgctaaaaatgattttatcaacctattttttaacatggaagaacatccagaatatatctagtgtgtatggaagagaagcattttatgtagctatatacataatatgattccacagctggagaagagtttgtacatttacatacatggaagaagctttcagggagctctatatctaaatgctaacactgactatgttttactaaaggaagaaatacattacaggaacatttactccatcattggttattattattattcaatctaccagtttatgtggggaaatgctgaaaattatgcatactgatttgcagattacatcaacatttgattctgagattagaaaccagctatagctcaagatacgcaaattcagattcctagtaacaatttttacaaaagctgcataaaatggctagaattaaaacccttgcttttaggcaatataactattttgagcagtataaagtcatgctccattaaagcctacaacacacctccaccctattgattgttgacaagtcttggccaataaaccatttgtggattaaaaggcaataatcattctctctctcactctctctccactcactcactttctcactccagtaatggggaggaaagcccactgtacatattaatgctatggtgttattatcacaagctaggacaaccttcaatcattagtcttgtataattaactattgccagaaaaacagttcaataaaacctttttctgtcaagagccagattgtaaatattttcagttttgtgggtcactcaatctccgtctcaactagccaattctgccactgtagtctaaatcagctgtagacaataaaatggatgtggctatgttgtaataaaactttatttacaaaaacaggtgacaagtccaatgaaacctgggggccagtttgcagactcctgagatgtggtaaaaaatcattctaactgaaaagagtccctaaaattcaactgattcataagtaactacagccagcatattaattcatttctttatttggaagaaaagtgagctcatcctagagtacatatcagcaagccaggctgcccagaatctgacaattcatgaaagcactactgaggtttttcaaggattacaaagacaaataaatgtcaacaagtgttttaggtttctttttccagaataaatgatctcagtttatccatatggtatggaactcctggacaatgtcaaatatgtgtgatggttaattttacatgacaacttgactggaccatggggtgcccagatatgcagtcaaacattacttccgtgaaggtgtttggatgagctcaacattcagattggtcgactggataaggcagactgccctccataatgtgggtgggcttcactgaaccagctgaaggcctgaacacaacaaaaaagctaaccatcccctaagcagaagagaattcttcctgcctgatcccctttgattaaatacactagtacactggctttttcctaccttcaagcttgaactgatctcttcctggggcttgagcctgccagccttcagactggaactatgctatcaacaatcccaggtctccagcttgccaaatcacctcacagatcttgggacctgtcagccaccataatctcatgagccaattcttaattaattaattaaatgctattggctctgtttctctggagaacttcaatacaatattgggaaaactagaaaaattctaatcttgcctacagatatgaaaaagtggggacagccttctatttagaaaagaacaatagttgtaatcctcaatttccattacagtatttcaatatcatctactcaatatgatacctattccacagatttccaaagcacatcagtacaatctcaactatctgttatctaacttttatacaaaaaaagctataagaaatgacagagaaaatggtctaagacatgctatcattccgcccctctagaaaccctaaattctatctttgaatcacagagcagtacatacatacttagagcctttttatttagcaactcagggaaatgatcttcctaaaatttctttcagtgtactgccaccttataaacttgaacctctgacttttacagaaggacacaaaaagtaagcaaaccacataaatcatcaaattgttgtctaggccgggcaaggtggctcacacctgtaatcccagcactttgggaggccaacgctggcagacagcttgagttcaagagtttaagaccagcctggaaaacatggcaaaagcccatctctacaaaagaaaaaaaaaaaaaaattcaaaaaaatgcctctgtgcatggtggcacatgcctgtagtctcagctacctgggaagctaagctacttgaacccaggaggtggaggctgcagtaagccgagatcatgccactacactccagcctgggtaataaagcaagactgtctcaaaaaaaaaaaaaaaaaaaaaaagttgtctatatatttaagaagttaaaggcaaacactaaaaatatttgcagatatggtattaatgcataattataaagagatcataagcaaactaaaaataaataaataaatactaaatggtttagtctaaatggacaaaggacaaaccccaaagggaaaaacacaaataaaaaattctgaaaaatagtccaagcccactggtaagcaagtagtatcaaattcagaagacatgctatttttcagctatcaatctagcaaaaatgttaaaagaacaaaacaacagtgttcctagatactcccatacactgataatggtaatgttaatttattcattacaaaaacacaaccttttgataggctattaggcaatatacatcatgtgtagcacatgcctgtaataccagctactcaggaagccaaggtaagattgcttaagcccaggagttcgagaccagcctgggcaacatagtgagaccgtctcaaaaaaaaaaaaaggaaaagaattaactatataaattgatctcctcccacctgaactaatttgccttaacctttaaacataactatgtctttaaaaagaagatctggtattgtatgtgcctcaaacactgaagatgattaacaaatgtcatgaaaataacattctaatcttttaatttaaactgaaaaaattcacagtctgaaaagaatgacatgacttgtctttagacaagtcaatccagaagcacaatacaggaagaagtacatgtgaaatatgctgaccaggtgatttaataaggaaaattttctcacagaatagttacaagactatgttactgaaatgggaatattgatatctagtatgcaatatgcacttaaaaactcaaaataaggctgaataacctctggcaataatgtcttacctaaagacaaaaggactgctgtaagaacagcaaagatcccaagaaactctacattggaactcctccttggaagacaatatgttacatttttcaatactaattttttaatactaattttaattattttaatagaatactgagtgcctgcggataacattaaaaattctgaatatttctcagacaggaagattagcattaaataaaaaagcaacctattttacttctgaagctcttttattggaagcaaaaatgcatacagtatcaagtattccacagcatttgaatatatatgtaactgcactgagaacaagaactactctcattgaatattttaatgacagctctaaattgaagaaaataaaaataacactactgacaaagcagatttatacttttaaataagctgaatacataatacaaatcgagaatacaaattgcaatgtttttcagaatgcagattatctgtcacccattagtatgttttaaaatcaacttggaaaccaacactttcaaataaaatagtagataaagcatgtttacccttatattacataagtagcacgcggttcacattttaacatctctgaaatattaacaagtacttttgcacaaagaacctattctgctgctggaataactccactcaagccagcctctactctactatcttctagaatcaagcatgtttatgttattcttctacttacatagatctgtgagccccttacggcatattaaataaattcaaactccttaagttaggcaaagttcttcaccaattgtcagcttcactttgcaacttctacctacaaaaactatctagccacacttacctaatcacttcctccaaacagatgagactctttcatgactccaagctgtttcacttctgcaccttaagagtcctagttcagaattaacttgttctgtcttccctgattcctccaggtggcattaaatactttgttcactcccaatatattattcaaaattccaacaacatttaataaattatattaacccatatgtatatgactttcttctccctcaccaaactgtgaaaaatgaaaggcaactttttttagtgtccagtacctagcaaagagctgcacacttatacagggtctcaataaatgtagtcattataaccactggatacctaacaaatgttcacagaataaaattagaattttggaagccttacaattacaactacaaaaatatctttgtgttcagaaaaaggattcaaacaagcgttttgtttggtggttgttgtctgcttattttaaaatccaggatattttaaactatcccttgagccagtatgcatttaagtatctatttagagatcagtaaatatttatcaatgcagctttttttaaggtaattttaaataatttagagatctgatggccaacattcctaacatgggaaaacagtctccaataggttaaaaagacacaaaactcacacaaaaaattagaacattaaacggtaagaaaaaaacgttcatattaacagtagccaaacagaaaaaaccaacaaatctggaactacactgcagaatatctagctaagatgacagaaacatcacatagtgttattttctccatcccaatcctccactccatttcagtactatttatctctagggtaagtgactccaatagtcttagtttgtttcttttatcacagaattaccagtatagctcagtgtgcactgtgaaaccaggctacctgggttcaagttcattctacctcttattagcagtaagtcctcataaatcacttaacctctctgtgcctcaatttcttcatatgtaagagaagaaaaaaattatagaatagtacctatattatagggttgttgtgatcaatgaacatgtaaagttttttgttgttgttattgtttttgagacagagcctctctcagttgcccaggatggagtgcagtagtgcagtctcggctcactgcaacattcatcccccaggttcaagagattctcctgcctcagcctcccaagttgtgcggattacaggcacacaccaccatgtctggctaattttttaggttttttttaagtagagatggggtttcgccatgttggccaggctggtctcgaactcctgacctcaagtgatccgcctgctcagcctcccaaagtactgggattacaggcgtgagccactgcacctggcctgtaaatatatttttgaaagtgccagacatataattaggatctcaataaatgttattatttttattactgtccatgcatagaaattttccagaaggataactaaaaactattaaaaatggagtggaggactgacatgaaaggtagataaaaaagcttacttcactttaagcttttctgtactgagtcaacattttactgagcatgtgtaactttaataatgagaagaaaaaaatcatctgacaaataccacataacaataattcttctgctcctcatgaggtacagtaccccactctcttccaagtttttaaccttgctcttttccctccctatttaatcaaggacatctacactgtcaccagcttctctcttaatatcttactagcatgtttacaactacttatctccttcaaaacacaaacccaatgcccatctctctgataaccaccacttttttaacatcattccaagagattaagcataagctttctatctctatgatctgcaaagtgaatacatgcatgccagggagtacacgagccaatccactggcaagctgctggaagaaaaaaacttgtttatactgaaaattatctttaggaaaaagtaatgcattaaattttgctataatatttaacatacaggttaacactagtgcccttacttggattatcagagcattatgttacatatatataacataaacggaggtgctctatacagagggcttgacggtgacatcctcctttgttcatttgattttttcgtatgggtatgcattgcagttcatggctggttaagcagatttgcatatcgataacattaggtagttttacttaaactagccctcacaaaatggatttgtggctctatattactgcaaagaaacctgaagttgaaaaacctgaagataatactaaaaatgtaagtataaacaaacaagaaaatagtcaagctgatgcctcccatgcacacacttcaacattccttttgcaagagaaaaaaaaaaaattacaaaattagatctgacagtaatatgtcacctagcatttctgtttgaaaaaataaccattgatccccataagggtaaagatgatgctttcaaatgaaacgttcaatatgtagagggcatactggaaatcaacatgactcttgtatctgcatatgcgagttggaaaaaataatttttaaaatatatcaactgtatgtaccactaaaaaaaaggatgccaattaaatgacaccctgaattacatgatgcatccatatatcagaaatgctaaaacatttttaaagtacattttaaaattgataaagtataataaatattgcatacataaaataggagcatttgggtgaaatttttgctgttaggcatgtctaaaaaataaggagtccattggttctctatggtctcaaaacatttgctataccctaccctttttatgaaaggtttgtaaaatgtgtcaaaaaaataaaaataaacaacaggtagcaaaacggggaggtgaattgagaaactgtgctgctccaatcccaaaagagatccaaagatctgctcagacatgaaaagttaggttctagccagaagtaaaattctaggccagaagaaagtaagaatcaagaataaagtaagatcagattccaagattgggaattaaacttaagcagtcactgaagatgctttcactcagctaaaataaggttagcagcatcaagtaagtatactttctcacataaacacactagttaaaaaatacctacattaaaatctagctcaatctaagctaataggctttcttgggttgggcacggtggttcacatctgtaacaccagcactttgggaggctgagcagggtggatcacctaaggtcaggagttcgagaccagcctggccaacacggtgaaaccctgtctctactaaaaatatatatatataataaattagtccagcatggtggtgcacacctgtaatcccagctacttgggaggcggaggttgcagtgagccgagatcacaccactgcactccagcctgggtgacagagagactccgtctcaaaaacaaaaaaagctgtgttcaaaaaagcattttggcaactattaggaataacagccacgtatttagtttttggtaagtccttgttcctgtttaaaaactgggaaaataaggtacagttaacaactaatgaggctgttcataaaaccactacaaatatatacaacttggtatttcagacgggcttatctttgtcctagaacataagaatcatacacaatacatttaaatggctaaagaaaaataaagtcttaaaatattacaaaataattgagaaaatttataaatatatggaagttttctgttcccaaaattaaagcacttaacttctagtccaacttttcagtacattattcctaaaatgagacagaatgctcagtattaatgagaatgctttagaaaagcttcagaaatgtcatagcaaggccatatatatgtaatttcttatggtcaggaggcaatctctgcctctacaaaagcaatgtaatcaactggtagaaaatgctaaactacatgaaacatagtccaaatctttcatcccaaaatctttcagagaaatatataactaaaaactatagttcatttcagaactctaaactttaatactaaaaactattttcaaaacgagtatcaataaagcaaataagtttcattcactagacattaacagtgtagaaaggcatacaacagtttctgatcttacattaactctctttaaaggaacttaaaatcctatcaacgactttaattaatttagcactacctaatgaagtctttaaacaatttacagcaggagaaaaaaaacaaaagtaggggtagagttacttttctgaggtagattctcagatcagacagaggttaagaaaagcatgaaataaaactagatacagtactaaagtctggttccctgattgagagaatcttctattctgaggggcgagaacactgttaacaccagttcagacgccctgagcagacagagtaccctggtcaagacttggccactgttcagtgtaaggaatcccagaaaacccttcagtcctaggcaacctatgacacacaacccctagttttaaaactgaaacgtcaggcaaacccagacaactggtcaccctagcttaataagtggtaaagagcaattcaaacatttattaagcacttatgtatcaatccttatgcaataaagtcagctccactggattagataatctctaatttctgctaggtttatatttttaagtatctcactgaaactggccaaatgcattgatgcattttcttctgactcatcttacatggctgcctggaagcatgagactggtgatcactactgccttcagactcctctctaccagaacacttcattgtcctgcttttactcctaccaccctggctgctccttctcagtgtctttggacggcacatcttcctctgcctgaagagaaaatgttagtgtcccagggcttagtcctctactgtcttctctattctctcggtgtgatccatgacctttaaacaccatttataaccaagtaattctcaaattcctatctctcacccagcaacctccctactgagctccagcatttatacccaacttcatattcaacatctcacctgaatttctcaaaaggatctcaaatttcacatggccaaaaagaactcttgattccatttattttccttacactctctccccaccgccctctgcccactaaccttccccatctcaggaaatggcatcactatcgattataatcacagaagccaaaatcaagatgtcatttttgactcctctttcccttaattgacaactccaaaccatcagtaaatccttaagatttctcatgtatataccaaatccattttcttctctccaaatccaatctaaccattctaactcaagccatcatctctcacctaataactgcaatggcctattagctgtcttccctactgctgttcttgccccactcctctacaatttcttcttccacagaatagccaagactgattgtaaacacctaggacaaggaatatctgttccatgtccccaatacatgggaacagtatctgcctcatagtaggcactcaatgtgctcaggagtgaaagaatgaagtcactccccggcatcttctgacatgcagaatagaatccagactccctacaacccctaacattattatcaggccttcctcacctcacagtcctgctcactaagctccagactcactggagttcttcaaacttctcgaactcatttccgccttggagattttttgttccctccacctgaacacttctcccttcacgtctggcttcttctcatcattcaggtaacaatgttacctcctcagaggcctccctgaccagctactcaaggagctctgcccatcctctgccacctcaccaatcttcttttcctcttagtacttaacactagctgcatcatctcactatctgtttacttactgatcctcccctctaaaatgcaagccactaccaggcagcatggtggttcatgcctgtcatcccaatacttggaaggcccaggcaggagatcacttgagcctaaaagttcaagaccagcctgggtaacagtgagacctcatctctacagaaaatacaaaaattagccagcagtcagtgcacatgcctgtattcccagctgagcctgagaggctgaagtgagaggactgcttgatcctggcaggtcaaggctgcagagacctatgattgcacaaccgcactccagcctgactgacagagtgagacactgtctcaaaaacaaaacaaaacaaacaaacaaacaaaacctaaaaaatgtttttaaaagtaaaatacaagcctccgtagagcaagaaccttatctttcttgttcaatgatgtatccccagaggcttatacaatgtctagcacaccatatttattgaaagaataattcacaaacatttctaatgccaaggtaacaagcactatgctaggtaaccattttttttttaattaaagaaaaacagaaatcaaaatattggtatgaaaagtaatttggggccaggcgtggtggctcacgccttaatcccagcactttgggaggccgaggctggcagatcacgaggtcaggaattcaacaccagcctggccaatactgtgaaatcctgtctctactaaaaatacgaaaattagccaggcatggtggcacacgcccgtagtcccagctactcgggaggctgaggcagaagaatcacttgaacccatgaggcggaggttgcagtgagccgagattgcgccattgcactccagcctgggcaacagaacaagattctgtctaaaaaaaaagaaaagaaaagtaatttgatgttatttttatgttgatcatgcccatccttaaatgaccctatacaataaattgctcttcttagaatattactttgccagtgtaaaatatgaaaatcctgatagtaataataataatgaataacatgttattgcttaaaaattggctgggtgcagtggctcatgtctgtaatcccagcactctcggaggccaaggcaggcggatcacttgaggtcaggagttcaagaccaacctggtcaacatggtgaaaccccgactctacaaaaatacaaaacattagccaggtatggtggtttacgcctctaatcccagatactcgggaggctgaggtaggagaatcgcttgaaccccggagacggaggttgctgtgagccgagatcgcactccagcctgggtgacagaatgagactctgtctcaaaaaaaataaaaaatgatattgcttaaaaagtgtctgatgatcacgttcttcactttcttaatgcaaaatttatgtaattaggctataactcaggaaaatactatccagaagactttatgtcttcatcatcttttcagagtataaaaatacacatttcatccagtctgaaaaatcatgactctctcaaccctttctgttcacacacataaatattacaacatgacaatagaggttatcaactcaccatttattgcttggcctcagattaatttaccagcttcattcaagccaggaagtgatcaaattccaattattaatcaagttcatttcaccaaagtcatcactaaagttaagattcaccccttaccccccaatacctattatgaaagaacatgttcagttgggtttaggccagagttatgtttcattgttaccacagtattcctagaagtccatctaattcagaaccacagcagaaaacaatattattagttgtaaccataccagttattaccactatcattatgacatcactaaacaccttatggcaagcatcaattaagaggtaaatgtaaagctcaaagcaatgaacaaatgacattttttcagctcaagtgtttcctgtaacattttattttcgcacactataaaagtataatactctacctcaaaatgttttaagagttgaatatatgttttcgcttttgttttttaaagagacagagcctcactctgttgcccgggctggagtgcaacgacatgatctcagcccactgcaacctcagcctcccgggttcaggcaattctcctgccttcagcctcctgagtagctgggattacaggcgcacgccaccacgcccggctaatttttgtatttttagtagagactgggtttcaccgcgttggccaggctggtttgtaactcctgacctcaagtgatccgcccacctcggcctcccaaagtgctgggattataggcatgagccactgcgcctggcttatgttagtattttaaaaaaattatttacgaaaaggaacatacttagcacaactaggtattaggaagtactcaaagtatcactttatcatgcttgatttcaaaagcctacgggaaatatgtctatccttcatccaacttgaaaccagtatacattctgaacaatagggtaatctcaaatgcaatcaaccaaatgcataaaaagataccaattgttctattttaaattagccttctaaccacacttgccaatacaaaaaagagaggcttttatttgatatttgtaaggaaacttaagaaaacactcattttagctgggcgcggttactcatgcctgtaatcccagcactttgggaggctgaggccggtggatcacttgaggccaggagttcgcgaccagcatggccaacatggtgagaccttgtctctactaaaaatacaaaaattagctgggtgtggtggcacatgccggtaatcccagccatttgggagactgaggcacgagaaccgcttggaaccgggaggcggaagttgcagtgatccaagatcgcaccactgcactccaggctgggcaacagagggaaactctgtctcaaaaaataaataaataaatactcattttatttttggtttataacagttactccaaaaagctgaaaaatgggaaaagccaaattaaactgaatcctaaagcgaaggctaaaagttcagtatttttcaaactacacttattattcctattttttactgccatttctttaaaaaaaaatttcttctgatttttagaaagtggttctataagccgggcgcggtggctcacgcctgtaatcccagcactttgggaggccgaggcaggaggatcacgaggtcaggagatcgagaccaccctgggtaacacggtgaaaccccgtctctactaaaaatacaaaaaaataacccgggtgtggtggcgggagcctgtagtcccagctactcgggaggctgaggcaggagaatggcgtgaacctgggaggcggagcttgcagtgagccgagatcgcgccactacactccagcctgggcgacagagaaagactgtctcaaaaaaaaaaaaaaaaaaactaaagtggttctatagtacctttggcttttcctttagtctagttatatatttgtataaacaaataaaccagtttcaggacagcttgaattaatccacatattaagataaactcattttaataccagaaattatttacttatccctgccttcacactttgttttcagacaagtccaattttagggctggaataattgctcaaattattcaaaagatatactgaacaatatttcaaaaataaaaatttccttccaattatcaggaaaaaaggtccctacatgaatcaactcagaggtcattatcttgaccttcaccatctgctcacttgcacaagaagcaacacaagtttttcatctaaggtagaactttttaaaacttaaaattatctaagataattttaaatatttatatttgctcaaaaagggaagaaacacaataaataattacattactatttcagcatgtaactgaaaaaaaactttacaaaggcatgtcctgacttgtcaatagtttattactgacaaattgagataaaatacatactttggtacagctatactgtccaaatttcttcaattagggtagtaattacaaagtatcctcttccactattattctatgccatagcaaatgtctctctagaggctgcaacataacaaagtccttcgttacctaactttaaatactaaaatgttctcttcttcctagaaaacaatgaaaaatagacaccatgcctcagtgatatacctccaaacaagctgctattatcacgaataaattttaataggttagattgcaaagacattacagatggcttttgacattttcagataaactgaaaccactccctccagcccctagggataatgaagtagcttctcaatcactgaagttacttagatgacaggatttgtgaataatctgtaaactcgggaaacctctgaactgtctccttaggacaaataacatacaatttagaaaaaaaaaatccctacttaatactgctttttactaaattcatgcctacattaaatttcaggatcaaacttaagtgaatgattcaaatcattcattaacatacattaagtgtttcaggaccaaacttaagtgaatgattcaaatctaactctggctttttaaaatgtacatatgtctttttaaaaaccacacatcacaaatatctaaactatcaaagaattgcattattcgaaatttcaatagcctgatactagtgactcggtcagtgcctgattttttttaaatagcagaaaatattaccatcaaaagacccctttccaaatgctgcttctgcttttttgttttgtaaataacagctttggaaatgtatgcaaaaatatctctaagttacacaagtcgagctcaaacactttgtggagcaaggttacttaacaggagtcccagaaacagctaaaattgtagggaaaattttgcgtatgtatatatggcattgttttttctgcgcagaatgtccatataactcagtttctcaaaaggcctcaaaactcaagattaaaagtgcctggaaagaccatcatctttagagaacatatcacaggcaacccaagacttattttttatcccaagttaggggaggatttatcctaattttgtggctcctacacaacttctgagcgacgcaagcatgaaatggctgtccgatacaaacagaccccttcagatacggaatgcagcaaacccctaattttccttgaaggggccacggaaagccaaacggattcgtaacccggttgctcaatggtccattggctactgcaggacgcgccctcctcttacgccgcaggggctgcggggcggcgaccaggttcctccgaggggctgaagttcccttgggggtggctgagagcggccgcatctctggcagcatcctccctcccgaaaacgcgccctaaaagtagcggctgcgggcgtgggcacagccaaccccagcctgcgcctaccagaagtcgggagggcgcggaactgcggcccctccgagacgcgcccgggccgccgccgcagcactgtcgcagcgaccttcccgcccgggtccccgcgagcaaacgggcaagccccgttatcacgcaggtcacacaccccacgagtaaaaggaaaaaaccgggcagacaataaagcccaacccgcgggggcccaagcgagctggaagttgggggcgctggggctgcagcccaaggaggagcggcggggacgacgggatgcggggctgatgcgcctgggacgcggcaagccatatgtcagcccgggtgctgacagcggggaggacactgggcacgcggcggcgtcggggaggcggccggggtaagacaggcctgaggcgggaggggagcggcggcgaggtcccgaggcgccgcggtcggccgtgacccccaccccagccggggcgctgtcccgttccttaccggcagggaagctgcgggctccgccggggctatcccggccgctggcctccggagccaggaagcgcccccacatcgcgggcgagagggccgggtgggccagggacgcccgactcctcacgtccgtcctcctgcttcttcggcggcggaaacttgcgcggagcgtgggcctcggcgacacgggcaggaggaaaggcgggatggctggttaacggctgctcagctacgggcggggagcgcaggggccagattcgccgcactgccggcgcctgccatggccaagccggctgggctgaggcccgcgccggggaagcggcgactcggcggtgacggctgctagatccccggctgagcccaggctcaaaggctccaggcgaagttgcagctgcgggttctctccgccccctccgccggcagagccagagccggggctggggccgcgagggggcggggcctcgggcaatgacttcaggcgtgcgcggcgccgcgcggggcggggactgcggggggcggggactgcggggggcgggtgagctaccccgaccccgcttcgcctccttggcggcgactgggctgtcccgccctcccgccgcatccctctgtctccatcctcccgccctgcgagttgagtagagggcagcgacttggcctattttgcgatact

SEQ ID NO: 1676 - DNA, 121147 bp, Homo sapiens
cacggggcggacctcgcgcggacggacggacggagacggcgccgccacattcctatgcccgggagcggcggcggcggcggcggcggctcccgcgggaggcggcaggcgcgcggcgcggacagctgagcttctcctccgtcggcgcccgggcggacatcgcccgggccccgatggtttgagcttgcttctccctccctcccgacccccgtggtggcgaggccacgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacaggttagtggtgtcaccctttccctcccctcttcctcctgatgtggtccacatctcggtttttgttcccgattctcgaatccctccctccccgtgcctgtcttctcgtacaggttaagggagatgatgggaggctaggaagagaaagaaaggagaaataaggaaagcaggtttggtcttcaatgaagggcacgtgaatggtcaggtgggatttggccagattccttttattggatggcaaaatgtcccccccatcccccagtgagcaattttatgtttttacatagagtggttttgatttgtggtattttcttcattgtgttgcgtacatttctgcctcagtcataattgtgattacaccaccaagaaatctgagttggtttctttattattgcaagaaggtggatggtgcatagtactatattgattttgacatttgtaatgatggctgctattcaggctccgttggatgtaaggtggcctgtgtcgagtgcagtattaatttttgttgtcattctttaaggctgtatcagccttctgcacgcatgttaagttcttattaaatcagttatttaaaaccagcgttcagtttgctgactgtagggtgcagttttcatttcatattatcagtgaggcatattcttttttccaaatgtattttggcttcataaattaaaagaaacaaaaactccctactttgggaagttttttaatagatgagtttttcgaaggcgtgtgctgttgacacagaaattgtatagtacagtagcagttaaacactccctccataacccagtctttgcaaaataacaggaaaagggcctcccgttatgattctttagtgttgctttaggagcccatgttgtgaaatgttaaaaaaattagagagctgcttttcattggaagatgcttctgtaatttggtaacttttaagagtaattttacaagatttctgttccctagttaatgaagtttagatatatgaaatatttgttgaaaagttccctagtactcacaaatttccacatgttaaatatagggtttttcagggggagggtgactaatttccaattttaggactatgtaatgttttggtaaatggtttagttcagttttactgcttaaacttacacagctgagtattttcaggacttacacatcctacttaaatagcagattaatctcagtgtttggaaaatgatttgaatttgtttttggggaaacttgacattgatgtgattttatgtttatggcagccttaattttacttgaatttttatgctttgatattaagctggcatcaggaataaatatagtaaatccttttcaaattatttaaattttaaacatctctttgaaattgaatgtctagcgtaactcataggaagaaacacaaagtgttactgcctttatataaaaacattctggcaccactgatataagcagtgagaataatagatgtattttggttttaacttaagcagcacactgaagccggtatctatttggatggcaaatcaaggctatttaagtgcttagaaaacatggaaagagggaaatttacatagtcacctatgtggaaaagtagtatgtataaagtggaaggcaaagggaataagagaaatattttctttccatctggaactgagaggatacttataggatacagatatcaaaattttgccatgcatacacaaaagcttccagctagaaaatggcctactttctgggtatgtgtcaggcaggttcgtagattctagaccacttgaacatattgaacacacctgaagaagaaaggaaatgaagggaatctagtatcagtggaatctgatgtctgccaggcactctgctggatgctttgcagtaagttgtacgttagagattgataacaagtctctgatgtaggtagtgtgttccccatttaaaaaataggaggaaatcagtgcatagagaggttaactttcctactatcacagtgttagtaagtggcagaagtgagttttgatttgaggtctgactcaaaagggtaaaggtattggtggaggtggaacactgctgttagatacccagcactctgaatacattacttcatttattcctgcagcaaccctgtagatactgttctcattttgcagataaggtaactggctcacagattaatttgcacaagattaaacatctggcaagtgatgtgttctgcatgtctgactctgaagcctttgcttattactctataccgttctgcagagtaaccgttttatctgcaggtgtgaaaaatgtgcacatagtacatattgaagtctaattttttctttaaaaattgtacaaatcttaattcattttcagatagatgatattgttggctattacatttgccttggcagcagttggaatggatgaaaagaccatattcaaatgggatgaaaaacaagtttagaagaccttgagtgacttagtaacaatatattaatacattattaagaatgttatgtttgtacattttgtttattctttatcaacagtctttcaaaacaaatttatatggagtgaatagaaaaaaattaggaatttttttgatgtaaatattctttatttgctgcagatacacttatgcaggaaaggttaatagatagcatatttcaaaggtattacctaattatatttagttgttcaaaaaatcagcccagctttcaatatgatttactaaaatcactcctttaacaatgacttacagggtcttcaggcactgatttggtgttttctattagaaactttctaacttttgatgtactgaaaaagtagtcaattttataaccatatgttgtaaaagtcatttaaaatgatagctagaaatgtgagcatagaatgaagtaattgaacttaaaaaaaaaacactgatgttgtaatacctagaaagcaaatatggaatatttacttaatttgaagtcttaggagccttgaatcattttcttctctttacagtagtattacaaaagtattacaaatagcccaaattttaatagtttattttgtggaagatgcagatacaggtttgattaaatgaagaatacatttttatagatgaatttgaaacactaaatcgataatccaaattccaaaggaggaagtagttcaactatctgtgccttttctatatttgaagagcttaacccatttaagcaaagattttacagaattttctttaaatgttctgttctcttaaatcctttgggggaaatggtagatgcaaaacctcttgtgacactcttactaaactcttgaatttggaattcaaggcccacttcctagtgtcagtttatcacttcaatcttctcaactattattctcctttttatcccatttagtttagtgatataaaatatttcctatcataaatataccttgttacatttctttgtctgtcttaacaaatcttgctgtcaaagtcctgtataaggtctgactcttgtgcatatatgaagatagttgagagcagtgggtagcattgtggttaagagagacccgtagcagaggggccagtttgggacattattgcaagagtctgggcaaaagataaggtcctgtgtctttgactttgtagtcaacagaaaatttaccaataagaaaaaaaaaaaagaagttcatgaggtcttgaagtggtagggggcgggtatgataataaagctgctaatataggctgggcatggtggctcatgcctgtaatcccagcactttgggagaccaaggcgggtggatcacctgaggtcagaagttcaagaccagcgtgaccaacatggtgaaaccccgtctctactaaaaatagaaaaattagctgggcatggtggcgagtgcctgtaatcccaactactcaggaggctgaggcaggataatcgcttgaacccaggaagtggaggttgcagtgagccgagatggtgccattgcattccagcctgggcaacagagcaagactctgtctcaataaataaataaataaataaataaataaataaataaataaagctgctaatacttattgagctcctacactgtgtgtcaagcactttacacatactgtatcatttaaatcctcatgacagccttttgaggtggaaaggttacttattccaattttactgatgaggaaagtgtccggggacttaggaactcttccagagttacccaactaatggagctgggatctgaacccagggaatttgacttcagcctgtacttgtaactactgttctctatgggtagaagtcaaaaaatggaaaggaggcaaatgatagaaaaaatgttgcagagatttaatctctagtatttctaagtgggtacatgggaaatggtttgaatgaaaagggaatgtgtaagagggtgaggtcgcctgaggttttaagaaggatgaggttacctgagattttgagatttggtgactgacaggctgaattgagatgccattgacagagaagaaagtatagtaacactgaagccctggaaggagaaaatttcaaggagaatggtctgattcaacagtgtcaaatcctatgtgtttaagctatgcctttcttttaagagtttatgctttgctaggggaggtatgataaatgtataaccacagtagagttcagaaataagctaagagtcatataattggaaatatgacattcagagggagactggtggcgttaggatgcggtggggtggcaggggagaggccatttccagcctcatcagtggtctgtgaaggaagacctctctagtggaggtggtatttaagctataggctgaattgaaagtaggcatggtagatggaggaaatggtttgtgtgtagacatggagttgtgaaacccaggtagtgctaatgaaacaacatagaccagattgatgggatgaggtttatgtaatgaagcagtgagagagccagcttgaaagacaaacggacagaattatgtgaagggtgaggtgaaggaatttggtatttatttagtagttaaattatcctaagcacattggattaaaaaaaaaagaaaaaatactattaagtatattaaacatgtaatttgtgctcattattcttgtaagcgttttatatgcattatttattttaattctgagaatgagcctattaagtagatattattttattctaagactctaaaacagggtttctcaactgcagaactattggccagataattctttgttgttgggggctgtcctgtgcattctaggattttagcggcatctgtggcctctacccacctgatgccagtagtgttccctaccactacccctactcctaccccagttgtgacaacccaaaatgtccccagacatctccagatgtctcctggggaacaaaaggagcccaggttgagaatcactgctataaatattataagacacactattgtgatctaaaaaggtttttttttttgtatgttgaagtacaaattaattataagacatactgatttcacaaatattcaatttgaaaataagaatttaggaaatattatatgatagttcaccctttttaaaataaacaatgagacagatttagaggagttaactaacttgcccttgatcatacaacttgtaagaggtggaaacaaaattagagtctaagcctttgtgatactgaaatttgtatcttaacctctgagttacagtcttcctggatttttagtagagattggggttttgccatgttggcctggctggtctcaaactttggggtcaagtgatccgcctgcctcggcctcccaaagtgctgggattacaggcatgagcctttgtgcctggttgatgatgatgttaaaatagattgttgaccatgtgaacttattttctaatttacgttttatagaattttgtctcgtaacagattttgaaacagcagaaatattttctattatctaccctttaaaaaatagatgctagaggtctttatttatataggttcttgaaaatttattgacagttaaaaagtttttaaaaataggtatacaggtacagattcaaaactcaaaggtataaaagagtagatcttgtgagaagtcttcttcccacgtggaccctgagctagtcagtttctgttttaagcgagatgaaatcatcagaagatttgtttttagaaaatctcttggaatacacttaaaaatggttaaaatagtaaagtttatgtaatgtatattttaccacaatttttaaaaagatgtcttggaaacagtagaaaatgaattggaggagggccaagagttatgaaggaggaaaccacagggaagttattatgtttcaggtgagagatgatggcatcttgaatgtggatggtagtggtgggtatggaaagaagtggatgaatgtaaaggataaggcttggtgattgattggatatgtggaagaaaagatgagatcttgggaagtgttaagattgattctattttgtgagaaagggaacaatggaagagggccagtgtatgtgtttaagagcgggttggggggaaagaaccatgttgagtttgaggaatataaaatggtggtgtgtgcattaggcctgtggaaattcatgtatggagcttagaagacttcagggatgagagctataagtggtaattaaaatttaaaaagtaggtgactaccagtcactagtcacattttttttttttttttgagacggagtcttgccctgtcgcccaggctggagtgcagtggcgtgatctcggctcactgcaagctccgcctcccgggttctcgccattctcctgcctcagcctcccgagtagctgggactacaggagcccaccaccacgcccagctaattttttgtatttttagtagagacggggtttcaccgtgttagccaggatggtcttgatctcccgacctcgtgatctgcccccctcggcctcccaaaatgctgggattacaggcgtgagtcaactgcgcccggcctagtcacattttttttaaggtctcactgtcacccaggctgagtgcagtcatgtgatcaaagctcattgcagcttcaaatttctgggctcaggtgatcctcctgcctcagccttttgagtagctgggactacatgcctggctaatttttttgaaaatgttttgtagagatagggtctcactgtgttgcccaagctggtcttgaactcctgtattcaagcacttttcctgcctcggcttcccaaagtgttgggattacctgcgtgagccaccccacccagctgactgccagtcactttgagggagcgtatggagaaagaaaggacccaagacaggcgagccagcaaaggagctaggcatagggtaattagaaagaaaaccaagggaatgtggaggctcagaagactagggaagagaacattgaggatgaaggaatatgaggtgtagctgagaaagattaatcgaggactctcaaaaagatccattagatttagctacaaggaagttattgatgattttgctgagaacattttgaggggaatgtagagacagaagcatgactaggttgaaagtaaatgggagattgtatcaattatgccgtcctcacttgtagtaacaaaaagtccacctcaaattggctaatagtaaagaggatttattgtttctgaaaaagtcctcaagtgggatgggctttggttttgatttgatcagggctgtagcgtcatttctctgtgattcttttagctgtgcccttgttgatgtgtggatttcattctcaggctgtctagtctcatggtagaaaatggctgtagcggccgggcgcggtggctcacgcctgtaatcccagcactctgggaggccgaggcaggcggatcacgaggtcaggagatcgagaccatcccggtactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagcgagactccgtctcaaaaaaaaaaaaaaaaaaagaaaatggctgtagcagttctaggtctcacatctatgtaccacaccattcagagctcttctctaatcactgaaagttctacactcttctcttgcttttttcttgctcttcaaacggaaggattgattatagaaaatctcaaatatatacaataacaataatctttcatgtacccatcatccagcccctgctgtcatcaacttatggccaatcttgattcatctctaaacactccccaccactgccaattatttgaaacaaattccaaacatcatgtcatcccatctatacgtgtatcagtatgtatttctgtaagtccactccctttttaaaatgtaattgtggcacagccatcacagcactgttgtcacagaattccatatcatcaaatcaatatgaacatttctgattgtctcataaatgttttttatttttattttacagttttatttgttctagttaggatccatctaaaggccatactttgtaattcgttgatatctctttatattgttgtgtttttttttctttttcaggtatatatgaccagaagattttttttcttaatgtataggctccttctccatctcattttaatcttccttgcagtttatttgttggagaaaccagagtatttgtcctataaagtctcctacagtttggagctccatgatattaacaagtttctctttgtcctctgtattcgttataaattgatagttagatctagaggattgattgcattcaggtttgatttttttttttttttggtatactttatacgtggtgtatagttctaccacaagatacttaatatctagttgtctctctatcatgacttctctatttattagctgaaatgctgttttaaaaataaatttccctttattatttggttaccctgagtgctgtgtgggaaattaccttgatccaatggtagcctctaagtgcgtgccatacaaaaactagcctagaggtcacagaacagaaagctcacagaacaacttaaaatgcccaaattatgtgatttgttaaatcagtttttagtgagaagcaagaggaaagagataggatgagttaaaacacttaggataggatgcaaacagggaggaaggaccacactccctgaatgctgcagtatatacatttcatgtgtcctgtctctactgcattagccttctctgctgatagtgtggtcaccaggaccagagctgaggtttgaacaaagaggcccacacagacataggccagtgccacacacttgctctattagacatgggacaaggaagcctgccacagctgtagcttgccacaagcctgatgatagccatgggcattgtgttccttgggcagaggacacatgggccagactgggcatcatcaatgggtagctgaattaaggactcatgaatatcatgctcatgtgttcattgactcttgtttagtgtcatgcatatttactctgtcatgaatatttagtacttagtatatttagtgtatcatgaatatttaatacataggtgcctcataaatattaggtatcttgttttttccatccctttctatgtttaatatatgtgtgctattaactgcttacctttatttaacatgttctatcaattatatgtttaacaaacttttaaaactagctccttatctatacttaaaatatctttgaacatttcatctacattttacaaactttttcatctttatttataatagaattgaatagtctcaaaagtaaaattttattacattgagatacagggaaagcaggataaatgctatattctttctctttatgggggggaaattggaccagactgaatggatcactggcccctgagaatctgaaaggaggtaaagaatagggagaacattccagagaatgtgaaaaggctccggagtggaagagagcatggtttccaggaactgaatgtgactggcagggataggatcattccattcttgtaggccagaggaaggattttaatccttagagaagtgggaagtcattggaaacccttggggatggggtggtgtgtgtgacatgaccaaatttgcttatgggaaataagcaaattctggctacagtagagaatggtttggagcggggagcagagtgaatgtgggaagacaaaatttggagtaaatatagtaattaagataaaaagtgctggttgcctgaactagggagaaccagaacctggagtctgagattgtgagaagggggaagactttagcctggattctgtaatggattttatttatggttgaaggagagggaggcattaacgatgactcctaggtttctgacttgttcggctcgatggattgtggtgtactttattgatataaggaacactgaaagatcatcaagtttgggagaaaagattggtttggggcattttgaagttttgtagctttttcaacataatttcaaatgtgtaagaatagtataaagaattcccaaatactctttacccagatttaccaattattttgtcccatttgttttattattctgtctcattccttcttcctacctcccacacaaatgcctgtatgtgtgtgtgtgtgtgtgtgtgtagagagaaagagatagatagatagatacatcttttttttttttttgagacagagtttcgctcttgttgcccaggttggagtgcaatggcgcaatctcagctcactgcaacctctgcctcccgggttcaagtgattctcctgcctcagtctcgcgagtagctgggattacaggtgactgccaccacacccagctaattttttttgtatttttggtagagaccgggtttcatgatgttggtcaggtgatccatctgcctcggccttccaaaatgctgggattataggcatgagccaccgcgcctgcctttttttttttttttttttgagacaggagttttgctttgtcaccaggctggaatgcagtggcacgatctcggctcactgcaatctccaactcccgggttcaagggattctcatgcctcagccacccaagtagctgggattacaggcacgtgccaccacgcccagctaatttttgtatttttagtagagatagggtttcaccatgttggccaggctgatcttgaactcctgacctcaagtgatctgcctgcctcagcctcccgaagtgctgggattataggcatgagccgccatacccagcaatgtatatataacgtgtgtgtgtgtgtgcttgcatatatataggatataaataaatatatataatatttctggaccatttgagaatatgtaaagagatattgtaccctacactccttcagtgtatatctcctataaaatgaaggatagttcctgaacataatctcatttaaaaattgggaaattttagctgggtgtggtggtgggcacctgtgatcctggctacttgggaggctgagacaggagaagcacttgaatcaggaggcggaggttgcagtgagccatgatcgcaccattgcactccagcctgggtgacaagagtgagactccatctcaaaaaaaaaaaaaaaaaaaaaaaagctacaagctacaatatgaggctatggtaaaggcagggaccagactaccagattagtcagttctctctaaatcataacagaatatttaacaaaccctaggagcaatggaaggtcactggtgtgtcaaaagctttccctggctaatagtaaggatgaaaagatggtgagagcacagaagtgttgctggaagtcacgcaagaggtatgggacctggaatgaggtaattaagatggagagacacagaggtgttcacagtctgtgtgggaatctgtgttggaaatagagcttggttataaattagatggagaatagggttgggctgtgggtgtaacaggtgcaaaactgagcctcagttgactcatttggaaatagcagagttgtggtttactgacgtggaagcactggattggggcagacttattgtgtgcaacatgggccacattaacttggaaatgcctgtaaagcatacaagggaagatatcacaaacataatctgtggctcaaaggggaggtctgggctacaaatccaaatgtatttttttaattttatctttcactttaaattaaacattaatgcatgaccgttgggggaaaaaaagcattaaaaatgaccatagagttctttctctacatgtgtacacataattattatttacaaaagaattatattatttttaatctgatttttaacattttgagcacagtttcttcaggtaaatatagattccttctgtgatatgtaactttactgagcatataatattgcttaatgtatctatactgtaaattattaacctggttcttattttaatatatatagatggtttctaatattttgctacaataagcagcactacaattaacactcttatatgtctttgtgtaatcacttagtaaaattcataattcataagaaaaaaaattgggaaatttaaccttgacgtgatactcttatctgattcacagcccgtattcagatttgccaattatgttgattttcattattgctattttatttcccaattcaggatcatgctttgcatttagttgtcatgtctcctttttttttttttgctgagatggagtctcgctctgtcgcccaggctggagtgcagtggcgccatctcagctcactgcaagctccacctcccaggttcacacattctcctgcctcagcctcccaagtagctgggactacaggtgcccgccaccacgcacggctaattttttgtattttatagtagagacggggttttgccgtgttagccaggatggtctcgatctcctgaccttgtgatccacccgcctcggcctctcaaagtgctgggattacaggcgtgagccaccgtgcctggcctagttgtcatgtctcttaagtctcctttaacctggaatagttcttcagtctgcctttgtctttaatgatattaacacttctgaagatagagcaccagcctgggtgtggtggctcacccctgtaatcccagcactttggaagattgaggtgggcggatcacttgaggtcaggagtttgagaccaccctggcaaacaaggtgaaaacccatctctactaagtggtgtgtgcctgtagttccagttacttggtccgtgcttgtggttccagctactcggtaggccgaggcaggagaattgcttgaacctgggaggcagaggttttagtgagctgggattgtgccactgcactccagcctgggcaacagaggcaaaactccatctcaaaaaaaaaaaaaaaaaaagatagagcacccttagctgtgtgctggctggatatcaagccccttccttaggcattgtcttagctcttgccaaacttttgcctgtgtgtctggtacaagcagccagttctctgcaggagctgactgggtgcctccttctttgtgttcctctttactctggagtgctgggccctggtttagcagatgtccccctccacccttggttcaaatgactgggacaatgatgagatccttacatgggtgctggtattgataggaatacctagacagtaggaaaaaaacaaattacacagagtcctgccctcaaacaagagctgatggagacccaggaactggagaccatctcctaaacccctactacttctgccctctggtgcaccctatcttttggctttcttccctctttcgtacttcccttcttccctctcttccattcactcttccctgctcccctctggcagacccactctgtactcctcttgcttgtcactgccactaccacgaccaccagttgtctctctgtcagcagatgtgccgtgttgcctctctgcacagtaccatccctgcattccacagaagacttgggcaagggtgcctgagaggtacccagagacaaatcacgtggcagccaggcagccccagagcaaagatattcagacagatgaaagtctccttacccccatttcttccaagatcagaacagcttgacatactccttcatacacagtgatgccaggaaggcaggggaggcgtgggaagtcttccttcccagtacctgcaaaatgtctgagcattatgttgatttttttcctttattaaaatgtactgtttaatcttataagaacaatatgcctgttattttatagaatgtctctaaatttggatttgtttaaggtttctttattcaagtttgataaggttcaagttatagaagcctggtagactactgcagaagagatgttgtagtctcagtaaatcatatcaggggacacataatgtttgttccagtataggtgatgttaactttgatcacctggtcaaagtggtatctgtagttttctccattataaaattatttttccactttaaattaattagtaatttatagggaggtaattcaaaatatcctgttcattaaactgttacccaccattttagaatccagtaatgatcttgcctgaaccgattattgctgttgattactatcctttttttccatttgtttgttggtattattctaccacaagaaagagctccttttttttttttttttttttttttttgagacgaagtctggctctgtcgcccaggctggagtgcagtggcccgacctcggctcagtgcaagctctgcctcccgggttcatgccattctcctgcctcagcctcctgagtagctgggactacaggcacccgccaccaggcccggctaattttttgtatgtttagtagagacggggtttcaccgtgttagtcaggacggtctctatctcctgaccttgtgatctgcctgcctcggcctcccaaagtgctgggattacaggcgtgagccaccgcgcctggccgaaagagcttttttaatgtattatttatttgtgtcaggatagactcattgatgcgtgttttattcagtgggttataattctttattatgtattctgatgttggtgttttcccagttttagccaatggcatccccttccatctggatcctgtgttcttttgacatggctccattatttgttagcatttccttactttctggcacataccacaacaaagatgttctaagcatatcttatactttccctgctccagacctggaaacatttcttcaaggagcagtgttgcttttggtggggaaggtattagaaaccaagatacaggtgctaggcttattgctaacagtgttatttagcagacagatagtaaacacacacatatatacatagtgtatagctaaatctatttcttttgctatccatataaataaagagatatatatctgaagcatcatgtatttataatgacacttcccatttcaaccagcaccacagagtttattctagtttttcctttttccatatttgtaactcccctggtcactgagaaacctggctcccattttgagttaggtttctttgtgacacccaagtgaagagctgagtaggctgatggcttataaggatctggagctcagaagaggtgctttggccttatagggtaatgggaggagtagaggtgataatttaagctcaggaatgctgtaccacacttaccatgttaggtaataatgtagagggcaggagggagctaacttttaattggtaccttcttggaaggcaaggctctatgtgtaggtaccgtacagtcttggtaaatatttgagtgcgtactgtgtttcagacgcagttccaggtactagtgacacaggacagataagtatcttgctctccttcaggtaccttatagtgagaggaggtagaaataaaatattatgggatagtaatagttgttatctagagaattaaactacaatgagtgactgggtggtcagggaaagtgtgtttgaggaggttacatttaactgagatctgaatggaaagagccaaccattcattcggttaaggggaggaacattagaggcagaaggcctctagtgcatgggccaaaaggtctgaacctggcatattctagcaacaggaagagttgggtgtttggaacatagcggcctggggaaagtggaggaagttgaggtcagagtaggagtaggcagtacatttgtggaatatggagaaactaaaactcagagaagttaattactgaactcaagatcccatcaagtaaatggctgggccgggcatggtggctggtgcctgtaatcccagcactttgggaggccaaggcgggcagatcatctgaggtcaggagtccaagatcagtctggccaacatagtgaaaccccatctctacgaaaaatacaaaaattagctgggtgtggtggcacatacctgtagtcccagctactcggaaggctgaggcacaagaattgcccgaacccaggaggtggaggttgcagtgagtcgagatcacgtcactgcactccagcctgggcgacagagtgagactctttctcaaagaaaaaaagaaaaaaaaaagaaaaaaaagtaagtggtgaaattaggactcaaccgattcttttaaaatctaaagcctatactttctcaaagcccaaatttttccaaattttggaatggatgcaggtagtgaatgtaggtaaactgaaaacctatgtggttttgagagggattgctgtcacagaaattaagtgtggcccagagaaaactaaagtttctcaaagcgtgtacaaggagtaaataatgattactagcacagaatcaggtagtaaacttgagggggaaatttgaaacctgggagtactttcaggaaaaggctagtgactagaattttttttaataacatttttatttattcatcaaatctttccttaccacgtaccaggcgctgagttaggccctagagattcatatcatggtaaatgaggaagacatgatccttgccctttggtcatatattagggtattcatatcggtacacccttgtcaacagtgggtttaaactttttttttgtttgtttgccattttgataactttaattactggtactatgaagttttaaatgttattgatcatctttatgtcttttggttaatttcaagttcagattctgtggcttacttttaattggagttctttgaaacttagaagttctataatagttattaccttagaaactattttttagatttggaaaataaggtggcattcctatgatttagtgtgatgatatttctaaaatgtactcccctcctgcttcctgcccctttattgcttttaataaatctgtgtcacttgctggaatgtggatgcaactggtagctaacccagttttatagaaaattgccttgagcagtactgtctctgctccctctacctgtacctcaagcatttcaggtggatgttactttcaaaacttaggtctagtcaggacttatagtagcatgattaaattatgttctgcttaagtcatggtatacaagaaaaactcatctcatatcctttgcaattctagcagtggtatttcattcagctgttctgtctgtattaatttcttactttttgtgttctggaggttagggagagagtgaaaccccttatctttgattttgctgtttattttctaatatgctgtttcagttcatttttttttaatgtggtacaattccaaactttaaaaaaaataatagttttataccattggtaaaatgatagacacatttgaagtcttctcttaagtatatttagctcttgaagacttgtttttaaaatgacctattttatattcagtatgaagttttacattctcttgagggctgaaaaatctatttttgttgtattcttgaaacagtctttgattagctgtggatcctttcccttttccttgcattggggtctttttaaaacttacactttcacaacttaggttagtggatatgctttaatgaaatggaagcaacccctggactcttgtcttccaccttccacccttttgatcttggcaaatcattattatgtttgagcctgtttagcaagatggtgtagagctataattctgtgcttatcagctatgtgcccctgggcaagatgtcctttcttgagttctttatctgtaaaataaggtaagagggttgtcagaattaaatgacagaatgcatgtttaggactgtgtctgacaagatgttataaaggtcatatatgaaaatggatgtaaaagcagtaagtaaatgctaggtggatatataggtatgatagataaatttgtaatcctgataatgagcatttacttttcacagctaatatttagatgccaaataacttatattagccattttttactgatacaggaaataaaaatccattgtttatacatttgataagttatcttaaaatcaaataattttccttttacagctgttctactaatagtttctgtttatttcctacaatactaaagtgtaaatgaataccagcactatattctgcaatttaaaactgaacttcaccatcacgctgaggcagctatattaaatttaaagctggctcactactgggtagtgcatctacgaagaaaggaaagtgttttcaattattaaatgaggatgatatttttagatgtcaccaaaatcccaaattgatacatccactcttgacctctttccagagtcctatatctccagctgcttattggatatttccacttggatatttttgctattgtttcaaactcaatatgtctaaaactgagtttttgatcttgcttttagaattggtgctgcctctgattttcatttttctattaatgatatcactgtttccctcataacgtaggcttattattgatttccatcttgaccctctttctttgctttattcctgggtactttttgtttgtctttagcagttagtctcttatgtcctatactttctgttttcactactgcctttgaacttcatttccttatatctatatggtaatcttctatctctgatttttatggccatcaatattaaataccagattgttccaaaacgtcagtcttaatgtgacactgtcctgtaaaactgtcagcacctccttgttagctaatatacaaagtcctcgtgtttaaaagatgaatatttctttcaagtcctcatcacgaacctctcccattccagctttgcctcttactgctttcccacatgaactcttctctccacccagattgttcaatttggtgtctcttcacatcttttttccctactctttctctcctccctctccttacgtttagaaaggctcttttttttctgactaaaattctgccgattcctgctattctattttttttttttttttgagatagagtttcactcttgttgcccaagctggagtgcaatggcgcgatctcactctctgcaacctctgcctcctaggttcaagcaattctactgtctcaacctcccaagtagctgggattacaggcacctgtcaccatgcctagctaattttgtgtttttagtagagaggggtttcatcatattggtcaggcaggtctggaactcctgacctcaggtgatctgcccacttcgacctcccaaagtgctgggattacgggcgtgagccaccgcgcccagctgcagatttttcgaagtaccagttttggttagtattgtggcattattgagcttatattaaagctgcctattcaggaaacagctaagatcagtgatgggatggctggcttcagaacctcactttctagagagaaggcaggtgagggactggctaggtctcaggacagagctatcaggttctataattgcagctccatgttaacctctaactcagaagccctacctctgggggacatacctcatccttgtcctgcttcgatgagaggtatagagcccaggtaagaaatggagaggaggaggaagagatacagggtagaataggcaagaaaacttgtaaaacaatgagaagtattttgtttctctcgtttgttttggtaattttgctgctgtcaaatacaaatgcctttgcttaagttgatttgggagcagacattgggagagtgggagtggacattggaagagtaggacttggcattcttaaagggtagtggctagcaggaaagagaaacttcggaggagattttggttttcttcccatctcccatttctaaactactacttatgttttagtcgaacttgtcagttgggtgcccaggaagtctttttcaggtaggatggggagtggtcagtggtaatgtggcaatatcagtggtttactagtgtaagggatttttaagagtagttctctcctaaacaattgctataattctttttcagtagtgtcagcaagctaagcatgaagggagagacggcagaggtcttgaggcaaagagatagaataagttaggcagtctctattctgcagctcattagctgtaaaactgggcagatgattttgtattctcaggtggcaaggactagcagtctcctgaaatacctattgtgcatttccatgttgacagcttgcctgtgaggagcgtcattgaaattagtttttaggaatcttatagttcattctgtagatttgactatgaatgtgggaatactttcccaagagccactagactcagaaagcttttctccttgtcttgtagtccctttttggaatatactcagaaagtatcttctgtaaaggaaatttgtatctttgtctcattccagagtatatgtcaaagtttaatgaatcatcttttcagttaaagggttattgctatatttttagagggaatcttaaattctatgacataaataataattattaattaaattctatgtttcttttataaaaatcttgtaagagaattttttccattaatctttatagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatggtgagtctttatatacccaagattattttaagtttgaagtgtgtacttttgagtgtgaatgatatactgtaaaacagagggaaatgttttgaaattggattgtatttttgcctagagtttacaactcatctttttcttaaccttgtttccaaatgaaggaagattttaacgattttggaatgtttggtgccatctaataccttggagaaacaactacataatttccaactaccttaatgtaattttaattgaaaacttttattttttccgttgtagagactggctagaagagatggaaaatgcatccttgactttatcattaggaaagagttgagattaataagtgctgatttatggccgggcgcggtggctcacgcctgtaatcccagcactttgggaggccgaggcgggcagatcacctgaggtcaggagttcaagaccagtcttaccaacatggagaaaccctgtctctactaaaaatgcaaaattagccgggcatggtggtgcatgcctgtaatcccagttacttgggaggctgaggcaggagaatcgcttgaacccaggaggtggaggttgcggtaagctgagatcatgccactgcactccagcctgggcaacaagagcaaaactctgtctcaaaaaaaaaaaaaaaagctcatttatgtacttgaataacttcttggtaaatttctgcatatcagatattttcgtttatttgatagctttgaactcattcttgtagacaacacacacagaaggcctctaagctggcctggggccatcatgcaggaactctctcataggcagtctcaggaaacataaatctaaatgtttaagttcattgtatgctggttcagtccattgtactgctttagcttgagtttcacaaaatgtggacatcatcaaggatggtattagaaagaaaagtggtttttccatactcgattaaatcaaagagtagtagttttgcttgggaggaaggtaaggtgtatatgtagaaaagtatattataaaatttatgaagttatgtaatttaggaagaatgaacaaaaaaattagtttataaaatctattactaaatgaggtgatgacctgttttgttttctggtttttttccttctttaaagtaactcttttaatatttctaagtaatggaaaataatgtattgattagttaatggaatttatagatttacaatatagttattaacaataactagaatattgattatccagtatgagattgtcatctttcattgatggctccaaaatcaccttatagttaccctctgactttggcatacctgctttgcatacatatcatatgtgaacagtttgcccataccagggacaagcagaatctacttaggtccttatcagtgtctcatattcatctcccccagaatcattcccctagctggacactccagcttgtgattacttctgcttccgttgtttgaaggctaagtggatagttagaaagcacatccatgactttgtgaagcagtgtttgtttagttgctgttctttcagatacagatatatatgtcatagataacctacttatccttagagtgtctatttcagatcctctaataagaatgaaacaaatttaacatgttttctacatttttttccagtgtagtttgtatgtgtgaaatacttggacaattaattttaaaatgaggggtttggtagactgctgattgtgttactcatgtttctttcacactttattgatcctgctgatagctttgaatgtattttaataatatttaaggaatggagtttaaatgacttagaatctttttttttttcttagttggagtctcactctgttgcccaggctggagtgcagtggtgcgatcttggctcacagcaacctcagccttctggtttcaagcaattcttgtgcctcagcctcccaagtagctgagattataggcgtgcatcaccatgcccagctaatttttgtacttttagtagaggctgggtttcaccatgttggccaggctggtcttgaactctagacttcaagtgatcctcccacctcagcctctcaatatgctgagattacaggtgcacggcatgggcaacatagaatctttatctctggttctaacttctatttgtggattgttagaacttgagaacttcaggctgggtgtggtagctcacgcctgtaatcccagcactttgggagacaaaggctggcggatcacctgaggtcaggagtttgagactagcctggctaacatggcgaaaccccatctctactgaaaatacaaaaattagccagatgtggtagtgcgcgcctgtagtcccagttactcgggaggctgaggcaggagaatctcttgaacccaggaggtggaagttgcagttagccgagattccgctactgcactccagccagactgggcgacagagtgagactttgtcttaaaaaccaaccaaccaaagaacttgagaacttcatatttgacctacatcatcttaaccctttgcagtgtcacatttaccaacctgtgttttaattgtttactttcaacttttatcacaatttgatttaaagttttccagttgctgtggcattttgattgatgatatttaatgtaactattttcctgaaacctgcgtgagaaaatttctcagattactagtaaaaagttgttccttaagaaactatgtttttggctgggcgtggtggctcgcgcctgtaatcccagcactttaggaggccaaggagggtggatcatgaggctaggagtttgagaccagcctagccaacatggcgaaaccccatctctactaaaaatacaaaaattagccaggtgtggtggcaggcacctgtaacccgaggtcgggaggctgaggcaggagaatcgcttgaacctgggaggcggaggttgcagtgagccgagattgcgccactgcactccagcccaggtgacaagagcaagactccgtctcaaaaaaaaagaaagaaactatttttttaaagagtaaagtaagagttaatgtaaattaacagtttttttttcctgctttttgggaagtatcatgaaaaatagtgtgtttaattgcactgaatatattgccccccacttccacttctaaattatttttaatttgggatattttatttctgtatgccagccttttggggggaaaaaaagtgtggtggtagcaaaagtatcatcctaatttttcaagaaataatgttagtactaattctttttcttcaaagtctcagtataaaaatttcctgtgaaataatatatatgaagacagaaatctttagaagaatttacaccagactgttaactttggtttcttctgtgaaatgggattaaataggattggagaaataaatggtaactttcatatcttatttgatgtatttctgcactattaacatttttatatgattttactgttttaaaatttaaaatgtagagaagaaatttaaattcaaatagaaattatcattatctgaaataacatgccttgtatgcatactaaatatttctgatagttaaattgttaaagagaaataagtatcctgcatttagcctttaagcagacataggaaataagaataaatattgaagacctctctaaatggttaaattccaaatatcccgtaaatggcaattcaaacctttaagatatcttttctgtagttccttttagtaatcaatctttaaaaagaaaagatgtggctgggctcagtggcacatacctgtaatcccagcactttgggaggccaaggcgggtggttcacctgaggtgaggagtttgagaccagcctggccaacatagtgaaaccccatctctactaaaaatacagaaattagctgggcgtgatggcaggcacctgtaatcccagctacatgggaggttgaggcaggagaatcacttgaaaccgggagaaggagattgcagtcagccaagattgcaccattgcactctggtctgggcaacagagtgagattccatctcaaaaaaaacaaaaaaacaaaaaaactcaacgtaacttctcaaaacaaaaacatttctctcaatctccaccccaaaattaatactacaatctgcttatcagtcaaacttgccttagtcatacttctttatttatttattttttcgagactgaattttgctcttgtcacccaagctggagtgcagtgacacaatttcagctcattgcaacctccacctcccaagttcaagcaattctcctgcctcagcctcccgagtagctgggtaaattacaggtgcgccaccatgcccagctaatttttgtatttttagtagagatggggtttcaccatgttggccaggctggtctcgagctcctgaccttgtgatccactcacctcggcctcccaaagtgctgggattacaggtgtgagccaccgcacccggccatatgttatgttctatgtatccagctgaccactgacatctccgcttgaatgatgtttgaactaaaaatctaatgaggaagaaaactgggaaaaaaaactagacagtatgaaataagtgttctaactttaagcaatagatactgagatcttagaggtggatgtgatcatctctattagggaggatcagggaaggcatcacagggtagaatgataaatgggatttcagtagttgggaaaagggatgggatgagagtagtaactgggttgaaggaattgtttgactcaagattgaactgtgaaggtatgttaagtattataaattaaaatattgactgcatggagggataaatgtcagatgaggctaaaaaataatttagagctagatcatgaagagtctgtaagttagataatgaggaggctgtaagtctgagttaaggatttttaactttctgtgggttacagaatcatggaatagattttcatactatattacaaaacacttggaagcattgcaaactgaaccgctatactgtcagcttagtttaaataattattgcagtctgttaattctcagattttatctattgtttatttatgagactatcaagtagctcttttttttttttttttcctgagacaggatctcactctgttgcccaggctggagtgcagtggcgcaatcacaactcactgtagcctcgacctgcagggctcaggtgaccctcccacctcagcctcctgggtagctgggtctgcagacgtgcaccaccccacctggctaatatttttttattattttttttgtagagacagggtctccctatgttgcccaggctgatctcaaactcctgggctatgctgggattacaggtgtgagctgggattacacctggtctatcaggtagctcttttcatttagtttactgtgtgccatgcagtgtgcttacactttaacactctatcttacgtaatttaattcttacaacaactccaagaggaaaggatcatcccttttctattgatgaagaaactgaggctttgagaatataaggtcacagagcaagtatagttaagtagtgaaggcaggattctgaacatctctgctttaactataaatcctatattctttttcggttttttttcttattttacttctcttttacatgataacaggataaatcctatgttcttaaccactaaattgtattttcgtctttgcctagggaataggtagatgggaagtagtaaggtggaaggaaatagaaatggtgtgccacctggaactctgcctggtggtttgtttgaaatcttggtaatttgcctaggtttctttccaaagtaatttcccctctctgttccatttacccactctgttcctgtattaaaggttatgttaattccatgtaccttaggagtaattatagcagttaagtagaatgactgctgacaggggatgaagtagagttgtgacagagtctaggtggacatgagttaattgatacagtatttaagaatatgcaggcagggcgtggtggctcacacctgtaattccagcactttgggaggccaaggcaggtggatcacctgaggtcaggagttcgagaccagcctggccaacatggtgaaaccccatctctactaaaaatacaaaaaaaaattagctgggcatggtggcgcactcctgtaatatcagctacttggcacatgcctgtaataccagctacttgggaggctgaggtgagagaatcgcttgaacctgggaggcagaggttgcagtgagctgagattgcgccactgcactccagcctgggcaacagagtgagactccatctcaaaaaaaaaaaaaaaagaatatgctgaataattctctagttaccattatttttgctggatacacaaaatgtattgagaacagagaagctgatcccaggaactttgtgttgtccctcttttttttttttttttttaaacatattggtcttatttggcaactatgcttaggaatttccattgtgtcaccatctgttggaactcaagtgtaatttacttgtgtagaggcttgttaaaaaaaatcctttccctgtttaagaacaggattatataaatgtagtattgtaatagtaggtgagaagacattaatttctggtcacccttgtatatgagtggcttgcaaatttataagccaaacctgtctttgaaaaattaattacattctcatagatgttgttgaacagggttttcttcttcatgcacagtgctagaactcaattttctgtttactactcatgtacctaataatgttccattatttctaggtaacatctatacctctgttacaaattcacaatatcttttgataccttacaaccatgtttatcatgttagagtaactctttatttgtgatcatttatttggagctccaagtttactttctcatagaaataacttgatgaatggtacttactttactaggtgatctcacaaagactctttttaataaaactgaattgtcagaccatttattaatttatttaaggagcttctgcattgtcctttgtattttctaccatgattacaaagagtttcatgttcttcagtgtctcactttctagcggtggcttatagaaaactgtccaatgttttaggagtgtaaaggcaccaaactctgtactacacttcaactgagttttgaaggatgcggaggaatttaccacatagagaaatgaaggctgtgttgtacggtattgtatttgggagtataatgggatgttaaaagggagtgtgagagcatggtgaccctcaggtcaaaggaagcagcttagttgtggcgttagcactagctgccttttgaggggtgataagaaacgagatcacagagttagatagggttagggcatgaatgatgttttgtgctatgccaagtgtttacgttatcctggaagtgatgggaaccctagtgtagggttttaagccagagagggtatcatcagatttgtgtttcagaaagtcactgtggtgtattgtagaagagataccacttaggaggctgttgaaatagctggaggcctgaactaaggtgcaggccatgaagatttattagtagggttgagtgggagagactttttttttgttgttgttgttttgagatggagtcttgctctgtcaccaggctggagtgcagtggcgcgatctcggctcactgcaacctccatctcccaggttcaagcgattctcctgcctcagcctcccaagtagctgggactacaggcgtgtgccaccacgcctggctaatttttgtatttttagtagagacagggtttcaccatgttagccaggatggtctcgacctcctgacctcgtgatccacccaccctggcctctcaaagtgcaggggattacaggcatgagccactgtgcctggctggagagacctcgttaaggtaggattgagatgataccttgatttatcaagaattgggagattaggaagagaaaccagaacagggctggcaaaaaatattttatcccttatgtcaactctaattaattaattagtagttaactactggaaggtgggaaaaactagctccttggttttcactctgttcctttgagagcctcggggtctagatgttcccttccccatcctttgttcctcctagtgcttttgaactcttgtattttttacctaatagtggtaaatgacaaaaacaagtaaaggaacagctttataagtttgaagtcttgagctgatattgctaaacttactatttttgatgagaaagataaaggctgttctgtaagactcatactaagtttctcttttcttcttagaaaaagagttgaaaagagtttttcccaacacaccaagcaacggacaccagtggggtgtcctctaattcagttccaacattatctacctggagatagtatcagatcagtgtcagatcccacaggttgagggcttagtccccaagactaccccaccaccacaccagtcacaagtccaggcctccggtacttctcactgaccggcttcaagttggggttcccatgaccccctctttgggttcagttaatttgctggagcaactcacagaactcagggaaactcttacttacatttactggtttattataagggatattgcaaaggatacaaatgaagacacgtttagggcaaggtatgggagaaagggtgcaccaccctccaggaacctcactgtgcttagctgtccagaagctccctgaatcctcttctcagttttttgaagctttataatcttggcatcccttttcccagggtatagggtgggactgtctcatagagggtcttaagacccacagtcagaaaggcaggagaagattagattcctgccttggggcaggtgaaaggagggcaggagattctgtttcctgaggcctaacacacccaagattataatgaaagactataacaagggctttagaagttatgaaccaggaactgtagatggaaagcaatatatatcataacaccacagtgatcaagtagatagatgattctcccctatcatgtcttggaagatgtgaggtgtgggattaaaaaagtgagtgtggaaacgggataggaccgaaggtacagaattgtagggatgacatgagggatgaggaaaattgagtacactttacaaatattatgaatgtaatgtatgatataggtggtgccctattgatgaggaaattgatctataactgactccaaaaggtgagttaacttgcccaaagtcaaacaggtaataaacgataatgttaggatttaaacttgcatctgctgattccaaagcccatgcttattctgtttacaccatgaggccttcccaaaccaaaacaaaatgtccccctactatttcttttttttttttttgagacggagtctctgtctcccaagctggagtgcagtggcgccatcttggctcactgcaagctctgcctcctgggttcatgccattctcttgcctcagtctcctgaatagctgggactacaggtgcccgccaccacacccagctaatttttttgtatttttagtagagatggtgtttcattgtgttagccaggatggtctcagtctcctgaccttgtgatccacccacctcggcctcccaaagtgctgggattacaggcgtgagccaccgcacctggcctactatttctatagtacttaatagtttgtaaaacatgtatacgttattattattattttctgataataaccagagaaggcaaatagggcagttattaccatctcttttttcacaagtaaggaaactttacggatgggtttatttagtagatactcggttcttagtggaaagaggtgtagaaagaaaaaatgcatagatcatgatcacatggctaggctagttagtaacagagcagagatagatcccaatcttcttacttctaacccagtgcttattctacaaatgcatcctgcagccatcctttttcctgtccttgtggattataccatgtattgattccggaaagactaacagagaatatgagcatggagtaggatgtcaaacactgagaggcgatagcaaagaaggggagaggggaacagggcaggaatcccaagaataggaatagaagggagaaaaggggattgttttgctcacctgactaaagcattattttctcatataagagatatatcttgtttagtgaccaccgacaggaagatttagatctacaaaaataatttactttgcaaagtaattttttatttaaaaaatgtttagaattaattttacattgttttagaaaaatagaacttgaagtaacaagttttcaagaacacatgtgaaatgaaaaataccatattcattataatgtttaatataatgttgattatattaaaaattatctcgttcttaagtaaaatatacattctcctttactgataacatattttatattttttatattgtaccacatatcatgcctggtacataagggcttgataaacaaagtgttaatttctggtcataaagagatattttagacaaattggggaggtggataattccttatttttccagagaccatgtctatgcctctcactttgcttttggccattgctgattgatctcaggattaagaaatcagatgtaagatgggctgactagattgttttctggaaaactggaaacccaaagggagggagaatgactgtacagtgatggaaggtggttggaaccaccctgtcttatagaagcagtgccctagggagaaatctgtgagctcctgctgctgaaataccggtgctgctcaatttccatgctttctgagcttagtgttttggctcttccttagattctgtgaactactttagtgttccctcagtaaattacagctaatttaacagggttagattctgttgcctgccattaaaagaactgtagctaaacaataaataaataaaaagccacccattgaccatttttactcacttgaggacagatttcattacagaagtatagttttagagctgaaagagatcctagcaatcatctggtctcgagttttgaaattctcttaactatgactcacagttaggaatgcattttacttcaagatacccacctggtttacctagttacacatgtattacagaaacaaaagtacttatccttgtaactttatttttttaagattctatttgaaaaaaaaatatgggttgtgaccaactaaattgactttatgcatgacccatgaatgggttataaacccacatttaaaaaatactaatgtaggctgggcacagtgactcacacctataatcccagcactttgggaggctgagatgggtggatcacttgaggccaagagtttgagaccagcctggacaacatggcgaaaccccgtctttactaaacatacaaaaactagccaagtgtggtggcatacgcctgtaatcccagctacttgggaggctgaggcatgggaattgcttgaacccaggaggcagaggttgcagtgagccaaggtcatgccactgcactccagcctgtgcgacagagggagactatgtctcaaaaaaataaataaaaataaataaattaattaaaaatacaaatgtagttaaattgctttatcttatagagaagagtggtaaaatgacagtgttactagaaactaaataccatacccatgtttttctttaaaaatgtattttcattttcaaattaccaatagcatctatttgtttgaaaagagctatggaaataatttgttgtacatactcttacttccttgaagtttgtctaatctctatggtatactgctgccagattaattttcctgaaatatcactttgatatctagcttatttcctaattcaaaacttttaattattttatttgacttaaaatgccatatatattttggtttcagatgtatgtccttttaaatttgtcagattttcagagctagcaactgtaagtatgagggaagaagttgctgcaaactttgtccataaattagataattcacttttgaatagtggaagttttatattcctttgtttgtaatcttatgtacataagagacaattcaaagtaacaaaagctaagatacttaaggagttgtctgatattacagacctgccagcaataatttttatgaatatagaagatgaattaagcatatattaaccatgacttttcattttttatttttatttatttatttatttattttgagacagtctccctctgttgcccaggctggagtgcagtggtgtgatctcggcttactgcaacctctgcctcccaggttcaggtgattctcttgcctcaccctcccaagtagctgggactacaagtgcacaccaccatgcctggctagttttttttgtatttttagtagagacggcgtttcgccatgttagccaggctggtctcgaactcctgacctcacatgatccgcctgcctcagcctcccaaagtgctgggactacaggtgtgagctaccatgtccggcctcatcttttaaaaagataaaaagatttctatgcattcactgcagattaataaatttaaatagatggtatattgtaagttagcgtcagtgtctgggacctggcctattgtggagtaataatgttctcctagtttaaatatctaaaaaactaatagtagacacacacatataaataattggagtggcttggtgcggtggctcaggcctgtaatctcagtactttgggagactgaggtgggcggattgctggagctcaggaagtcaaggctacagtgagccatgattgtgccactgcacttcagcctgggcaacagagcaagactctgtctcaaaaaataaaataaaataaaataaaataaaataaaataaaataaaataaaataaaataaaataaaataaattattggagcacaaggttgagatgttttagtaggtttggtattaaaactacatatttttctgatttgcagaatacagtatagtgctatagaacagtggacagtcatggcagttgtctgtggccatccataccccagtgtgtgttgagcagattgatgctccaacactgccatgatatggaaccatttttgcaatttgttaggttatagcagtgaagcagattgtttttaattaatgtcagtgatgtgatttagtggaataaaataggtggtcattaaaacaaaaactttagtaactgttattttgttgcttgcttgttttccggtaactgcataaatgagcttctgtaatagaaaaaaaaaaaatctttacaatgctcagattccttctcagcctgtactgttccatgtttgaaacagtgttagaatgagctgtgttacaaagtgcactatgttagaagctgtcccaggggcccgtcttttcaggaagttcttttgctatacttggaggattgtgagaatactgattattgttttcctgaagctaaaactgttagtttgtggttagcaaacaagtaaacaaatattaaaaacgtaactagagagtggtgaaagctgtgaagaaagtaaaagcaggataatacaagtgatctgaaggaatcatgtgttattatagttagagtggctaggagcagtcttatacaggagattatatttgagcagagatttgaaagatgaggagccatttaggcaaagatcagaggctatcgcattgccgacagagggaataaatacgaagaccctgagttagtatataattcacaaaataaataaacttcatggctggatgataaaggtcctactaagaatttcctggagggaacatcttcaggaatttgaaagtgtagagtcacatttatttaccatataatatgtgtgataggaagtacttgactcattcaataagtactttttggttacgggatgtagtaatgagaagacagaccaagcccctgctttcatggagctactattttagtagtaaagttgaccagtaaacaattagacaaattgtaacaattgcaggaaatggtaaatgctgtgaaaaaaataaattagtaaggagctacaaggagtggaacaggctcttttcataggaggctttcagggaaggcctgtcaactgagttgatatttgaactgagacctaaatacctgaaggaactggcagatgatctggaaaaagaacattccaggcaaaagaaatagtaagcttactggctctgatgtaagaggagtttggtatgtttcaggaactgaaagaaggccactgattttggtagtgagcaagattgatatggagagtgataagagatctggttgagaaaaagattgtagccaaagcaagtgaagctctataagccagattttattgtgaatgtgcaaggatgtctctggaggattttaaggaggacaatgagttgatctggtttatttttttttcagaatcattaaatgccataataataattttggtaaaatagaaaagcttcctttttcatgaatatccgaggcttttttgttgtttgttttttgagatggagtctcactctgttgcccaggctggagtgcagtggcgcaatctcagctcactgcaacctctgccttccaggttcaagcagttttcctgcctcagtctcccaagtagctgggactacaggcacacgccaccacacctggccaatttttggatttttagtagagatgaggtttcaccatgttgacccaggctggtctcgaactcctgacctcaggtgatccacccccctcggcctcccaaagtgctgggattatgggcatgagccactgtgcctggccagaatgtttgtattttaatgtagtaacattatagtaaaacaaaataatttgggaaaagacttgatggcaagtatataactttagtaagtacagagtgctatgccaatataaaatcactgtttcatcaaggcaaaagctttcaaggatctttaaaaacaaaaaaaaaaagaaaagaaaaatcactgtttcttgcatggtgaagtagggagtcaacatgagtaataatcagataagaactttcagaagcttcttttttataccaaaacattttgccaatcttattatttttttaaaaatttgtttttggtgttgaaaatgcatagctttagatgttgtaatcatagtatttggtcagggagcttggaaacattttaattgttcttccatccagccttcaggttgctttgtggagaaatacttgagagaactaggcacagaaaaggcaaagcaagaccaagaaaacattttagcattagctcaggttaggttccaacccctgatgcagaaatctggtaggtgaaactggaccaagtaaaagggctgtttttgtcctgagccagattggcctagaaccaagtgtagtcataaatgtcctttattttcctacgacaaccaaacatggaactcattcttccaaaaatagggtcaatgttcatcctgcctgttttagaggaagaagaacttgagggtaagagagagagagaaacctgggcaggcttgtgcacaggaagggcaggaaagagagttgactgggtgtgttgttgggtgcctgtaatcccagtacttgggagacggaggcaggagaaccacttgaacctgggaggtggaggttgcagtgagccgagattgtgccactgcactccagcctgggcaacagagtgagactccgtcttaaaaaaacaaaacaaaacaacaacaacaaaaaacccagacattcatgaaaaaggaagctttttattttaccaaaattattattatggcatttaatgcttctgaaaaaaagtaaaccattggtggaagacttgggagaagagtgagagaaaaggaggaaggagagacaatgagaaaggaaggaaaagaaggagctggaatggggaggagacagtttccagacaggtgcttgcctcaaggccccttatgtggaaaatcttcaaaggagagagaaggacaaaacacctttctcagagctcctcttaataccttatttaataatcataaggaagagagaatgagagaaggatgaccaacctttctcctgagggagtaggtcctgggctcatcaacactgcagccatatgggaagaggcaaagaaaaggccatgactcagtgctgacctttgactcctttgaatatactaacctacaaaatgtggggcccagtctgtgttttggagtcatttattctctatcctagatatagaataaagggatgggcccctttattcctcatggtgctttgaagagagaaattatttccttccccttgagccaactttgtaatgaaaaggatttagactttttcattttttgtctgtatagtaaagttgcttcagaaaaacacaatgagaagaagcatggtagaacatcttgtgaataacctcaaaagaaagaatattgcatgtatctctaattgcctttttttcctccctgataaatgaggagagataaatcgtattgaacaaagtactaaaaagtgctcaacaacacttttatctctttaagtttgtctttttctaacttctaggagtcatttttaggaaagatggatgcctgtagatttcagcttatttttatataatggagccaaagtgaaattcttcaagttcttaataggaaaaaaaggtatactttacagttgtgccacccagccaaggctaacatatattctctatatatgctatatgtgcatatattctgtaatataatctatattaaaaagtgtgattttggaaataaaaaattagccgggcatggtggcaagtgcctgtagtcccagctactcgggaggctgagatgagaggatggcttgtgcctgggaggtaaaggctgcaatgagctgtgattatgccactgcacccagcccaggttacagagcgagaacctgactccagaaaaaaacttgtgaggccaggcacagtggctcacacttataatcccagcactttgggaggctaaggccagaggatcacttgagctcaggagttcgagaccagcctgggcaacatagtgagaacttgttaaagtgtgctttttacagaatcaaaaaacaattttatatagaatctttttatacagaatcaactccacaaagagggggccataattgtcatcgtattcccagtgcctagtctagagaagatgttgaatcattgaataaataagaggtattagcgaatgttttaattaagaattaaatatattttttaagaaaagaaagtcattcagaattattactaagagagtggtggaggttctttgttttgttcctcccccttgacatttgaatagagtaagcagtaattattgaaatacgtatttattgagttgtgagaattaagtgttttgggggaggctcctgaatgcctggagtttatacgagaatctaaccaagtgattagatggtttgttttctgctttatcattttaatataacaagtacctttataatttcaaatactcatagggaaaagagtgttgactttttgtttcagttaaccagtgatcatttgactttcctctctacctttgctttttgtgtctagctgtgttgtttaaaatttaacaaataattaatcatgtttaatatataatacctgcatttttaccagtttttttcatgaagtgaagcatgattgagatataaatactgtagatctatttaataccaatgatatattttagaaactaaatccggctacagtagatttaggttgttcctcattttttttcattatatattaatagttggattgtattgatctagaaatcttttaattatatgttaatttggaattttattgggttgggtccaagccattttttttgcaagagcagataaaatccaaagaatagctatgacctacggctcttggcgtggggcctggcacaagacaatgaatgaggccaatcagattctttgcctcagagacctgaacaaatcgtggaaggaatttgcttgttagcaaattgggaaattaagcagagtcatgaggtagagttagggctggaggagctgtgagaaaccatggagttaacgctggggagggtgcctggaaaagcctcataaccatttttccctattaatgaatataggtctataccatgatttttgaaggctgcacaatattctgtggtatgaaaagtaccacaatttatttgccccaatcccttgttgatgaatgtgtaggacctccccacaccaaagggtttttaatcacaacaatgacaccatcagagttcgatttttaaaagatagaaaagactatgtaacctagactaagcaaactaggtatatattgtagtgacttttactgacataggaaaaagaggagagaaaggaattggagtgggggaaatggccatggtagagtgcagagataatacattcagtttgggacaggtttaggatgccttcaggacacccaggaaaagataaccagggagatatgggcttgagatagagatttgggaatcagctgagagtagtggttattgacgtcatggaaattgtgatgcccagggagggcatgtttcgaagtgaaaagagaaggtcagagatagaactgttagaagacaaatattcaactaatgtgcagaaaatactgtggagggtagtcaaaggtgtaggatatagaattgaacaactctggctaacatctgaatcttcttgttctatgaaatgcctatttttttttctgattttttttccattttgctggttgatcatgtttttggtcttatatctcagattgggaattttaacaatgtgtttaataactatagaatatcaggatatgttaagagtgatcttatagatttttcataattttgaaataaaaatggaaaattctttaaactttttttaaataatgaggcagacaggttcagaaattatttggctattttgacattttatcatttgcaataaatactatgcataggtaccatgtgtctataataagccttttcttcttattaatagagtttatgccataccattagtttccttgtcactaaaagaatataagaatattattcaagaaagcctgaaaacgcaaggaaactagttttttgtctttattttgttaaaaagcattatttattgaattgttaatgtttagaatttagatttaagtaatgtctgtgatttattacaaattagtgttttaaaggatccttatgtgacatggtctaccaaaattacagaggtcgatgttttatgtgggcagtacttgtcaactctttgaaaagctgatgctggtaaggtgttgtcagctgatacagttaaaaaaacttaacagtcttttgtaaccctttagcagtaaagattgacaattttatgtaggtaggagcatttagtgagaattatgacaccctgtcatttttgcttaatttgggggcaaggaaattctagcatacttgttcatatattcaaacttatttcaagtaagtataagttctggtacccaccagatctacaattcctgatagttacactttctgtgctctggccatatgtatttgtagaggcagtgaggtgtgggttaggtaatgtttggtctcttagttccacctctaaggcatgctaatatggtagttgcttgccagcagcattggtctggaaatgggtgacttctagatacctggtaggttggaggaaaggtgttactacttcttactgtgctgtttgagtatctgccatagatatttatgtgcaaatcttgtgaaaccccctgctgtttctcagctgtaagttgtctttgtagtttataaaaacctgggatggctacttaacgaggtggatatcatgactttttcttttctgtttctcacagtgcttgggaagtgaagcctgactgagtggtagaggtaaattggggaacagttacgattatgtcaaaaccttgtgtggttcagtttcgttttcttctaataaaactagcgccatgaggcactttttttatacacacccagctgaaagaaatgtgctgacaaactttttttcagggaattttttgagtgttaattggagctgttactgatggttatttttatatgataaagtgtatttcagtgaatttaatgtaacttgttttagatttttagatttgaagcacagtttttggctcaggaccaaatatgcctggaaaactttcaaatctggaaagctataaaacacaaacatactttgaagtacggcatatgtgactgtttaaaatatactaggaatgtctttattggttagcaaatgaaagaacatagctatcatttttatattgttggcatagggtagcagcaattatgttgagtggtggtggacaggcctgagctgccttatataaattatcataaaaataagtttgcccaggtcactatggttaggacatttgaaaaatacgtatgttctgtacttaaatcttgatttattgaatataatcgtctagtgggttttttcataaagcctatgttgtatactgtttttttgttgtatgtttgtttttgttttttttgagacagggtctccctctgttgctcagcttgaagtgcagtggcatcatctcggctcactgtatcctcaacctcccgggctcaggtgatcctcctacctcagcctcccaagtagctgggattacagggatgctcactatacccggctaattttttttgtattttttgtagagacagggttttgccatgttgccctggctggtttcgaactcttgggctcaagcgatcctcctgcctcggcctcccaaattaagaggattacaggtgtaaaccactgcctgtaatctcatgattacatcatgtgtactcttgatagttactgtttttttcctgcttacatgtctttgatggctcattggcaactccattattagtgaaccaggcacatgaagaaatttcctaatttatttcctttaagtgttaattgatataacattttggggggaaaacataaaaataaatgattacagtgaagtttgaagattatcttcagattttattcattattgtaataaaatgattctgtaggctaatctgatggccatacagtgactgtataatgccttaagtaataaaaacactaaaaatctttagagcattgggaaatttttagagcagtttgatatacatctcatttgatgccgtgtgtggtaagaaatgaagtattatcccacatttaacagatgaagaagatgaggctgagtgaagtccattgatgtcctaaggtcagaacttactttttaaaaaatcaactttactaaggcataatttacataaaatgtacccatttaaagtaatttgaacagttttgacaaaggtatgcactcttgtagataccactacagttgagatatagaacataataaccccccaaaattcccttgtgcctttttgcagtcagcccgcagccccaccccacttcaggcatccattaatctcagttctgtcgttgtagattaatttttgcctgttctagaatttcatatagatgaaagcaaactgcacgaactctttttttactagattcttttgctcatatttttgagattcatctatgttgctatgtgtagtttattcctttttattgctgaatattccattctgtgaataccacaatttgcttattcatttacctgctgatggactttgatgctgtttccagttttgatgtgttagaaataacgcagctatgatttgtatttagacatgtattttcatttctctcttttttttttttttttttttttttttgagacagggtcttactctgtcatccaggctagagtacagtggcagtggcttgatcacgggctcaacctcctgggctcaggtgattctcccacctctgcctcccaagtagcgtgcactaccacacccagctaattttttgtagacatagggtttcactgtgttgcccagcctggtctggaactattggaatcaagcaattcgcctgcctcggcctcccaaagtactggattacaggcctgagccactgcacccgaccttattttcatttctcttggtgggccatatgtatgtttgactattaagctatcaagcaattttccaaagtggttgtactttctatttcaccaccagcaatgtctgagcgttccagttgctccacttctttgccaatacttttggtattgtcagtcttaattgtagacattctagtgtaaattagattctccttgtggttttattttgcatttccctgaggactaatagaatttaatgttttttgtatgcttactggtcattcatacatcttttatgaaatgtctgttcaaatctttttctcagtgtcttattggggtttttattttcttattactgtaggagttatttatactgaatacaagtcctttgacaaatacatgcattgcagatagtttctcctaatctgtggttcacattttcttttcttttcttcttttgagacaaggccttgctctgttgtccaggctggagtgcagtggcatgatcacggctcactgcagcctcgacttcctagcctctatcaatcctccctcttcagcctcctaagtagctgggactataggcgattgccaccatacctggctaattaaaaaaaaaatttttttttgtagaaacagggcctcactgtgttgcccagatagttttgaactcctgggctcaagtagtcctcctgccttggcctcccaaagtgccgggattacaggaatgaccaccatgcccagcctgcgtttcattttcttcgtggtgtctttcaaggaattttaaattttgatgaagaccagtttacaatttttttcttttttagttagtgcttttatgtcctaagaaatcttttcttgcctatattatggttgtaaagatttttttcccctatgttttcttctcgaagtttacagttttagctttttcatttagaactatgattcattttggatcagtttttttgtatagtgtggtcgaggttcattttaccctttttttttaacaagattatctagttgttccagtagtatttattgaagactgttgtctcctcattgactgacgtcgacacctgtgtctcttccattgatttagatgtctgttaggctgtgccacacagtcttgactaatgtagcttcataataagtcttgaaacttgttagtgtaagccatccggctttgttgttttttatcaaaattgttttcgttattctaggttctttgcatttccatataaattttagaatcaacttgtcaatttctattaaaaaaaaagcttgctaggatttagattggaattgtgttgaatctatagaccattttgggaagaattaatagtttaacaatttgtgtcttccagtgaaaacatggtttctcttctcatttaagtattctttaatttatttcagtagtgttttatagtttttagcatatgagattcatatgcactttgttgaatctttcatatttttgatttggaattgcatttcagatttaattcttaaattatttattgctaatatatagaaatacaattgaattttgaacattttttttatcctgtgaccttgctatatacatttattcctagtatgtttttgtggatttgtcagaactttcaacgtaaacaatcatgttgtctgtgaataaacacagttttacttcttcctttccactatgtatgtggtctgctccccgcttcttattgcactgccaaacactaacagttaatgttgagtaaaagtggtgagaccagacatttttgtcttattcctcatcttatcaggaatctgttgagttcccattgttaaatgtgatattatctgtaggatttttgaagatgttctttttcgggttaagggagtgcctttctgttccacgtttgctaagaaatatatgtatgtttatgtttttaaaatcatgaataactgctgtatttttcaaatgctttttctgcctctattaagataatcatatggctgttctcatttatcctgttaataggtgagttacgttgatttcaaatattaaactggtcttgaattcctggagttaaactcagttggtcacggtaaattatctcttttatatattgttaggtttaatttgttaatattttctcaagggtgtttacagccatgttcgtgagagatatttttcttctcatttctttgtcttgtgttagcatcagggtaatactgtttttatataatgagttgcaaagtgttccctactccactgttttctgaaagacttcacttaggatttctgtaatttcttccttaaatgtggggcagaattcactaggtatgccaccggggcttgatgttttctttttttttcttttgttttttttttttttgaggtggagtctcactctgtgcccaggctggagtgcagtggcctgatcttggctcactgcaacctctgcctcccaggttcaagcgattctcctatctcagcctccgaagtagctgggattacaggtgtccccccaccacacctgggtaatttttgtatttttagtagagacagggtttcgccatgtttgccaggccggtctcgaactcgtgacctcaagcagtccatctgccttggcctcccaaagtgctgggattataggcgtgagccatgtgcctggctgatattttcttttttttgagacagagtcttgctccgttgtccaggctggagtgcagtggcgtgatcttggctcactgcaacctctgcctcccaggttcaagtgattcttgtgcctcagcttcccaagtagctgagattaaaggcatgtgccactactcctggctaattttttgtatttttagtagagaaggggcttcatccatgttggtcaggctggtctcaaactcctgatctcaaatgatccacctgccttggcctcccaaagtgctgggattacaggcgtgagccacggcacccagccaattttggttattttatatcttttaagacatttgtccatttcatctaaatatgtcaatttattgtcattaagttggttataatactcccttattatctttttaatatctatagaacctgtggtgatatccctttttactttcctggtgttattaatatatatggaggtttatcaattctgttaatcttttctaaaaaccagctctttgtttcagttttttaaactaatttttgcttgttttctgtttcattgatttctgttctttattatttcttttctttttcttattttggctttttaaaaaaatctagcttcttaagatgtactcttaggtcattaattttaaagctttcttcttttctgatacaagcacttaaagccataaattgctttcttttttttttttttctttgagatggagtcttgctctgtcgcccaggctggagtgcagtggcgcaatctcagctcgctgcagcctccgcctcccgggttcaagcgtttctccatcctcagcctcctgagtagctggaattataggcgcccaccaccatgcccagctaatgtttgtatttttagtagagacgaggttttgccatgttggccaggctggtctggaactcgacctcaggtgatccaccaacctcagccttttaaagtgctgggattacaggcatgagccactgcacccagcctaagcaagattttcgatgtagatgaaatagccttcctttagaagaggatgccatataggacttgcatagctagagaggagaagtcagtgactggcttcagtgcttcaaaggacaggttgactgttttgttatgggctatgtgggctaatgtagctggtgactttagatcgaagccagtgctcatttaccattctgaaaatcctagggcacttaagaactatgctaaattgactatgcctgtgctctataagtagaaaaacaaagcctggatgacagcacatctatttatagcatggtttactggatattttaagcccttattgagacctgctcagaaaaaaaaaaaaaagattcctttcaaaatatcactgctcgttgacaatgcgcgtggtcacccaagagctgtgatggagagggacaagggcatgaatgttttcatgcctgctaacacagcttctgttctgtggcccatggatcagggagtaatattgaatttcaagtctttttatttaagaaataacattttctaagtatatatctgctatagatagtgattcctctgttggatctgggcaaagtaaatttaaaaccttctgaaaaggatttaccaatctagatgccattcatgattcgtgggaggagatcaaaatatcaacatgaacaggagttgggaagaagttgatttccaacttttagggatgactttaaggggttcagtacttcagtggcagaagtatctgcagatgtggtagaaataggaagagaactataattagaagtgaagcccggagataggactgaattgctgtaatctcattatcaaaattgtctggatgaggagttgcttcttacagatgagcaaagtggtttcttgtgatggatctattcctggtggggatgctgtgaacattgttgaaatgacaacaaacaatggatttacagtattatatatcaagttagttggtgaagcagcggcagagtttgataggactgactccacgtttgaaagaagttctactgtgggtaaaatgctatcaaatggcatcacatattatagagaaatttttggtgaaagaagagccaatcagcacgcaagttttgttgtctcaagaaattgccacagccatcccctccttcagcaatcaccactctgatcgaacaacatggaaccaagaccctccaccatcaaaaatactgtgtttcattgaaggcttgggtgattgttagcattttttagcaatacaatatttttaaattaagttaggtacattggttttttagacataatgatattgcactcaatagattacagtataagcataacttttatatgcctggggatattaaaaaattgtgtgacccggtttattatgctacttgctttattgcaatggaatggaatggaacctgcaatatatccaaggagtgcctgtagttggaatcataaagaatgtagccttttcacattgactttttatttaataatgtgcacttaaatttcctcccatgtatttttataacttgattgctcacatctttttagcactgagtaatattttgttgtctgaatgtgctacagttttaaaaattcatatatcaactgaagaatgtcttggttgcttccaagttttggcaattatgaataaagcttacataatcatctgtgtttaggtttttatgtggacataagttttcagctcctataggtatataccatggagtgtgattgctggatcatagagtaataatatgtttagttttgtaagaaatcaccaaactctcttccaaagtggctgtatcattttggattcccactagcagtgaatgaaagttcctgttgttccacaggaactttccagtccagtatttggtgttgtcagtgttgtggatttagacgttctaataggttttaatttgcatttccctgataatatatgacttagaacatcttttctttttttctttttttttttttttgagacggagtctcaccctgttgcccagactggaagtgcaatggcacaatctcggctcattgcaacctccgcctcctgggttcaagcaattctcctgcctcagctacccaagtagctgggattacaggtgcctgccaccatgcctggctgacttttgtatttttttttttttttagtagagacggagtttcactatgctggccaggctggtctcgaaatcctgacctcgggtgatccgcccacctcagcctcccaaagtgctggaaatacagtcatgagctactgtgcccggccagaacatcttttcatatgcttacttgccatctttatatcttctttggtgaggtgtttgttaaggttgttggcctgttttttaattgggttgttttctgagttttaagagttttttgtatattttggataacagtcctttatcagagatgtcttttgcaattgttttctcccagtctgtggcttatgtttttcattctcttgacacccttccgcagtgcaaaattttttattttaataaagtccagcttatcaattattttttcatggattgtgcatttggttttgtatctaagaagtcattgccaagcccaatattatctagtttttcttctgttatcttctagaagttttatagttttgttgtacatttaggtctgtgattcattttgagttaatttttatgaaggctgtaaagtctgtctagagtcttttttttttcatgtggatgtctggttgttctagcaccatttgttaaaaagactgtctttctccactgcattgccttatttgcttctttgtcagagatcagttgactttgttcgtgtgctctatattctgttccggtgatctatttgttcttttgccagtaccacattgtgttgattactgaatctctgtagtgagctttgaaggtgggtagcatcagttctctaactttattcttctccttcaatattatttgctattctaggtcttttgcctctccatgtaaactttagatcaattcatcaatatctacaaaataacttgctggaatttttactgggattgcattgaatctgtagatcaagttgggaaaaaccggtatcttgatgatactgagtctttttatccatgaacatggactctccatttatttagttctttgattttgttaatcagttttatagctttcctcacatagatcttatgcatttttttagatttatacttagtatttataatttgggggtgctaatgaaaatggtattttgtttttaatttcaaataccacttgttcattgttggtatataggaatgtgtttggcttttgtatgttaaccttgtatcctgcaaccttgctataatatggtggtaaggtgtgggggagaggagaagcattctatagtcctataattaggtctcaggcttttagtgagcctatgcctctggactgtggacttcataaatgtttctcaggtttttttctccttctttaggtgggtcaggaaggctagaggggacaggatttgaatgtttccctctcccaggtcagttaggctttgatagtaccttaacagattaagctctggtttaacctagtttcttctgagggcaggccttgttaagaagaatggagtgctctagtatatttagaaattctctctcccctcccactggaaccatgggggcagcggggctggggggaagggttggggacagtttctgatatttattgtgagaacctgttcaagccagagcctggttgagctcttgaaggtaaagctccctataacttgatcccttggagttttaactctcagacttgtttactctgaacctgcaacaattcatcagttacagtttagttttccttctccagcactggttcccttggctgtttctgtttgtgagtctttgctctggtaatctgtgacttccctttgcctgtctgtctctccatcctttgggctggtggtttgccttgtgttctcacctttctttcagatctacctagaattgttgatacttcattctgttcagctttgtgcttgttgttagaacagagtgactgctaaggtttttacatgcagaccagaaactaaagtcttctttcttttacatttttttgtagtgcacatttgctagtgacatctttagatcaataaacattgagaaaagttatctttattttacctccttttttttttgagacggagttttgctcttgttgcccaggctggagtgcaatggtgccatcttggctcactgtaacctccgcctctcaggttcaagtgattctccagcctcagcctcccaaatagctgggattacaggcacatgccaccatgcctggctaatttttgtatttttagtagggatggggtttcaccatgttggtcaggctggtctcgaatccctgacctcaggtgatccacctgcctcggcctcccaaagttctgggattacaggcgtgagccactgcatccggcctttacctccatttttgtaggttatttttgctgagtaagatgcattctgtgtcttatggcttgcattgtttctgagagaagtcagatgttattcttatcagatttcctctgtatgtaatgtgtaatttgattttcttcagctgcttttaagatttctttctttttttttcggaatttggttatggtgtgccttaatggatttttctttgtatttaccccgttggggatttttaaagctactcatatccttgagtttatagttttcatcaaaattggaaaaatttcagccattatttctctgaatattatcccccaccatgttttttagactccatttgtataactgcttgctattgtcccacacacaggtcaccgatgaggctctgaggctttgttcatttttttaaggccttttttctttttatgctttagttggatagcttgaaatatcactggaagttgagaacaggaaaatctgttatatttacagtcttattcctgtggtccctttcaaagatgtattctgttgcagttagcacctgtgattgttattcttttcctttaagaccctcttagagatttactttttgtgcgagctagttagatatgttaaaaattaaataaatagtaaggccaatatggtgaagccctgtctccactaaaaatacaaaaattagctggatgtggtggcacgcgcctgtaatctcagttactcaggaggctgaggcagaagaatcgcttgaacccaggaggcagaggttgcagtgagccaagaacacgccactgcactccaccctgagtgacaaagcaagaccctgtctccaaaaaaaaaaatacttacccaaaataatttttttatttaactatgccatatgacctgagttcttctttttaagaatatgaactttaatttccttagaactttaaacattcctaagaaaggtaggttaaattgggaaaattaggccacccataatagtaagattagtacttccatttaatatatttgaggtaatcctaaaaacattaatgagatagttttgttgaatgttcaatgtgtaagtcaagctgatgtatttacatttacaaaagtgtttatatttcataatctgaaataattgttgtcttaagtagtttaccggaatactactcagcaataaaaagaaatgaactattgatacatataacagcttgtatgaatatgcatagacatgctaagtttaaaaaagccaatcccagccgggcgcagtggctcaagcctgtaatcccagcactttgagagtttgagatcgggagtttgagaccagcctggccaacatggtgaaaccctgtctctactaaaaatataaaaattagctggttgtggtggaaggcacctgtaatcccagctactcgggaggctgaggcaggaaaattgcttgaacccgggaggaggaggttgcagtgagccgagatggcaccactgcgctccagcctggatgacaaagcaagagactccgtctcgggcagtaggggtgggggagaagacaatcccaaaaagttacatactgtataaatcccatttatataaacattcttgaaatgacaaaattatagaaatggagaacagattagtgattgccaggggttggagagaagtagatgtgactgggaaagggcaacatgaaggatcctgtgttgtagtgttttgtggcttaattatatccatatcagtatcctggttgtgatattgtactatggttttgcaaggtgttaccattgggggaaactgggtctatggtaaatgggatgtttctgtgttctttctcacagttgtgtttgaacttacaatgagctcaaaataaaaagtttaataaaaagatgtatgaggaatgaatttttaagatgaaaagaaaatgctaccatgtggagcagaaatggtttcagtgtcatttctcactggtagtgagaaagtatggagtgatcgagtacattatctctgtagtggacagaccccaacaatgatcagcagtttgactttataacatttctaaaactctctgagcttcagttttcctcatctatagtaagcaatgataatattgtctgccttataaataggtgtgaggattaaatacaatagtggctgtgaagtatctaatgtggtgcttgacctatagtaagaaagatcagtaaacgttagcaatcatcgttggtttttattgacctacttctatttctagggtgtttttttaatggatattagtatatatgttaatttaaataacatgtataactgagttactaggaaaaatgtttacttatatatgggaaaacaaaatagtaacaactaaaagaaatacaattatttttcactttagatcataaaatttcttaagagtggatttgattttggaagggttgctgcagagaaagctgccttgtttggatattactgatggtaggacagtattctgagcttaaaacacttgtatcctgttgctctgcatatttatggtataattaaagtggcttatatttgctttgaaaacccacttgaaggcattttattcttaaggcttttttttttattttcatcttttatttctttttggcttattgatccctcttcagtttctgtaactaattgtagcaactggactcacaaacgttgtttaattagcactacattaaggttgtagactttcttataaccacctgatgacgtgtgtattaaacaaacaaacattttgaagtgcattctttataaggtaaggcttgggaggaaagctgcccacaattaacctaggaattaaaaaggtaagcagaaacaacttattctgtggatgtagtaacagctcctttttactccagatattacccaaagcttacttgtaaacatagttttctgggacaagaatattgagatctgtaaattcatcttcagaccttagctgacttagctatgacatatataatgatgcatgtataagatgtgcttactgatttctgtggaaaaaatacaagctttgtttgcttctaaattatattttcttctattcttaattttgccaaaagtttaaaaactaagataagataaacattttgccatacagttgacccttgaacaacatgagtttgaactgagcagacccactttatacacagttttttcagtaagtacaatagaccctgcaaatcagcgggtttggcataaccaaatatgacataaccaaatattccagactcactttcttctttccctatctctgacctggaaccagctgttttctgtgaagccttgggtttatattaatggggaatgttatttagaaaccatgatctggggatagatgtatttattgctgctgttttagtgttactgctaggcccttaactcatgacaatgccaggagaaatatgtaatcatgagttcttactgatatctccataggattcttccatatttgaatcttaaaatgagcatctgccccagggccccttcccagaggtacgcattcccagcacaatgcagttcttggctagggtcaagttgtattgcctcctgtgcctgccttaatctggctctgctggctgagatccatgtctatctggattcaccagcagcactcaccatccatgctctaattagagtcccatctgcatttccacattgtagttttgtgcatttttcagtatggcaacctccagccatgttgatgagtctgcctgggcagtcctcattgcctcctggttataaagttgtgtgacttttgagtgattcatcctaaccctattcttgacataaaccatgttatttttacagcatgaaatgccttgtactattattgtcactccattttatagttgaggtattgaagcacagagaagttaaggaatttgccaaagatcacctagttagtaagtggcagagttgggattaaacctaggtactctgcttaaatggtctttgctaacctatgctgctagactataggatttatgtggggaagtattagaagacctgaaaagagtgattattttaagatcttgaagaattttaatattatttaaataatcctggacttgttgggtaggccctgggaagtcactgaaggcttttgactgtagagtgatgtgattggcaatgtcctgtagaaaggttaatcacttgtagctgtgagggactgtgaaagcaagattcctgatagtatgctgttcttgggcttctctctagagatctaatgagtcagcctctaaggtttgatgccagggaatttatgatctttttgatgatcatccatatttggaacgactgctctaaactgtttcctttgtttactatattggtttgactactagtatgccattcctgtatgtgtccatccagtacagccacatttaaatgcccttaatttgccatttgaagctacatatagtccagatgaagtcgatgagtctgctcaggagacatatctttcatctgtctgggccttgcgtttcaatagatatttgagctatactctttcttatatatattaagtttgcaataaagcttaatatcagcttgttttaacattatcttggaaacacttcttcattgggtagtgtgattattaccaaatgtaagtgacaagatgtaaaccagatactcatctacttgtatataaacagatgaaagagaactctcaactacttccttgtctctaatatttgcttcctaaaaatttgggcagaattaaatagcagttaaatcagtatcattgtgctgatagtcgcatgctagtcatcatacttttttgacttgctctgcctacttcattgacatatctaaccagggaggtccaaataaaataaaaatagcagttttgtgcgatcagttgtttaagcatatgtcatattgttaagattttgaaactcttcagagaggtattttgaatctcatgaaagtcacccctcttgccagggctgccacatgcatagttccacctgggtatagcagagtagcagtggcacctttggtcctgactatgtttaatacagattgggtataacagcagtacgtctggaacaacaatgccataatcctcttgtaggttactacttaactatttgctgttcaatagttaaacaaaattttttgtgttaaaaaaaatcaattgaccatagacatatgggcttatttatggactctgttccattgatctctgtttttataccagtaccgtattgtgttgattattgttgctttgtagaaagttttaaaatcaggaagtataagtcctcctactttgttccctttcacgattgctttggctgtggtgagtcccttgagctttaatatgaattttaggatcagtttgtcagtttctataaagaagctacctgggattctgatagagatcacattactttgtataccaatttaggaaagtattgccatcctaggagtatgtagtcttccatccatcaatatgggatgtctttctgtttatctttaatttctttcaacaatgttttgtagttttcagagcataagtttttttttgtctttttttttttttatactttaagttttagggtacatgtgcacattgtgaaggttagttacatatgtatacatgtgccatgctggtgcactgcacccactaactcatcatctagcattaggtatatctcccaatgctatccctcccctctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcttccatgtccctacaaaggacatgaactcatcatttttatggctgcatagtattccatggcgtgtatgtgccacattttcttaatccagtctatcattgttggacatttgggttggttccaagtctttgctattgtgaataatgccgcaataaacatacgtgtgcatgtgtctttatagcagaatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttatttcctgactttttaatgattgccattctaactggtgtgagatggtatctcattgtggttttgatttgcatttctctgatggccagcgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcatgtttttgtcaggtttgtcaaagatcagatagttgtaggtatgcggcgttatttctgagggctctgtcctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttagttttttccaattctgtgaagaaagtcattggtagcttgatggggatggcattgaatctataaattaccttgggcagtatggccattttcacgatattgattcttcccacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgctggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccttttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttagcatgaagcgttgttgaattttgtcaaaggccttttctgcatctattgagataatcatgtggtttttgtctttggctctgtttatatgctggattacatttattgatttgcgtatattgaaccagccttgcatcccagggatgaagctgacttgatcgtggtggataagctttttgatgtggtgctggattcagtttgccagtgttttattgagggttttcacattgatgttcatcagggatattggcctgaaattttctttttttgttgtgtctttgccagattttggtatcaggatgatgctggcctcataaaaagagttatggagaagtccctctttttctgttgtttggaataatttcagaaggaatggtaccagctcctctttgtacccctggtagaatttggctgtgaatccgtctagtcctggggttttttttttggttggtagacttttaattactgcctcaatttcagaacttgttattggtctgttcagggattcgacttcttcctggtttagtcttgggagggagtatgtgtccaggaatttatccatttcttctagattttctagtttattcgcatagaggtgtttatagtattctctgatggcagtttgtatttctgtggtatcagtggtgatatcctctttatcattttttattgtatctatttgattcttctctctttccttctttattagtctggctagcagtctatctattttgttaatcttttcagaaaaccagctcctggattcattgatttttttgaaggctttttcatgtctctttctccttcagttctgctctgatcgtagttatttcttgtcttctgctaagttttgaatttgtttgttcttgcttctctagttcttttaaatgtgatgttagggtgtcgattttggatctttcctgctttctcttgtgggtatttagcactataaatttcactctaaacactgctttagctgtgttccagagattctagtacatgtgtctttgttctcattggtttcaaagaacttatttctgccttaattttgttatttacccagtagtcattcaggagcaggttgttcagtttccatgtagtttagcggttttgagtgagtttcttaaccttgagtcctaatttgattgcactgtggtctgagagactgtttgttatgatttccattcttttgcatttgctgaggagtgttttacttccaattatgtaatcaattttagaataagtgcaatgtggttctgagaagaatgtgtattctgttgatttgggatggcgaattctgtagatgtctattaggtctgcttggtccagagctgagttcaagtcctgaatatccttgttgattttctatctcgttgatctaatagtgacagtggggtgttcaagtctcccactattattgtgtgggagtctaagtctctttgtaggcctctaagaacttgctttatgaatctgggtgctcctgtattgggtgcatatatatttaggatagttagttcttcttgttgcattgatccctttaccattatggaatgcccttctttgtctttttttatctttgttggtttgacatctgttttatcagagactaggattgcaacccttgctttttttttgctttccatttgcttggtaaatcttcctccatccctttatttttagcctatgtgtgtctttgcacatgtgatgggtcttctgaatagagcacaccagtgggtcttgactctatccaatttgtcaatctttgtcttttaactggggcatttagcccatttacatttaaggttaatattgttatgtgtgaattttatcctgtcattatgatgctagctggttattttgcctgttagttgatgcagtttcttcatagtgtcgatggtctttacaatttggtatgtttttgcagtggctggtactggtttttcctatccacatttagtgcttccttcaggagctcttgtaaggcaggcctggtggtgacaaaaatctctcagtatttggttgtctgtaaaggattttatttctccttcgcttatgaagcttagtttgactggatatgaaattctgggatgaaaattcttttctttaagaaggttgaggcctgacgcagtggctcacacctgtaattgcagcactttgggaggccaagacgggcggatcacagggtcgagagattgagaccatcctggccaacattgtgaaaccccttctctactaaaaatacaaaaattagctgggcatggtggtgtgtgcctatagtcccagctacttgggaggctgaggcaggagaatctcttgaacccaggaggtggaggttgcggtgagctgagatcgcgccactgcactccagcctggagacagagcaagactccatctcaaagaaaaaaaaaaaaatagaatgttgaatattggcccccactctcttctggcttgtagggtttccacgtagagatccgctgttaatctgatgggcttccctttgtgggtaacctgaccttttgggtgaatctgatgattatgtgtcttggggttgcacttctcgaggagtatctttgtggtggtctctgtatttcgtgaatttgaatattggcctgtcttcctaggttaggaagttctcctggaaaatatcctgaagagtgttttccaacttggttccattctccccatcactttcaggtgtaccgatcaaacgtaggtttggtcttttcacatagtcccatatttcttggaggctttgtttgttccttttcgttgttttttctctaatcttgccttcatgctttattttattaagttgattttcaatctctgatatcctttctaaattatctgaaggttattaaagcttacaccatctaaattatatttagatgagttacctataagctaaaagctagagtcagatggcagtatctaagatgaactcttaagtgtaggtggtatccttgttttctttttcataatctctttaactcgtcttagtaccttatttatttatttgttctgggaaccacatttgagctttgagaggcaggaggacagtgcttgatgtgttggcagctagtaacccctagtttaactgagttgaggacagtagtaatactatggtggcaatagcaagatttttatctctgcagccttatagtacaactgtcttggtttaaaactggattttattttaactaaattctgttttaaaccaagatagttctatataagaatgtctttggattggaagccttggttttagtttattcttgaattgtcaatatcagaagtttagaaatagtaattcaatggcaaagtattattacataataacaaaagatttattgtgaaatactggggccaacatggaggaatggcaagtatacgagctttgaccatagacagaccaggattttgaatcctagttctaactcttactaactctgtgaccaaatgtagatactcatcctgagatttcctcattgataaaatgacatatcatctcagcggagttgcaagtggtgttttacttttatctccatgtaaattaaagataaatgaaacttatgaaaaagtgtttatatagataaatgatatgtaaaatattttctaagttggaataactttgaaaaactatagagtttaatatgaatatgcagtatgtaccattttagcagaataactagtacctcatgtttgtgattgattaaagtatttatttcctcttaaatacctgtgggcgtacttgggcatagtaggcagtctagccactttattagtccaaaaactaagttcattttaggatttttttttaagttctatgtctaaatctgatacaagaatagtaaaagccatgcagtagtagatcttttatcttaatttatgaggctaaaaatttcttataacactgaaaccctttcctttctttaataggtttaaccttcatttctaatacataaatgtaatttatttttgcttagactccactggttggagatgataaaaatataacccttgtaacacagatatagaacctaatggtggcctttggatgatacttcagctctcacccagtaaagtccctgggattccacattccccaaatccttttcttttcattgaaatgccaagtagccctcctgctttttcttccataaccagccttcctgctgctgctcttagatgtcatgctatgctctgccacctggtggttgcaatgtacactgctgtttctgttgctgccgcagttgcctcctacaaggtgcagaggttgggatttaagtctgcaggtgtgatgttcagtgttgtgggctctggaggcagatttctaagtttgaatccctacatcactgcctccttgctgtgtaaccttggacaggttatacagttttcttatctgtaaaataggtagagtaatagtgcttaccctcacagggttgtttcattaaattaatacaaatgctgagaacattacatactgaaaacagtacatgacagaaaacagtaaaatgccaaaaacagtatgtgacacttaacagtgttagttattgttattattctgatctgaatgctttaggtaagcaattaaacgtgtatattttatttggagctatcatagctccaaactgattgattttagccttgagtttattttttaatgttgatcttttctaaatccattgtgtatatactttctgttatacataatttttaattatcactatcatattgtaaagttaagaagtaaaaaaaaaaaatcacactaaaatgtaagagttcttaaagtgagtgaatatcatatggaaataaccacagcacagtagtggaatttttagaaatttgttttttaatttgggaagttaatcagtgaaatgagctttgttctgaaaatgtatcccaattttcgaagtaaactatagattttatttgtgtttttacatactataacaaggtaatttctaagttttacttttattcattcattttccctttctgttgtgtgtgcgtgtgtgtctgtggtattcaaacattattatggtatgatgttctgtttttctttttttttttctttgagacagagtcttgctctgttgcccaggctggagtgcagtggtgcgacctcggctcactgcaacctccacctcccgggttcatgccattctcctgcctcagcctcctgagtagctgagactacaggtgtccgccaccacgcctggctaattttttgtatttttagtagagacagggtttcaccgtgttagccaggatggtctcgatctcctgaccttgtgatctgcccacctcggcctcccaaagtgctgggattacaagcgtgagccaccgcgcctggccagatgttctgtttttcttgtttcttgtctgtttccttcctttttcatatttttatgtatatatataaaacagtattatagtgtggtattctgttttttccactcaattttatattgtacacatttcccttatttttaaatagtttaatatatcataaattactcattttggttggatattgttttctttctgttgtataatattataatggttattttttatttatacagcgtttttatcctctctcatgtgtttatagaacaaactgccaagaggagtcttaagagtacatgaatgattttgtggctcttgaaatattttcccacattttaatccaaaaatgccatgctttttaatgctgttaaacaggaatttactttcacccataaaacattgtctaggaacaaaagtgaaaaagacaggatccctgctctccagggatggagtataacggagaggatacatacagatgaatgactaagagaaaggctgcaatattctgagtgtgaaggaagaactgggatagttggacagtagcagtgtggaaaatacttcttagaggagattgaatatgaaaatgcggttttaatttgaaataattattgatcctactttttctttcttgcatattatgtttgtcatttctgaaacatatttttttgctttgcaacaaaatgacttaactcctgccaactgcatgatatggtagaaagagcacacaggtttggacaaattgcataattgtctaaacttcagtttctgcacatataaaacataaatgatacttcctttagagacttttgaggattatagaaagtgttttttatctattgtctccaggcttatttcaaaaaatatttgaaatgaaagagttaatatactaataaagtatttagcacagtatatggcacataagttagacttagtaagtaggagccactgttggttttatgattgccagtgttaagcattctgcttcttacaaagcgtcagctttcctataaatactgctcagttttctagaagctggaactgccacctcctaaacgatcagaattcacttcctcaacctccagagtaacccagctcttgagtctttatagtaaccaaaaggctagcttctttctttcctttcctttctttagcccctgctagttgccagataccacgttagatgtagggaataggaagataactgagataatatcctacaactgtctatctagagaaatagagtcatatgcaggtgactgtgcacatgtcagagaaatcagtggttctcaaccctggctgctcattagcatcacctggggaagctgtttaaaaataccagtgctgatgccgtactttagataatttagaaattaatgcaaacagaaacaatattctgtaggaacctgtactcattgataggttgagtgagtcattttgattggaaagagaactggaaaaatcttcacaatcagagtaacattcaaaccaacgacaaaacttagtctgtattgttaggaggacaacaagccagggcacaaaagcttgaaaactggtagcagattggagaaggaaatggtagattctaaggctagactaacaaagcagctaataagaaagaaagaaagaaactttacctcttttaaggagtttagacttcgttatgtagaaaatgaggtagactttatgagagaatgatatgatgcaatctccgatttggaaaaaacagccgctagtttataacattgtcaaaagtaaattccagatggaattaaagttatggaaaaaatagagaataatatttctatattttggggttggagaagacctttataaacatgttatcaactccaaagccataaaggaaaacactgagattaacagattttaccaagtaaatatttaaaactctgcaacaaaaggtaccctaaagttgaaagtctggagaaaaactaggggaaagtatttgctacctcaatgacagaaggttaaaaagtacttaatatataatgagctcttacaaatcagttaagaataggcaaaagatttgagcaggtagctttccaaagaagaaatgcaaatggttgctaaagcacataaaaggatgctcatcttcagtgataatcaggattgtaaagtcaaacaagagtggggtcttctaaactttcatgttgatacagatttttaaaagtgaataatatctaatgttgtcaaaaatgtggagaaacaggcaggctgataacgttggtgggagataagttggtgtaacctttctagagagtagattaatggttatctatcaaaacttaaattgtggttgcccttggacccagtggccacaactaagaattatccctggagaaatacaatgttgtaacattgttggtaatgccaagcagtgtaaatgtgtacatatttcataggcattaaacttttttgtaggaatatataccagactgaagaaactggtggagggaggggcacttcatatactactgtaatgttttttttagaacttccatataattgtgtgtgtgtgtgtgtgtgtgtatctatctatctatctatctatctatctatctatctatctatctatctatgccaaatctatctatctgtgccaaaggctagaagtcctgttctggatgaattagatgaggaagaagttggaggcaggaaaaccagttaaagaattttttaccttgttcaagtgtgagaaatgtttgggtctgaattggaactgtgacaatcagaatgaggaagagggaagatttgaaagatagagaatctataaacttgtactatgtgggtgagaagaatgaggaaagactgtcaaagatggttctgaagtcggtaagttatattgctgagtaaatgaccatgacattataaaaaataggaaaaacaagaaaagaagcatctttggagtagaagataatgagtatcttaaatatagatcctcaataagtatttgaacaataaattagtttgggtcagttagctcatctttagcatgtacaatttatgctttcttattaaggctggtcttctgtagttattctgctgcttgttaggagatgtcattaacatttcaaaatatgtaaaaagcaatttctaaatataatttttaaactatttgttcttgttttatattttcagagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaggattatactcacttgagtaaatcgcatctcatagccagaaaacgtgaaattctaaattatacattgccacttcattactctttttgtttcaaatcaaagtgcaaacttaagttgtaaaatacacttaaattttttagtaaaaaagcttaaaatgatgaaaatagttttctgtatacttagcaatatttatgattactctttttttttttttttttttgagaagtagtctcgctctgtcacccaggctggagtgaagtggcatgatctcggctcactgcaacctccgcccttcaggttctagcaattctcatgcctcggcctcccaagtagctgggattacaggcgtttgccaccacacccggctaatttttgtgtttttagtggagacgagttttcgccatgttggccaggctggtctggaactcctggcctcacggtgatctacccaccttggcctcccaaagtgctgcaattacaggcgtgagccaccacgcctggccaatatttataattactcttaatgattaatctggttcataccagattatgaaaaaattcagaacactcctaatagtgaactatacacagtgggtgttcagtaaatattttttgaattcatttcaagaatgaaataattttcttacatttccagttaggggattcttaggtttgcttgaccaagttgcacaagatcctattgattgtggattcctcttcttggaaatttttatggagctgtgatttgtgctttgaagatgcttaatttgtcagcttatcactccctttgccaatttgagtagttaatttgtcttgatccactttcatttacaactgccagccaaaagaaaattaaaccttatctgaagacaagcactaaacggatttaaaagaagttatatctccaggtatcctttcttgaaagctggcatgaagctcgtaataaaaagctaaatgtaaaaaacactattacagctatcttcattatccataatatcagtatcattgtagaaggactgcttaatactttgcctctggagttcctttatttcttcatctttagtaatctttccctgactcctcctcagctgtagaaaatcacagttacattctagacctattcatcttgagaaactatgcaaccttcacatcccattacagacttcccattcttgaacagtttctcctatcttcctaacccacttgctttaaataataatttttaaaatgttgaacctcattatgacttataaactattgagcctattaatttctcacaatcttattggacttcatatttgtccatcttgaacttagatttttataagtactctcagttcttatgtctccccttccctccctgttactcatttggtaacagctcagatggtttagcttagttacccattttatttctaacctgcatttgcagaggcaaatattgctggagaaatttacacaaggaagttggtttcactttaagttcataagcacaaacttccactgccagtccaacaaatgtgtccctaagtttgctttcccacgcttcatgacaactgtgttacccattttcctctaattctcggaccttctgtaaccctttccctactactgtcagctaaatttgccttatcttttcttgagaccagagatgggaaggctttaggtgggaattatcttccctttatactagcaaatctgtaaacagttttggatcgcactcattgcctttcttttgtcctactgttacaatgaagaatttcccccttcacatcaaacgtgagttttctactacttgctctagaactttcttcccttttttgtggtcattggtcctgtacttcagttcttactttttaatgtacataagaattacctggtgtattagtccattttcttcttgtaacagaatacctgagccgggctcagtggctcacgcctgtaatcccagcactttgggaggccaaggcaggtgggaggtcaggagttcaagaccagcctggccaacatggcgaaactccgtctctactaaaaatacaaacattagctgagcatggtggcagatgccagtaatcccagctactcaggaggctgaggcaggagaatcacttgaacctgggaggcggaggttgcagtgagccgagatcgcgccagtgcactccggcctgggtgacagagcgagatcctctcaaaataataataatgataataataataacagaatacctgaaactgggtgatttataatgaaaaggaatttatttcttatagctatggaggctaagagatcccaggtgaagaggccactggtgagagcttcctgctaagtggggactctgcagagtcctgaggcagcacagggcatcatcacatgtctgagcatgttagctcaggtctgtcttccccgtcttacaaagctgctagtgatagcccgttgatccattgatctgtgaattgggtctgctctcataacccagtcacctcttaaaggtcccacctttcagtactgccacagtggagattaagtttcaacatgaatttcagaggggggcaaatattcaaaccatagaacctgggaacgtgttaaaatggctgatctgaatgaggaggtgtctagggtgaagcaggagagtctgcatttctaacaagctccaggtgatactaatgctgctggtttgggaccacactgttatttgttcactcccacattgtctgactcttccggtctattggatcattcttataagaatacagatttgggccgggcgtggtggctcacacctgtaatcccagcactttgggaggcccaggcaggcggatcacctgaggttgagagttcaagactagcctggccaacatggtgaaaccccgttctgaaaatatagtaattagctgggtatggtggcgggtgcctgtaatcccagctacttgggaggctgaggcaggagaattgcttgaacctgggaggcggaggttgctgtgtgccgagatggcgccacggcactccagcctgggtgacagagcgagactccatctcaaaaaaaaaaaaaaaagaatacagacttggagactgggggcggtgactcacgtctgtaatcccactactttgggaggctgaggctgatggatcatttcaggtcaggagtcggagaccagcctgaccaacatggcgaaaccctgtctctactaaaaatacagaaattagctgggcgtggtggcacgcgcctgtagtcccagctacttgggaggctgagacaggagaaccacttgaacctggtaggtggaggttgcagcgactcgagattgcaccactgcacaccagcctgggcaacaaagcaaaactccatctcaaaaaaaaaccaaaaaacagacttgctctagtgtcttccatcctaagaaacaaaacttccccatccaaatacaaccctatttctccatacaacagactctctcaagagttgtttgctatttcgttagcctgctcttctctctctctcccatacccattcctaacccgaaattgttcctgagttggtcaaaaaggcaaatccaatcaatatttttctgtccttaatttaaactcaatctttacttctaaagcatgaaccatctttttgaagtttcagtggaaaacccaaggtgtttaccaagccctcctctacttggtgggatttgaacaacaaactctgtctcccctgtggtggcagtttctttggcttctcagcagttttttctccctgcacttcttagaatctttcctacacatgcacagtccagggctcagccaagagttgagggaagtttatatgcagattttgggcctcccccattacccttcctagaatattcctcctcagtatccagctactctagcagtgccagatttcccttgattcctcctgccaaccagactacagttttctccttgagttctagtcacagtgcactgttgaattgagggtaaggccatataaacatggatttcactcagtgtgtttctttctttccaaagttgaattctttcttgcttctacttgctcttggttgctcaccagtacctccaacagatgctttatatattttgtccagagtttataattgctctctgcggggattagtgtgatgcatgctattccactattaccagaaccagaattctacaagtatctttttatagtgcagcttggatcatgccattcttttgctcaaaactcttcagtgacttcactttacccttaaaataaaatgtaaaatttatcgtggcctgcaaggtaccacctaacctgaccctgtgtactccattgtaggctcatggccactgttcccctttctcacttctttgacttccttcccgctatatgccctttctcacctctgaaccgttgaacctcatgtttcctattcctgggcagctcagctcccagctttctgcatggcttagtgcttctgctctccgtcagcttggatagcactttttcctgacaaccttatctaaatgaagtgcctctatcaaccccttgttttctataccctaacactctactttttttctttcatagcacttttcagactaattacttttcttaatcatttaattttttaaaatctgtcttcctcactagaatagtctatgtgaggataggtacaatgaactttttatttctagtgcctacgatgaccttcttcttttcagttttagtatctagaccagcacagtgtttgacaaagagattatatttaataaacactaaactaataaagagaaggatagtttaagccattgaattaagctaggcactttagaactttggaaatctacacaaaattaaggaaatcacttaactaggaatgttcagcacctttatgcagtcatatccacctcattccattttcaaattaggtttaaaacaatttgattcaacctgaactgcagtgtattttttttccttgatccattctaccagccccagcattattttttattctcgcattatgactttacccttgcctctcagatttagtatatgttttctccttctggctcttgttttggctcgtcctaacccagttgccttttttcctggataatgcatccacaagtataaaaaaacctaccaaagaaaaatggcaataacatggctaaaataattatcagcatagtggctaaaatgagtttaaacttaaaaaagcaaaatcacagaagacaagattatattgaatgattgaatcatgcagaggtacacaaaaatcatgaatatattaaccttatattatttggctctacctctgtttcctatctcattttgtgacttctttgggttcactatgtcattctgttacttaaacacgcaagtatttttcctaccacagggcttttgcttatgtttttcattctctctctggaatgctctttcctctacttttcccatagccagcttgttctctttaagatctcagcttaaagttacttcttaaagaaattgtcttagtctgtttgggttgttataacaaaatgccttagcctaggtaatttataaacagcagaaattcattgctcatagttctgaaagctgggaattcccagatcaaggtgccagcagattcagtttttggtcaggacttgctctctgcttcagaatggcagcttcttgttgtgtcctcacgtggccgaaagggccactgtgctccttcaaccccctttataaaggaaccaaccccatatgcaagggcagagcctcatgacttaatcatgccccgaaaggctacacctcttaatattaacacattggggattaagtttcaaatatgaactctggggggcaaacatttagaccaaagcgaaggccttgtctgatataaccatcttttctaaaatagatcttcctgctcccattattttctactcacattttaatgtatttatagcatttacaaatggtttttgttgttgttctatctcccctgcttcatgaggacaggaatcactttggctttgtagtccattgtatacctagcctcttaatacagtatctggcacataactggcattcagtagatatctgttgaatgtgcacatacatgagtgaatggtggtttaaaatgttaatttgtgaccactttgctttttggacagaatcagataaaaacctctttaaaaatgaaggtatttcctcagtggggaaaaaaataaaaacaaggatatttccaaactggcagatcaattacgactacctgacaatgaattagaaagtgtttgttttttaacttaaagggaatgaggctgggtctggtggctcatgtctgtaatcccaacactttcggaggctgaggcaggtggattgcttgagtccaggagtttaagaccaatctgggaaacaaggtgaaacttgtctctaccaaaaacaaaacaaaaaacaaaaattagctaggcatggtggtacacgcctgtggtcccagctattcgagaggccgagacaggaggattgcttgagcccaggagacaaaggttgtagtaagtcgagatcacgccactgcactccagcctggctgacagagtgagactgtgtttccaaaaaaaaaaaaaaaaaggtggcggggggaggggtgggcgggtggggaatgaaaatactacaaaacaaacaaatagaaaacattataaactttcccaggatttggtcctgtcttcttcccctccccgaattggtaaagagaccaaaatgcttaaagatacatgggtgttataaaactgctttgtaacacaatgtattaccatgatagaaaatatggggctgggcatggtggctcatgcctttaatcccagcactttgggaggccgaggtgggtggatcacctgaggtcaggagtttgagaccagcctggtcaacattgtgaaaccccatctctactagaaatatttaaaaaattagccgggcatgatggcgggcgcctgtaatcccagttactcaggaggttgaggcaggagaattgcttgaacccaggagacggaggctgcagtgagctgacacagtgccactgcactccagcctgggcgacagtgtgagattgcatcccaaaaaaaaaaaaaaaaaaaaaaaaacaagaagaagatatgaatgattttgtcaacatgtcacactaaaactacaactcttcctgttaggaacacctaaaaatgcttgataaatataattagaaaagtttatactgcagagttgagtttaaaggaagaaaagggaattcttaggtgccagaaacaaagtggggactgaaagttttggtggctaatggcattaatattttctacagtgccatgattaataaatttgaacttttattgattgttactagagtgaccttaaaatcattaactcaaaaccaaaaattatctaaagtcttctcaagaaataatttatgcaccatgtagacttttttttttttaaactgtttttggattatggactgcttgaataatctgatgagaaagaaattaagctctctcctcaaaaagttttcatatgcagaaattttgcatgtgttttaactgtggcattatgactgccctaaactcccccatgatcatggatatgtctgaaatcataccttaagaacttgattcacagtgttatttattgataacaacaacattaattttagggaaaataactttcatttactagttctaaaatagattgtaaaatttttacttgatattagtttgcttcctaagcattaaaactgacattaccaagtaccttttttcccttagcgctccaaccagttcctgacatacagtgtctgctcaacaactatttgataaattaatgaattctagaatatcaaataagtacccataaactatttttttctgattgtgaagctgaaattttctttatttgagtgagactgatatttgacatcagggctctgactataggcatcttaatgtgtgttattttattgttatatttgaatgtaaattcaaaaaaagaataaaaattcaaactgatatttttatattttaaggtaaatgaacatttgaaagacataatggaacaagaacaaaaactgaaagaacatcacacagttgaagctccaggaggtcaaaaggtatttatttcaaaaacaaaaaggtgcctttatgagactgtatatatgttcacatatttgtattattttgggaaatgttaattgtgtttattaaattattttttagtggtgttaactgtaccctagaaagccatactgtaaacactaagtaaatagaagtacaaaatgaaggttaattggatgatggtgtttgtaaaaaaatatattaatgactagaactcaagttctgaggttcttttgtcaaaaataacagtttgcctttctttggtaaaatgtgtaaaacaacaaggaaacaattttaaatgttcaggctttataatgacatgcaatgcagcaagaccaacatttaaaacaaaattcccagaatttcactgggtgcgatggctcacgcctgtaataccagcactttgggaggccaaggcaggcagatcatgaggttaggagttcaagaccagcctgacaaacatgatgaagccccatctctgctaaaaatacaaaaattagctgggcatagtggcgtgtacctgtaatcccagccactcaggaggcaggagaatcgcttaaactcaggaggcagaggttgcagtgagccgagatcatgccactgcactccagcctgggggacagagcgagactccatctcaaacaaaaaaaatatatatatagggccaggcgtggtggctcacacctgtaatcccagcactttgggaggctgagacgggcggatcacctgaggtcaggagtttgagaccagcctgcccaacatagtaaaaccccgtctctactaaaactacaaaaaattagccaggcgtggtggccggtgcttgtagtcccagctactcgggagacagaggcaggagaatcgcttgaacccaggaggcggaggttgcagtgagccaagatcatgccactgcactccagcctgggcaataagagcaaaacttcatctcaaaaaaaaaaaatatatatatatatatatatgtatatatatacacacacatatatatgcacacacatacacatgtgtatatgtgtgtatatgtacatgcacacatatatgtgtatatatacacacgcacatatatgtgtgtacacacacacgcgtgtatatatgtgtgtacacacacacgcgtgtatatatgtgtgtacacacacacgcgtgtatatatgtgtgtacacacacacgcgtgtgtatgtgtgtacacacacacgcgtgtgtatgtgtgtacacacacacgcgtgtgtatgtgtgtacacacacacgcgtgtgtatgtgtgtacacacacacgcgtgtgtatgtgtgtacacacacacgcgtgtgtatgtgtatatatctacacatatatacatatatgtgtacccacatacacacgtatatatgtgtatacccacatacacacgtgtatgtgtatacacacacgtatatatgtgtatacacacacacgtatatatgtatacacacacgtgtgtgtatatacacgtatatatgtgtatatatacacatacacacatacacacacgtgtgtgtatatacacacacacacatgtgtgtgtgtatacacacatacacacatatgtgtgtgtatatacacacatacacacatatgtgtgtgtatatacacacatatatatatattttcccagaattccaaaatgtacagtatggttgttctgtgaagaaagaagaaacattaacatggatttattcttttaaaaatctcaaacagacttttagaattttcttctctgaaaatttagttgtgtgtttgtcatatgctaagaccaaaagcatattttctatgatatagtatatcttacgtcttttaaaatgtattgtaattggaaccctttaaacatgttgtatagtattagaattgaggtataagaaattgtaatcattcagaaactttaatctccatttggtttaaagtttcttcattattacacagtacttctattattttgagcttattcttattccactattcactgatctctccataaaaagagaaagaagggaaaaaggaaggaaaagcgaagctgttctgtctcttatcaacttcaatagaaaaatcttgtggaggaccacgtacaattttgtctgattttgatgttttgggatcacaatgctttcccccatttggttaactgactggctcctgaaaatacgatttgtgcttaatccttcattctaactctgttgaggtcctttaccctaaaggtagattggaatggaattctcctttttccccatcaccccagattatgtttcatttccctgcttccagccaatttctgtccttgcctcttccctgttacgtcccacagtcttttcttgtcagcttccttccctttctctttttcataatcataggagctgaaacttttgccttggagatatgtgtaatcctgcccctcaattttgctcctggctttttatcagtaataaggttgaagtggcatcattctaaattataacactaatgaaatttctctatagaaatcttgtgtattatatataatggttaaattctgtagtattgcatacacattatgaaccaaatggggattttatatgatgacagagggcccaagaaacatttttttaatgaaaaaaatgccatttgtatttcaaacaatcaaataaagtgatcttgaagaaaaactgtatggaatctagacattgttgtattacatggcttttactttttcacagcacttagctccatgcagttgcacgtattaactgtacaactagtatttggtgaatgggtgactgagtgaataaagaaatgattgtgcaattcatttttaaatatttgattagtatacacttgtagtttagcacatacatagcatttaccccttcattttcaaatgaattttatccttttccccccattgtttttgaaaattgaatctttgtgaaaataagggttaatttaacataatcttactgtaggttcaggtgttgtcattatgaagaaacacacaatcacagaataaactagggaaaggaatcttggtctgttacctaacaatgggatttttggcatttgaactgtgtacttggtttgactggaaatattatcattccattcttggtttttaattctgtaaaagcaaaattcatgctccttttcttcttttacaaatgagagagaaaatgacttgctctttttattgctatacagttggtaagaagttgccactctttccatctacttcagtcagcttttctagtgaggcgtactcaggagcctagccctgttgcctattgcttgtccagctatagacagagcccgtggtattgaataataacatatcttaccttttgtccttgcccaactactcttaactcagatgtccagtagaatttgttttatgaaatatctttttataaccatattcttggtaaaatatatgcacatgttgaaggatacttgtactatatattattagggttggactgaaatgaaagatttcaaaggtatttgtttagggtattagatcctccagtgatgtatttctgatcattggattgggtggtgtcctaagagaaaggcattttaaatagtgtcatgtcctaggaaaatgttttgtttaaacagtttactaatgttattttctcttttttttccaagttgctcattttgcttctaatacttcttttgattgtaaattagggtgcctaattaaatttgaatgccagagaaacaacaaataatttttttataagttgcacaggtgtcttgtattgtgtgagcatcttgtatttatttgctaaatctggaagccgtacttgaacgatttctgaagtttatagccaagatgacattaagtccaacattcattctcttgaagagtttgtataaagtactatggtaaaatgagtattgcacataaagtcaggctagttctgccactaaatagcttcatgacctttacaaaggcacttgacctctctgggccttgggtttgtttttttttaatctgtaaaaattagaaggttggattaaatggtttctaaattctgtaattaaaaagatgctcagtttttcccttctcgatatgttagtaaacatgagacaaaaacaaaaggttggcaaaaatagtaaatagttatcatagacttttctatatgtatattactagtagatttatgctaactgtatgcatgaaatatctaggagtaccttctagaggatgtgggactttaacagggccttagtagatttcatgatactaggtcataaggaacaatataagtagtgacactaagtcacaagtgaagtcacatgtgggaattactgagtggatgaatttggcagaatcagttttgaaagagctatgaattcatgagtttgtattctaatactaactatatagagaatgaagtttaatgtttctcaaaaaattttttttttttttttgagacggagttttgctccgtcacccaggctggagggcagaggcatgatctcggctcattgcaactttggcctcctgggttcaagcaattctcgtgcctcagcctccctagtagctgggattacaggtgtgcaccgccatgcccacctaattttttgtgtatttttagtggagatggggtttcgccatgtgctggtcttgagctcccgacttcaggtgatcccccagtttggcctcccaaagtgctgggattataggtatgagacaccaccccagccaatgtttctcaaagtattaaagatacatgtttacttaatgtggcatttgctactttttaaaaagaaatatttgtgaggtattttgcaagggagtaggaattaggtgaaggaattacctttggagaaaagacatccacagagctctaattgcttttcactttaaggtgtatctcaatatagactacactttccccctgtgagagagtaggtaaatgcttatacctctttgcctgattacttcagcccttatgaatttctcccttgactaaaattccttaacagttacaaactataacccacttttttctccctcaaatgctgtttcttcaaatagtactatttgagagaagggctccgaagtaaaatacatttgggaaatgctgcctagtctatgcccctttaagaatgttgcaatccatttcagtacattaaagtcccagtcaaagagactgtttagccattttccaaacatttttgatctttgaactgttttataaatgacttttactagcatcccatagaattagtgttcttcagtgcacaatttagaaaacggtaatttttaacgtataattttgtacttaagttgtctatttaatatgtatataaatatataaaacatttaatgttcaaatatagcgcatcattctcagatacatcatttcatttgactcttagatttacctcgatttcttttataccattattttagttaactgtgaagacatagcctgtctaaattagataatttttgttttgaatcctacccttaagattctgttttataattataaatctatccatatgtagcctgcttcttcttcttcttttttttttttccttttggagacagggtctcactctattgcccaggctggaatgaagtagcgagatcatggctcactgcagccttgatctcctgggctcaagcaatcttcccacctcagcctcccaactacttgggactacaggcatgtgccaccatgcctatctaatttttttactttttgtagagtcagggtctcaccatgttgcccaggctgatctcaagctcctgagctcaagcagtccgcctgccttgacctccaaagtgctgggattacaggcctttggccaatgtgtagtcttctgtggtcaatgctaattcatttcttcttcttcttttttttaaaatgttttttacattaatagggatggggtttcgccatgttggccaggctggtctcaaactcttggcctccagcgatccacccgcctcggcctcccagagtgctgggattacaggcgtaagccaccacacgtggccatttcttttttttatccctaatatcaacataccttttctctttcataataatttacttgcccttacaggaaacacaacaacctagagtacgtccctgttctattattaactcatttattatagttaagagaacttggcattttaaacatttttttgaattcagagatggtaccatggttttaatctttacctaagagtatgataaccattagatttctctaacagttttataaattaataatcttgtgcatttggacacaagaccctataaagacttggattggtatagatctaatataacttttaaagaacttttattttattttgaaataattacacccttacaaaaagttgcaggaatagtaaaaagaattctcaaactctgttcagattcatcagtttttcaacagattcatcagtttttcaaactgaaaatttcctttatcattctgtctccctctctctctctctctcgctctacacacacacacacacacacacacacacacacacacgtaaattgttctaccacatttcaaagaaggttgcatatatcatgcccctttaccccttaatacttcaatatatatttcctaagaacaaggcaattcatttccataacgacagtacaggtaatttaatgtcagtataatactgtatcatttatgttcccattttatcattaatttatttcgctgtcatatccctagtcttctttaaactgaagcagttctttagcttttcttttctttgtggccttgacatttttaaagaatcgggctattttaatagaatacttctcaatttggctttttctaatatttcctcattattagatgaaggttgtgcttttcaggctagaatgctttgtaaattgtgtccttatcacaatgtaatatccagaggcacatgatatccatttacccctgctagataatgttcattttgatcagttggttaagatattctctggtttcttgactacagggttacattagtcctcttttatcctcagaggatatgttccaagacccccagtgcatacctgaaacctcagatagtactgtatctacactttgttttttcctatacagcaatgggcaggtagcatatacagcatggaatgctggacagaggtatgattcccttcccagactggatggaataggacagcatgtggtttcatcacactcctcagaacagcatgcaatttaaaacttatgagttgtttatttctggaatttttcattcattttcagacagtgactgtgaataactgcagatacaaaactatgggtaagggggggacagctatattatgtttccgtttgtaataggtaatttgagaggagttactctaccactgtaaatagcctatctttcttgaaagcttcccctcatcctagatttagcattcattgaatatacctacctgaattaattttactatgatagtcacaaatttataattttctaaccccttcatttattccatatttattagttagcattctgttataagcaagtttttcttcttccacccatctacctgtctatataatatttctctactatctgaatgagcttatggatatgtaatgggttataatcagtttttgtccttatgtatttacttttaaaattattacagaattattttagatttacaggaaagtttcaaagatagtacaacttcacccagttttctctaatgttaacatcttacgtaattggagcccatttgtgaacagtaagaaagtaacattggtacattattattgagtacactacagactttatttagattctactggttttccactgatgtcctttttaaatatttgtcaggtgttttgtagtgttcttcaatttgggtttgtctgatatttctcatggttagactggagttacaggttttttgagaagactaccagagaggtcatatatcatatcatatattgtatcacggggtacatgataagaacatgatttaacactagtgatattaaccatgatcccttggttaaggtagtgtttgtcaggtttctccattataaatttactggttttcccttcttatttttggaagtgggtcaccacctccatcctgcactccaaaggagggaaattaagctcactccctgaaagggagaatacttgcatatactattggggattcttctgtaaggaagatttgtgtcttcttccccatttattttttatattcaatcatttatttatatcagtatggactcatgtatacttaatattttatgctttgagttacaatctaatactgcgttgtttattttgttgctcaaaattttacagcatcagccactgagagctttttggggttggctttggtatctcttggatatgccccaatccttttgttttttgagcacttccttactttctggcactacagaatgctccaggctcatcttgttctttccttgacctaaaattagctatttctttattttgatgctcaaatggtcttagatttggccaacgggagtcccttcagactgactcctgtgcttttgatatgcccccattcatccatctcttttttttttttttgcccctccttatttaatttctagctcaacaagatgtttcagattcattttgtagtttccttgccataatcctaaaatcagccatttcttcagtaagtcttaattcttttttatggaaaacagtatttagcaactgtaaaatctgggcactaagtggctcattgctacaggaatatcattacttctaggccctatttcagtagacagagttcagaaataaaattttaaaaatacacaaacatgagttcatatataaacctccaattccaatcaaactccacagagttcttcctggcttcccctattccatgcaggacttccccttccacagtgagaactcaggcttccaacagcattaatatattttacttatttgctcagtcctacaatacatatacagtagtttcagaattgctatactcataccaatatgaaaaataaacctactggccgggcatggtggctcaagcctataatccccgcactttgggaggccgaggcgggtggatcacttgaggtcagaagtttgagaccagcctggccaacatggtgaaaccccgtctctaccaaaaatacaaaaattagccaggtgtgttggcatgcgcccgtaatcccagctacttgggaggctgaggcaggagaattgcttgagcccgggaggcggaggttgcagtgagccgagatcgtgccagtgtactccagcctaggtgacagagtgagactctgtctcaaataaataaataaataaataaatttaaaaacctactaagaagaatttaagatttgtttgcaatttttttttagactaatagtatatagtcaaagtacagtgttcttaagttgtttccctctgcccccgccttcactgtggttatattattcctttgaaatacatttgtgttaattggtttctgtattctttccattttagcgatcttttttgacaccatccttgttaacttttgttttttgaatatgtagaacattgacataattccaaaaatcagaactatataaatggtatactcagagaagtatcaatccctcccctatctcttctaccccttacttattccacatgtactccctcccagcccttctaaatggaccaagcacgtatgtgcatgtttgtttctcctcctttctagcacaaaacataacatatttattcttttgcagtttgctcttttcagtaactgtatatcctggaaattactccatacggtccctagagatcattctttctttctttctttcttcctttttttttttttttgagacagagtcttgctctgccacccaggctggagtgcaatggtgcgatctcggctcactgcaacctctgcctcccaggttcaagcgattcttctgcctcagcctcccaagtaactggtactacaggcgagcgccaccacacctggctaatctttgcattttttagtagacacggggtttcgccatgttggccaggctggtctcgacctcctgacctcgtgatctacccgccttggcctcccaaagtgctgggattacaggtgtgagctactgtgcccggccaatcattatttcttaaagcagcatagtgctgccttgtgaatatgtgccatagtttcttcaactatgtacctatgtgtaggcatttaagtagtttccagtatcttgctattgcaaattgtgctgcacagaatactgttatatgtggccttttgtattttggatatgtattttcaaggtaaatttcctagaagttggactgctagattgaagggtaaatgcatactgtatgtagttttgttaaatgttgacgaaatcccctccaaaagagcttgtaccattttatattccatcagcgattcggcataacttttggatctgcaacagctaggagattaagtctaatggctgggcgtggtggctcacacttgtaatcccagcactttgggaggcctaggtgggaggttcacttgaggtcaggagctcaagaccagcctggccaacatggtgaaaccccgtctctaccaaaaaatacaaaaattagccaagcatggtggtgcatgcctgttgtcccagctactagggaggctgaggtgggagaattgcttgaacctgggaggcagaggttgcagtgagctgagatagctccgctgccctctaccctgggtgacagagggagactgtctcaaaaaaaaaaaaaaagattaaatctaacaagttaacaagtcatgcagtaacaagtcacagccatgattaactccctgaaggaccccaactctttgaggtctccaataaagaccacaccaaaccaatatcctcctggaacggcctgagagcacctagaagtagttcaggaattatcctaccttgccagaatgttgtagatacccagaggaagagtattatttggagagtattaatggcaagtcctaaaacaactagccaaaattcagggtgagccaaacatgtattataaagacaattgaaaggaatatttgaaattagaactattccagaaaatctggactgcctaggttggcccctttgtcggtagaaacttaataaaagttttttcacctgttatccatgggttttaaaaaaccctttgtttcttgcctggtggtcctgataaaaagaaaaaaaaaatcaaaaaacctttgtcctcgtggttatttacatcttaaaacaggatttgatgttgcagtttgcctaattcttccctgaaaaccaaaaggatagttgctgatcacttcagaaatggcgttattcttcagcaaggaacttatgctatgtatttgagctttttgaagcatacgtatataagtatgcatagtatatttatttgttcttttagtacatttactctttagttaaatttccttcacacagccaatctgtgggtttcctttttccgccaagaagattgctgttaccagtttagatcaatggagggccaagagaaaggccagagcagtctgaattagtaacaaaatccaattattgcatattttacaagaaatatggaataactttaaccgttaagagacttctttgtacacctgctgttaggaatagtccacaataatttcttgttatcaccattttctatttaatgggttcttctagtctagaaaacaaaaaaatccttgtttttaaaatttctgttacaaattggaaaccctgacacgttttcagtggcttcctgctctttggtcctgctcttgtactttttgtggctattataactgcagctgccaaaaacgttcagttaaatgggagattaaaatacattccacaaaattattgaggctattcttcctggtgctataagaaaaatttattggaaatgttgtttatatgtaggaagctggtatgtttctgattcttcaggtgacatttttctaattcttaaagttcttgaaaataccttatttatattatttttctgtttatacggaaaaactttctacataaaaattttggatatgaattttaattttggatatgaattttaactcagattctatttactttggttcacttcaacaaacatttattcagagccagaagctgttttagcagatacaaagataaacaaacacaaatgattaattcatgttatctgaaattatgggtttattatattcatttttttaaagaagaaaattagattctttgggacagccctagatagtaaatttaataacatttatattctctttgtgtgagtagttacttgctttagacacttacaaaaatcttaactggtaacaattgccaactaggtttttttccattaattaaaagaaactttttatatagtgaaggaaatgatcatcttgatatattctactatattattatttgctttatacttgtttttattgaaattatctttctactttgctttttggggaatattgccttgtcagacacagtctactaatacctaagaattatgattgcaaacctagctgtagaatatttttacttcccttttgtgatatagatttattttttaatatgacatatgattccaaaactcagaaataaaattttttgctgctaaagtatacagcatattctaggtatcctacaatgaatatctgtatggggagaggagagagacaggagaagatagtggtctttagcattaggaacttatgtatttttaactaaaatatttattaacatatgaaatgttatgagaactataaacttggaactccactatcagaagctttactataatttgttaattgaagataattctgatgaattttccctttaccttttgctttccccttttttcccgctgcttcctctgaagtctccttccaaatggttttggaaactggttccagtaagtttgctcagctacttcagtttgctctccagaattgtaattgtagaatggtattgtttatgtcttgctgttaaagtcatttcatgtaattctgttagtcattgaatagagattggattttaaggtcatgtaaaatggaaagataaaagatacagccaaggtttagatcagaagttctaaaaataatttaaagggtaaacatcctgttgctaatcttgtcagtattcacagactatcagtaagtaggttaaaaaaaaaaaacttatgggccaggtgcggtggctcacacctgtaatcccagcactttgggaggccaaggtgggcagatcatgaggtcaggaggtcgagaccagcctgaccaacatggaaaaaccccatctctactaaaaatacaaaattagctgggcgtggtggcgcatgcctgtaatcccagctactcgggaggctgaggcaggagaatcgcttgaaccagggaggcagaggttgcagtgagccgagatcgcgccattgcactccagcctgggcaacaagagtgaaaccgtctcaaaaacaaaaacaaaaacaaaaatcttactatgtagcttctcattaatttaaataattttagtaaatattaatttgaattgcatgaataaattgcctgcatttaaaaatcatctttgtggctgagcatggtggctcacgcttataatcctagtactttgagaggccaaggtgggaggactgcttgagcccaggagttcaagaccatcttggacaacatattgaacccccatctctatttttaaaaaattatctttttgacagacctagttccttttcagcttgaattatagatgacacttcactttttgtgtgattaagaaagcagaaggttttctgtgacctcaccagtagcggaccaaaaccatattaaattctgatttgacttaaagattgatctttcagatttaaatatggggatgggtgtgttaaaccacttaagaactattttacatcctcgataataaaactctaatttagaaatataccataatggccgggtgcggtggctcacgcgcataatcccacactttgagaggccaaggcaggtggatcctttgatcccaggagtttgagaccagcctgggcaacttggcaaaacctcatctctacaaaaaatagaaaaatgaggcaggcataatggtacacatttgtggtttcacctactcaaaaggctgaggtgggagaatcacctgagaccaggaggtcgaggctgcagtgagccatgattgtgccactgcactccagcctgggtaacagagtgagacgctatctccaaaaaaaataataataataaaataaaaataaaacaaacaacaaaaaaaaggagaagaaaataaatataccataatgttgaaatataaaaatatagggggttctttctaaatgccaaacttcttagtttgcagaaagaaagggcatgtttccatgcaataagtttataaagcaaatagcatgttcaagtacaaaagactctttcatgaactgcggatgaaccttctgagtgctggacataatctcaagatttaaagttggtttacttaatatatcttctagaatacaatctttaggaaaatgttttggcatcccattcataattctctgtctagtctaaaccatagatacttattgctaatgtcatataaagctgtgtgtgtgtgtgtgtgtgtgcacgtgcacatacatgtgcctgtttgcacataccttgtacaaaagtgctactttgcaggagggagtagaacaaatcacataattcaattctttgttgcatgaccctgggtgcttggcttagtccaattcaggtcataggctgaaaacaaactactagtcccagcccaattttgaggatgtccaagaggcagactgtttttatcccagataaccaaagaaaagcatgtaaggatctggaacagatactaattgtgagaacggtagcttaagcctagaagataccgctgtactggttgatttcttttttctttcttccttcctcttccctccccatggttgattttaagctgtttcttagctgcaaagtgaggaattttctaagaattatgttaaaatcagaatcaattaaagaatccatatagtacctgcaagtaatttttttctgaatatagttaccccctgaattagggatgtactcttaaatacggagtctattatgcactaattaacaagaaccttcagaaatctttaagaggaaaacatgttccatgaattttgtccttgggtagccagtgagagaaatccaggaataagtatctccttcttcattaatgctgatgcttttctgagagatagcattgaaaagaaatctaacttcactaccaaatgttgtgttctctttcagtaaatttttatttttctatttttattctcacaaaagtgttttatcttataattatattttaattctaaactatagagatgaccaatttagatggaattagaagaaaaaatagtttgataaccttaaaaaaactaccagtaatttatgttatatattttgctagcaaaatactttcgtgtgtacattcactaaatcttcagcattattttacttggctttagaagagttaacagctaataatagctaacctttattgattgcttgctgtgtgcccagcaggatgcatagcactttgtgtccatcatcttacttaatcttccagtggttctatgaagtgggtactattattacgccagtttacagatgggaaaatgagaaatgagagtttaagtaacttgtccaagatcacaaaactagtaagtggcagaaccaggatctgaaccaggatctgaatttgttctcttaactattacagcatgtctcattttttagagatctatttttaaaaattctatctagccacaccaaacaatctttaggaaacaaaggtttcttctctttttctgagggggagcaagaacccgtatacttgctcaattattaatgaaatctaagttggaagggtttttttttttttcactttcaaagttgttaactatttgtgtttcctcaacattcagataataacccagaatgtcttggtgatactattccagttcctcaaatttcttttaagaatagtatattcttttaccttccccctcattttgataactctttctgcttgaatagtattcttgctcttcccgtataagaattttcagtttaaattaagtctgaattaaagtagatgaattttattatcttcaaaagagcagaactgattatttggatacaaagtgttcaaaatctgttttgtgatgcttttatacttaaatatttaagccaaatgtcagttagtgtaaattagcagtatgttatattaagtattgagcttcaaaactatagctattgttgccgtgtatttaactttggtaatacctagcgttatttagaaaaaaagaaatattggtgagtggtctcatttctcatgatttattttattactggtacattagaatttacagtactgatttttttcctatgcgttatttggtacttatttattttcatgtattttttttatatcgtaggctcgttatcggaaagagcaaacattgcttaagcaactgccttgcattccattggtagaaaatttgttgaaggatgggacagatggctgtgcattagctgcccttattcatttttactgtcctgatgttgtcagattagagggtaagtgttccattgtaatacttctgaactgtagacagatagtaaccaatatttaagacagtattattttgcactccagcctaggtgactgagtgggaccctgtctcaaaaaaaagacaatattatttaataagtactgaagacttttttttaaaaataaagaacatttatatataattctgagggaggtagttcaaaaaaaaatagtgctcggtttctaagtcttaatgtataatgactactatatttataaatgtatgtttgttaaccagaattgtgtatttgtactaattacaagatggatatgaaatatttattatcaaattaatccaaagtcaccaccttgctcttttcttatttgaagatatttgtttgaaagaaactatgtctttggctgatagcctgtataatctgcagctgattcaagaattttgccaagaatacttgaaccagtgttgccatttcactctggaagatatgctctatgctgcttcatccataaaggtaaattaaattattctttttttccctttgctttgttaaaatatgtttttttaaaaaacaaacaaaaacaccgggaacagtggctcatgcctgtaatcccagtactttgggaggacaaggtgggaggattgcttaagcctgggaggttgaggcttcagtgagcgatgatcgtgccactgcactccagcctgggcaacagagcaagaccctgtctcacaaaataaataaataaaattttaaaaataaaaaataaaccatagaacaagatatataaatgacctagcaactttaagcttatagattaactatattagtcaaaagaacttttgaagaaagtttttaatttttttctccttattttgttttttaatatactataagctacaagtttcttttatagtgcaaagccaaacttaaagtcatgtacaaaattggccagttgtagtgactcgtgcctgtaatcccagcactttgggaggaggaggtgggcagatagcttgagctcaggagttcaagaccagactgggcaacatggtgaaaccccatccctacaataaatacaaaaattagctgggagtggtggcatgtgcctgtgttcccagctactcgaaggctgaggtaggaggattgcttgagtctggaaggcagaggttgcggtgagctgagatcgcgccactgcaccctagcctgggcagcagagccaggccctgtctcaaaaaaagaaaaaaaaaagtcatgtacaaaattgatctattgtcttaatgtttgcaaaatagagaataagccattaaatgtttcttacaaatagcaatgcttacaaatagtaagattctttataaataatgaagctttctttttcttaaagaatttttaatttttgaattaaaaaattaattgaaaagtaacattatgtactatttaactaccattatgcataaatatatgatatgtatagttaaatgatatggtatccttgcgtatttttatgtgtacaatgagtcattgagcattaaattgaaatttagtttgtttattctcactagattatatataattgttctgtagttaccagactgtttgaaatttgtcacgtttattgtcctttgactgtaggctaatgtatgctgtcagattgtgttaaaataataaaatttcacatgggtagtattattttcttaattttaagttgaatatattttatttacattgatgttaaatgttaaaaataataatcatggctgagcatggtggctcacacctgtaatctcagcactttgggaggctgaggtgggcagatcactgaggcgaggagttcgagaccagcctggccaacatggtgaaacctcacgtttactaaaaatacaaacactagccaggcgtagtggcacgcacctataatcccagctacttgggaggctgaggcaggagaatcacttgaacctgggaggcagaggttgcagtgagctgagatggcaccactgcattccagcctgggtgacagaataagactatgtctcaaaaaaaaaaaatcattattatcatcatcacgaatagatttttgaaaatcattccattccattcccaagtttgaaaattaagttgtgttatgaatactgttatttttaatacttcaagaattatgtcttatcctccagatgttattttagtaatgttagtgttgtactttatgtgagtcaataatataaagtcaattcagaaatcagaaatgttttctagttgagtcatattaatttatgaaatactgaactacaatataaaaacttcaggcctggtgcggtggctcatgcctataatcccagcactttgggaggacaaggcaggaggatcgcttcagtccaggagtttgagaccggcctgggcaacatagtgagacctttgtctttacagaaaataaagttagccaggcgtgatggcacacatgtgtagtaccagctactcaggaggttgatattggaggattgcttgaacctaggaggctgagactgcagtgagccctgattgcatgactgcactccaaacttagtgacaaaccaagaccctgtcaccaaaaacaaaacaaaaaccataggggctttctcttttaatttttaaaggttaaaaaagagtgtttaaaatagtaattatttgaagttcaagatttgctgttgttaaaaacatggtgggaatcatatacatgctatataaacacaggcaacccccatgtatgcagttttagttctggtaaaccatttggaagcagactggggaaacgaactgggtacacctttgcttttgaagaattttaggatttgtttgcagctactctaggttaccaagtgtcacatgtgcatcattagaacaaagccctaatttaagacactgaagaactacagaatgcaagtgtgtaaaagttattaagatgaaaagaaaggagcgttaaacaagtttgtcagcaaaatgtaaaatggcaaaatttggagattattataacttttagaacattgcaggacccacactaatgtttgaaaaatattttagcgagagactattatatgctagacactgtactgagcctggggatttggtcatttattcattcatcggcagatatttactgagtatctccatgtgccagacactattcttagctttggaggtaaagcagagaacgaaatggcagggtaaactataaagccagtggtaaagacatttctaaaataagccactgctcctgctgacccaaagttgtacccagtctcttgtgtctgacacatcaaaaaaaatttttttctaattgatgttgaaggtttacacccttgccattcatatcagaatgaaaggtaatatcatttccatatatatcttgtaatgctttttctggtattttcaggtaataacagaaatattaatttctgttagtaccagaaaaggcatcaacatgatatctacattgtcagctaaaaatttaaatgctacttctgtaatctcaaaggaaaaaaactgtctcactaaatacatggagatataagattgcatttgtttaagttggtataccttggacttccaatacataatatacagtcctgatgtttatatcaactttgtctgggtacgacccatataaagatattttcttaaattaggtatatttaaactatgattttctacagaaagggctttggtcactttctatgttctttacttattactaccacagctttgacttcatttgaatctttttttttttaattcaatcttattttaaacttttagcttaagctcaagggtacatatgcaggtttgttacataggtaaacttgtgtcatgggagtttgtggtacagatttttatttcgtcacccaggtattaaccttaatacccatcagttatttctcctgatcctctccctcctttcaccttccactcgtggatagtttgcagtttctgttgttctctttctgtccctgtgttttcgtcacataagtgagagcatgtggtgtgtggttttgtttctgcattagtttgctaaggataatgacctccagctccatctgtgttcctacaaaggacatgatcttgttcttttttatggctgcatagtattccatagtgtatatgtaccccattttctttatccagtctagcgtcaatgggcatttaggatgattccatgtcttggctattgttaatagtgctgcagtgaacatacacatgcatgtgtctttttggtggaatgatttatgttcctttgggatatacccagtaatgggattgctgggttcagtagtatttctgtttttaggtctttgaggaattaccacactgttttccacattggttgaactagtttacactcctaccaacagtgtgtaaatgttcctttttctctgcaactttgtcaacacctattattttttgactttttagtaagagccattctaaccggtgtgagatggtatctcattgtggttttgatttgcatttctctaatgatcagtgatattgggctttttttcatatgcttgttggccgcgtgtatgtctatgtcttttgaaaagtgtctgttcatgtcctttgcccacttcttaatgagattatttttatcttgtaaatatgtttaagtcccttatagatgctggatatgagaccttggtcagatgcatagtccgaaaaattttctcccattctataagctctctgttcacactgttgatagtttcttttgctgtgcagaagctttgtagtttaattagatcctatttgtcaatttttgcttttgttgcaacttcttttggcacctttgtcatgaaatctttgcccattcctatgtccagaatggtactgcctagattttcttccagggtttttatagttttgggtttatatttaattctttaatccatcttgagttaatttttttatatagtgtaaggaaagtgtctgttttccatcttctgagtatggctagaccgttatcccagcaccatttgttgaatagggagtccttccccattgtttgctttggtcagctttttcaaagatcagatggttgtagatatgtggccttatttctgggctctctgttctgttccatttttgtaccagtaccatgctgttttggttactgtagccctgtaatatagtttgcagtcaggtaacatgatgcctcctgctttgttctttttgcttaagattgccttgggtattcaggttcttttttggttcaatatgatttttaaaatagttttttttagttctatgaagaatatcattggtagtttaataagaatagcattgaatctatacattgatttgggcagtatggctattttaacaatattgattcttcctgtccatgagcatggaatgtttttccatttgtttgtatcatctctgatttctttgagcagtgtattgtagttctccttgtagagatctttcacttccctggttagctgtattcctaggtattttattctttttgtgccagttgtgaatgggattgcattcctgatttggctcttggcttaactgttgttggtgtataggaatgttagtgatttttgtacattaattttgtatcctgagactttgctgaagttgtttatcagcttaaggagcttttgggacaagagtatgtagccttatgaccatcttaactaaaagaaggaaagaagaagcttttaaatgaattaatctggcatcattcctgaaatatggtgacagatttattgctgtttaatcgtcatgaactcagaaagacataatcttcataagttttaattactgggaaaattatttcttactctactgacatcttgtggccaaatagtacaattaatgttattaggatggctatcttaccaaagtccttaaaatattaacttattttctgttcaacagataattattgagcacttaagcagtattttttcaaaatataatcagctttcagttaactaggctagtaaaatggaacctagcaccagtacttaaaaaccaattttatactttggctttagaaagtataccataaagataagtataaagaagaaatataaatcacaataatcttactaatcagaaatattgtgtcaatgttttgatgttttactgactgttttttttagtacgtagattcattcatttgtacattcatttaataaatatttattgagcacctatcatgtgccagacactgttttaaacactgaagatataatgatgagcataaactttgtctttttagactttatcatctggagggtaagatgaggaaacttggagaatgtagtaatagataaatctgggaagagaaaaagggactgtaccaagtagcctcttgtaagccatagtaagattccctttacctcaagagcaatggaaagagagttgcattttgaaaagtttgttttcttagcaagccaaagaaaaagctattgtgttccaaacaaggcaaaaatgtttgaatcagagcagttatgatggagagaagttggtgaattccagaaatatttaggatgcaaaatctgcatgctttggtgatgaattggacatgggagaaagaaggtgtcaaggatgactcctaggtttctggtttgcacactgggatagtggtgccattcagtgagataaggactgcagtaagatcacatttgtagggaaggtcactatttcaattttggacataggcctttgagatatccaaaagaaaatgctcggtaggccactgcatatataagtgcagtcagtacatttgagaatcatttagtagctgatggacgtaggcatggcagtgtttcaaagaggggcgagatcaggaatatcaaatgcagctgagaggtcaagtaagatgggaaatctgtttgatttagcaacatatgtacatcattggtgacttgagcagttgctgttaggggaatgatgtgactcagtgccaagactgaagtagattagagagtaaaagtgatgaaatggaaaatgtcagtagaggcctgctcctaaaagaagtttgtgaagaggtaaaaagatggtgggaatgaggagaaactagagaatagttattgagtaaaggttttgtttcatttattttgatgggagggatttgagcatgtttaaaagccaaataggaaggattctgttgacaggggaaggatacatatgtaggagagaaaagtaggattaagaatataatggcattcacagcaatttggatggaattggagaccattattctaagtgaagtaactcaggaatggaaaaccaaacatcatatgttctcactcataagtgggagctaagccataaggatgcaaaggcataagaatgatacagtggactttggggactcagggaaaaaagcaggagggaggtgagggataaaagaccacacattgggtacagtgtacactgcttgggtgatgggtgcaccagaatctcagaaattacttaaagaacttattcatgtaaccaaacaccacctgttcccctaaacacctattaaaataagaaataaattttttaaaactgtaaagtttctgagaagtcaagcagggatgagagccactgcatagcctttacggattataagcattcttattactttttttagtcacaaattttaatggctgcttcaattagtatgtatctgtatatcaacattctaaaattctgagaatttacagtaaaagcaaacatgaaggtaaagtagaaacctaccaaatgctcttcaccactgtgcattatcttctgtaatactccagactcttacactcagccacctacaagacaggtccacttaaatgtccagtgaacatctcaaacaatgactctagattcctttcattacctgtttctcccagtcctttctatctcactattagttgctcgagacaaaaacctaagagtcatcactcttgattcttctcttttcatcactttctttttatttttttttagagacagggtctcactctgtcacccaggctggagtgcagtggcacaatcagccaaatcctgggctcaagctgtattcctgccctagcctcccaagcagctaggatgacaggcacgtgccaccatgcatagctaatttttaaaatttttatagaggcaagctatgttgcccaggctggtctcaacctccaggcctcaagcagtccttcctcctcagcctcctcaagcactgggattacaggcatgagccactgcgcccagcctcttttcttcactttctacatacacgatagccttccagaactatcagatgagagatgatatttgaaagtcaccaacttaaatatgagaaaaccaagagaacgcatgagttctagtggagagcatatagagtttaaggattattcataattagcaagtaggaagaaggcaagacattagaaaataaccatatccaggataatcttaaaaactttaatatgaaataagaccttattaaacattaataaatttgatagtaactattttattaaatgccaaacacccaaaatttagaaaacatattattttaaatagttatgaaaacagattttgtagtttttaaaaatttaccgaatgcctaaaattgaaataattcttcatgcttacagcttttattttatatgcattttaaaatataaacttgtagtagaaatgtgcttttgaggacccttaatcctttctcttaattttaagccatttaaaaaattatttacattttaaaatagtaataataaaaggtaacattgttgacttattgataacttttcaaagttaggtagatacattcattgtataaataatgttttgtacatttcaaaattattaaaaattagctataaaaatttagttttggtgttatttagcacctgtattactggtgagtttaacattactgagcacatacatataactttttttgtttaagacggagtcttgccctgtcacccaggctggagtgcaatggcatgatcttggctcactgcaacctctgtgtcttgggttcaagctattctcctacctcagcctctcaagtagctaggattacaggcacgcgccaccacacccggctagttttttgtatctttagtagagacggggtttcaccttgttggccaggctggtctcaaactcctgacctcgtgatctgcccaccttggcctcccaaagtgctggggttacaggcgtgagtcaccacgcccggccaaataaagtatttttttaacactacatccagttacgttttggagaaatttctagggatctgagtagagcttagttatgttttgaaagtgataacccctctttagagtgtcagatgattgaataactttttaagttgcttatatttactttggaatgaaagtgccttatatattatctcagtgttctacacagttagaggtattcatgcctgctagatcaattggaccaccattttagaactatagagcaaatgatcagcaagaggttttgaatagttataatttttacccacaagagttaatattccatcccatgtttaatagcctactatagtgaatatactccagtgatgaatgaatgagatttaaacctatattttaaaacaataaaattctgtttatcatgaagttttacctaatgtaggctttctcttaaatttcctatatagagtaattatttggtgttcatggcggaactgttctggtggtttgaagtggtgaagccgtcttttgtacagcctcgtgttgttcgtccacaaggaggtaatcaatctttttaattttaaatgttcctatgaacagaaaaaaatggaatgttgatataaccttacctggttacatttttagaaatcagcctattattttttttttagatttcagctattacacttgatagattctcctaacctcttaaaatggttagaggagaagaaaaagaaaatggagggaatggctttgaatttgaagtcttatgatgtggaacttttagctttaactgtccatttcttttctttgcatcttttatcgttatcccagcttttattcccttttagattcttagtttttaacattgtgttacccagaatccccacaaattattgtttggccttaacccgcaactcgaatttgccattaaactataaaaaggtttgtatggatttttaaacctagtggattttatgactattatatcatgaactattgattgtacataataagaataaaattagtaagaaataagggggttactgtaaagacccctagatataaggaacaaaaaatcttcctaaattttctgtaaagcaaaatttcacatagcaaaaccaattttctcttggctcccattataaaactagaggtttatttctaggctgggtgcggtggctcacgcctgtaatcctagcactttgagaggcctaggcgggtggattacctgaggtcaggagtttgaaaccaggctgggcaacatggtgaaaccctgtctctactaaaaatacaaaaattagccgggcatgttggtgcatgcctgtaattccagctactcgggaggctgagacagtagagttacttgaacccaggaggcagaggttgcagtgagcgagattgcatcactgcactccagcctgggtgacagagatgagacaccatctcaaaaaaaaaagaaaaaaaaaaaaaactagaggtttatttctatagggggaaaaatgatcttaaattataagcttagcccactaaagaactttcttccagcataacttatggaaacatttctgtctgctaccaatagctgccctacccaacgcaacacatgatcattgtgcatcccaactacttagcagctttccttggctccaaagtttgttatttttgtaactgctaccgttacctgcacctccccgctaaacccccaaaaaataaaagaagagaaagtgatcaggaaggaggaaaaacatatgtagccaaaggggaggcatagtctagtgagtacaatgaggttacttcaggcagcccaccgcatctcaggcaaaaatctgtgaaataagcaataattagagtattgctaagcttcttaaggcagattctgaatatcgagtcactatataacattatataacttctttacatgcctataaaaaaattgagatgctcccctaagtccattgaatgaagtcagatattcttagtaattttcataaccaatatttgtataatttttaaaaattattaacagggttttcactacattgctttctgtgatttcacctgtgaagctcactattcaaaataccaacagctgttgcatcagatctcaaagtcaaaaagtaaattgagtcttcctccagagttacttacaaaaataaaagtataccagcaggtttaattattttctaaagaaattctgtttttctctaattgaccaaaataccagctgtttcataaagaagcagagctgaccatatgtatctgaagttctatgaaagctttcacaaaactaaacgctcaaacttatttttgttttttttttgtttgtttgtttttgttttgttttgttttgttttgtttttgagatggagtctcgctctgttgcccaggctggagtgcagtggcacaatctcggctcactgcaggctccatctcccaggttcacgccattctcctgcctcagcctcctgagtagctgggacaacaggcgcctgccaccacgcccggctaattttttgtatttttagtagaggtggggtttcaccatgttagccaggatggtctcaatctcctgacctcgtgatccaccggcctcagcctcccagagtactgggattacaggcgtgaaccaccacacccagccacttatttttgttttaaatacatgtatttattttatgttaggctttttccccctaattatccttaatcagatgaattttttaatttaagaaatttttggctgggcgtggtggcttacgcctgtaatcccagcactttgggaggttgaggcgggcagatcacaaggtcaagagttcgagaccagcctggccaatatggtgaaaccctgtctctactaaaaattcaaaaattagctgagcgtggtggcgggtgcctgtagtcccagctgcttgggaggctgaggcaggagaattgcttgaacccaagaggtggaggttgcagtgagctgagatcgcgccattgcactccagcctgggtgacagagcgagactccgtctaaaaaaaaagaaagaaaattttttttaattttgaaattaagtctgaatacttcaaaaagatcttaaagaaacttgaccctttgaaaattatttaagaagaaaactttatgctatgatttctcaatacgtagaaagggaaatagaagttaaattttgttataaatttgcttatggtccagaatttttcatagaaatatgctaatttgagggtgtttttaaaaatcttttattccagctgaacctgtaaaagatatgccttcaattcctgtcttgaatgctgccaaaagaaatgtcttagatagtagttctgacttcccttcaaggtaaactccacaatgactttattttcaccatttctattctatttactaattaaattacataatattatattacattaaataaggtttttaagaatttcagttggattttgaactgttataattagcttaccctattaaagcctgttttaacttaaatataaattgaaatatacactgaaatgaatgtttatgtaccacactgaaaagatgggacaatatattctaagttcccaataaccaacctaaaaccaaacttttgatgcataacttgttcataattgagaactgtctaataggtaactcttaggccttggagggaaattttgaaattctattaggacttttacatattttattattttaaaaatctttgaaggtttttcctgctttttttttttcttgttaggatagctattgagagatcacagtgttacccacacaacgggtgggtttggtctcttggcagatgacagtccaaagccacaaccaaggaggatttaacaagacgaggattttattacttgcagcaagtaaggaggacaccgggaataattccccaaagcagtgcctcctcaagcagaggtgaaaatagggcttttagtaggctggttaactgtatcattgtgtgtagaggtggagtaaaggcagtaaaggcacagtcatcagtcatgcttctgcatactggcatgtatagaaaatgcggaataagctcctccttggatgggatttttagtgtggtaatggtaatacatttccgtctcaggcatctctacatccacccagcttgtgtagtttttgttttgtaatgtggggttgggctgcttcctggaaatttctcaaacaataaaaatttcaaggtgcaacagttacaagcaggtaccttttcacagtgtgtacctgaaaacccaaggaccctgggttacaacaatagaatatttattacaatattaaatctttaatgttttagtacatagtattaggaactaaactgaaagcaaagtaaaaatgtcctatcatattaatacctagataatcctgacttctcacccaggtatatgatagggacattagtttgtttaaaaatgtatttcagcagctcctataagcagctttttatttgaatctattagaacctacaatttatattgactttggactccctaatctatctgattttttacgttaaaactaatgtcttttgtgggtttttggaaattcagacacattaaaaatacatttcaaaaattatgagtaaaacattcaaagtaatttctgtatgaattcttggcttaacacaaaaatatgaaatttagcaggcatggtgggtcaatagtgacatttccttccttgaagatttagaaaacactcagtgttctaggtcatcactcttgctctattaaatctttaaattccactttcaaagtggaggaaagtaaagctttccactcaaagattagattattccataattattctaggaacctaaatggacagtctcccacatttctgaaaaatgttttaattcatgtcctctggaaaactcatctcttttctgtctctcagacatctcagcagctcatttttcctatttttcccagcagaaactctttttataatgcagatggatgtctacattcttttccttgaaaagttattgtgtagccattattctaggctattctgagttcctagtcatcctctcatttctataagtctccatatggtccattgtagttctccaacactgtggaacttttgagaaagaattgaagtatttttacccttcctgggaataatgtagccacatctcaaatgttagtgaacctaaataatgattttatgagaaagaaaaaaacaaaggacgaagacagacaaagcaaaagatgttttcagcagctactccacacacttggctaccagctgttggagatatacaaacaggtccgtgagcagagaggctgtcaaggtattttactagggtttattatacctatagtttttagagattagatttgaccaaagtatttcaaattggtgagtttcattttacttttttatatatcagtttttatgtttataaaaatgaaaataattcatatctcacaaagacattgagatgtatatgaaagtacttcaagttgtttggctaaaagacataaaatatatatagatacatactgtaatcacagccattctttggtttaaacaatatgtttccatatttttaaaatttaggttgtagaatgagaggtggtagtgttgtttctaacttaagacattctacctaaatttatattaaacagctaaaatataacattttaaatttattttccattgcagtggggaaggagctacatttacacagtctcatcatcatttgccttctaggtattcacgtccccaggctcattcttcagcctcaggtaatatatttgaaaaagcctaggaaaatactcttttaagtaggttacctgggaaatgattgacagtaaatataaataaacaaatatccagggtttttttgtgtgtgtgtgtgtgtgtttttttgtttgtttgtttgttttctgaaaaatggctattataacacactaaaagcatggtcagtttcactgtggttgcttttcttgataaaattatctctaattctccttatgtacctatttaatttgtattgctattaatgaatcctcaaatacatgaaatctcctaagttgctataagttaatttttttacatgatttcaatggctttttcttttttgcatttgaaggaggaattagaaggtcttcatctatgtcttatgttgatggcttcatagggacatggcccaaagagaaaaggtaaacaaagagaattacttttagtgtattcagattattaagaaatgcaaattgcatctgtgtctctcttttattgataaccaaattgctaaaacttttaattagttcctaaatttgaaaaaggcagtataggcagatgatagagatgtaaaagaggctaactttaaaaagtagctagatagccctccccttaccttgaagacagtatgattatgagaactggggaaagaaaggaaatgtaatttcaaataattcttgttaaatgatactaaaaatcatttctaggatttttaaaggatttttctctttaacttttttttagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggtgtagtattaatctgcatagttttgggcatcttcattagatgagtgtggttgtgttggatattttttttttcagttgacatgcttgcttctttcagtagcagtcccttttgatacaagttcatccccattaactatagtaacattcaagcacactgtggtttccagtatggactcaaagctgtaataaatccttttatcacatgtttagatgtattccttggttttgctcctctactgctctttctcactcacaaaagccttttaaaaattaagctactcagatctcttcagagaatgattccattttgtctcttaatcatgtaacactgccattttttttaacagaatgctactgtagacactaatagatattaaaatttactgcctagagactctgttccttgcagaggaagggaaacaaaggggaagaaaatcattagtataaaacaggcagtacctctgttgcttcatttctattccatttatttacacatcttcaccaccccattactcatctgttggactatggttacagcttcttgactgggctgtctgtctccaatcatgccattccagtcttcatactgctactaaaggtgatagttccaagagcatagctccaattgagtctctttctagtcaaaaatcttgcctgttgaataaagttcaaaccctttagcacaacattcagggactttcacagatgaacctaaatctttttgtctagcttcttccccataattttattttgtattgttctttaagattaacttcaagcttcatctaaagccttttataattccttcagtcgaggtcaaatgtttcatcatttgtgtatctattgtatccttaaatatactcatacctgtcctgtgtcccggagttttcaactgttttgtatgatttgctttgtctcttagaccatgacctcctagaggtgctgcatctttttatttttatttatttatttatttattttttgagacagagcttcgctcttgttgcccaggctggagtacaatggcgcaatctcggcttaccacaacctccgcctcctgggttcaggcgattctcctgccacagcctccctagtagctggtattacaggcatgcaccacaaaataaattttgtatttttagtagagatggggtttctccacgttggtcaggctggtctcgaactcccaacctcaggtgatctacccgcctcagcctcccaaagtgctgggattacaggcatgagcccccgtgcccagccaaggtactgcatctttttatccccatagcataataaagtgtctggcaaactacaatatatgtaatttgatagatgaagacatatgaatgtttgaactaattgcttgaatggtatcttctgactttctccattcagagttaaatctctctctgggtttccatacaaagcctgttgtttgtacctcttctccttgtgattttttaggctccttgacctgaggtaccatatattttaatatatgtaatatctgacactatgttgtgagtatgttagacaccaaagaaatgtttattgaattaagcattggcagggacagttgacaaggagacattaagacagtgaaccacttctacaacagcttgttactttgctgaattctgaagcattttggaagcccgctgagaactagggctgtccctaaggattcaggtagaaactagggcaggcccaggaggcctatagataatgaactagctctcaaattaaaagtactgtagaagggaagtataatcatccccatcttttcttcaatggaaaaatgttcattatagttcagaacctatcaagcagactgtcagtacctcaacttaaaatcatgcagcaatagtttcatttatgtgctacaacattgggtggctaattttgggatgtttttacttgaggtatttttactgagcttatattttaaataaaatttaaatgcaattttaaaaattggtgggggaactacctactgtaagttattaaattagggttaaaaaaaatttgtgcttttttgttttgtttttatggttgttctttgcaaatctcataggttttgacagagtgtaattaaataagtttgcctgtcctcttttttgatggaactgttaccactgtagttccgttcttccttcataatttctcaaccacacccacattcagaagggttgtaatagttcaaactttcagttataggactaaccacaaaatgtgactacaacaattgaaaatgagaatattggtacctaaaatgtttgatcgttttcaatgaaattcgttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaa

SEQ ID NO: 1677 - DNA, 89314 bp, Homo sapiens
ggttttgatgaacacctggctttattcttgcaatgaagaaaggttctcaacaaaaaatattctccaaagcaaagataccatcatcatctcactctcctatcccatcatctatgtccaatatgagatctaggtcactttcacctttgattggatcagagactctaccttttcattctggaggacagtggtgtgagcaagttgagattgcagatgaaaacaatatgcttttggactatcaagaccataaaggtatcactttttaatctaagaattggtctgaccacatacttcaagtagagatggaaaattttcggcttgcatttttggtccaactgtaacattctggtactaatttgatctattgtttttattaacagaaattaaggactgtaaggacagttggaggattgaggtttctgggtgagggtaaagatgtcagtggattcaaagagggagttttcagaaagaggaagctttgtttcctgtggtaggagagtgtcttaaaactcatcccaaaacttgccatcctctttggttaaggggagggaagatctgttcacttcagagtggagcgccttaattcagtaaaaaaacgttatacatacttggcctatgccagtcttcttattagcaaactgcttatctgtgaatggactgatttccacatatgggacatgtatgtatgttccactagtgttttagttttttcttaaaatcatctgttagtctaggaatctgttctcaaaagtgcattgttgggggtatagcttagtggtagagcatttaacttcaaaagtaagttattctttggtaagtcatgaaataatagccattaaactctaatcaggttttattagcattaacaacactgagtttatactatatctttgctgcaagttggcatattgttatttctaatttgattaatattttagaatgttatcaaatttagaatattaatcaattttctttccaagaacaagccaagttaaatttaaatatctttttattttgcaccaaaataaatttaatactaacttgtaaataatcttagagaatctttggctcacagcctggatctcaacccaggattaattttttctgactcgtaaggcaggaaccaagaggtgatttactttttagggctacttttgtaaaatgtaatgtggcattaacagtctttgacaacaatatccaggaaagttataagaccagatttgccatccatcaagtgactgctctagctctataaaatatgttgtgattttctctatttaaaagtgcaacaaatttagagtttcttaccataaaaaaataggaaaagaggatttttaagaatttcagtgtttctgaactttagattggaattttctaaaaaaacaaacaactaagtattaccagtttatttttaaaaactaacacgaaaatattgctgaaaacttcatatagttaaaagtgcaagttttatattcctctgactggattcaagttctggatttgtgccttaattagctgtaggatcttgagcaaatgattttttttagtaagtgatgatattaataatttctatctcaaaggtttgttgtataaattaaattttaaaaatgtaaaccacttagcccaaagcttggcacacaccaaatatttatagtgtgtataaccattatcatctttgtatcattatagttactacattacaatacgttatagtattacaatacattaattgtaatatacaatacattatagttattacattataatacattatagtattacaatcattacatcattatttcattataattatgaaatgctatgaagtaaaatattattaaaacattatgattagaaatagccagcttttttggtatattcatggcttaatttttgtttttgttacataacatcaaaacaacttgttctttgtgatattcatgtctttcctctactgatgatgatctgtttctataatttcaggagctgattcacatgcaggagttagatatattacagaggccctcattaaaaaacttactaaacaggataatttggctttgataaaatctctgaacctttcactttctaaagacggtggcaagaaatttaaggtaggttaccaacaatttctgagcatagatactgtttttaacttttctgtgctttaatactgcgaaaaaaaattatcctaatgtcacctaatttgtggcagaccttttattgtttccagtgaatgttctaaatcagaagtatatgacatttccaaattaataagtttctattactcaatattcttacaacattgactctgtagagaaggggttggcaaagtacagcttacaggccagatcaggccagctatctatttttgtaagtaaagttttattggaacacagtcacccttatttgtttacatattgtctgtggttgtttttgcactacagtagcagagcttagtagttgccacagactatatggcccgcaaagccaaaaacatttactatttggcctttgtattcgttcattttcatgctgctgataaagacatacccaagactgggcaatttacaaaagaaagaggtttaattggacttacagtttcacgtggctggggaagcctcacaatcgtggtggaaggcaaagaggagcaagtcacgtcttacatggatggcagcaggcctaaagagagcttgtgaaggaaaactcccccttataataaccaccagatcttgtgagacttactatcacgagaacagtaggggaaggacctgcccccatgattcaattatctcccactgggtccctcccacaacacatgggaattcaagatgagatttgggtggggacacagctaaaccatatcagccttttacagaaaatgtttgctaattcctgctctagagtgtttacagcttcattcataaactatacaacatgaacacattataatagacaacttaattcctttaattggaagaaaaaaaccttagatttctaccacgtattattcacaaaaagtatttccagaagggtgaagaactaaatgaaaacaaagcaaaatgaaaacaccaagtaacagaaatgctataaaagtattagagagagtatatgagaatatttttaaaatcttagagtggtgaaggtccccctaagcaaatactaaccctagtaccacaaaggaaaaatattgacagatttagcctgcataagacttaaacattgtgtttaatgaaagatgtattttaataagttaaaagaaaagcagcagccgggcgcagtggctcacacctgtaatcccagcactttgggaggccgaggtgggcagatcacctgaggtcaggagtttgagaccagcctgggcaacatgatgaaaccccatctctactaaaaataccaaaaattagccaggcgtagtggcgggcgcctgtaatcccagctactcaggaggctgagataggagaatcacttgaacccaggaggtggaggttgcagtgagccaagatcgcgccattgtactctagcctgggcaacctagatgttcatacagctggcttcttgttgttaaggtctcaacttagtgaggtcttctcttttttttttttttttttttttgagacagggtctcactctgtcatctaggccgatgccctctcttaccacccaatcacaattagtcaccctctcctcagtcgcactctcattcttttagtcaacaagtatttatttagcaccaggcagtaatgctagagtagtgaaacacaacgggcaaaatatatatatttatatataaatataaatatatacatattttatagatttttatagcaaacatgtattgcttatatatttatatatgcttatatataaatatatacatattttatagattttatagcaaacaagatcttcagaaaataaacagtgctaaaaaggaaataaagacatcttgtgacagaatgcaaggcaccaacagggcagattttgcccattgtgttcactactctagcattactgcctggtgctaaataaatacttacttgttgactaaaagaatgagagtgcgactgaggagagggtgactaattgtgattgggtggtaagagaaggcatcagcctagatgacagagtgagatatagatagatagatagataatatatatctatatatatataatatatatctatatatataatatatatctatatatataatatatatctatatatataatatatatctatatatattatatatatctatatatataatatatatctatatatataatatatatctatatatataatatatatctatatatattatatatatctatatatataatatatatctatatataatatatatctatatatataatatatatctatatatataatatatatctatatatataatatatatctatatatatataatatatatctatatataatatatatctatatatattatatatatctatatagatatgtaatatatatatctatatatatatatatttttttttttttggagtctcgctctcttgccaggctggagtgcaatggcgtgatctcggctcactgcaacatcctactccctggttcaagggattttcctgccttagcctcctgagtagctgggattacaggcacgtgctacgacgcccagctaatttttttttatctttagtagagacagggtttcaccatgttggccaggatggtctcgatctcctgaccttgtgatctcccctcctcggcttcccaaagtgttgggattacaggcatgagccaccgcgccctgccatatatttatttgtttattgtctgtttctgtgattgagaacaagaactttgttttctttattcactactttgtttccagtacctagaacagctcctggcccataatccatgtttgataaatatttgtggaatgggtgaatgaattataatcttggagagaaccatttgatgtggtagaagatatattgccttaccaatacaggttgagcatcccaaatccaaaaatctgcaatgctccaaaatccaaaactttttgagcactgacctgatgctcaaggaaaatgctcatttgagcatttttgggttttggattttttgatttgtgttgcttaaccagtaagtataatgcaaatatttcaaaacaaatctgaaatctgaaactctttaggtcccaagcattttgaataaggtatagtcaacctgtagaataggaatgaatggaagacagaatgaacaaatgtagacaattcgtgtgagaacattggtggtagataaggaagataagatgatagcttcatagtaaaacaagtttagtcctaggtgatttatatagaagaaatctgaacatattgaatataaactctgggcagcagggaagaattatctagttcacgccatattcccattacctggtgcaatgcctcatatgtagtaagtgtgtaatgaatatatgttggaaaatgactgcttttaaacttgaggggaagatccaggagggagaaagaggttgaatttgcaagggcattgggggaggaggtgagatcatgcaagagcataagtacttgatttaacttgaaaaagaagacattgtggctgacatggtgaaaccccatctctactaaaaatacaaaaaattaaccaggctaggtgggacgcgcctgtggtcccagctactcgggaggctgaggcaggagaatcgcttgaacccgagaggcagaggttgcagtgagccaagattgcgccactgcactccagcctggccaacagcgagactcggtccccgccccctccccacccccgcaaaaaaaaagaaaaagaagaaagctatctctcttagtctcttagtccattttctgctgctgtaacagactaccacagactgggtaatttataaagagtaaagatttctttggctcaccgttctggaggctgggaagttcaagattgaggtgctgcatctagggagggccttcttgctgcgtcatgacatggtagaaggcatcccatagtgaggcagagcaagagagcaaaagatcctgagacacagagagaaaaaggagactgaactgtgataattaatccactcccaagataatggcattaattcattcctgagggcagaaccctcataacctaatcaccacatgaaggtctcgcctctcagaactgtcacaatggcagttaaattcaacatgagctttggaggggacactaaaaccatagcactatcttttggaagaaaggaggggaatgagagggagaggtatggcaaaagtgaggtagagggaatgacagtgagggaaatcttgttggatagtcttgagcttcttagtatatagacaatgttgttgtcaactgaagggcaaagagagtttggtagcttgagtagagttattactcctagtcaaggagagctgcatcaagggattctccaggagagcagtaagggtatattattttctgatgactgatcaaacagaccctgatgcacataagtaaatgttgtactttatgtcaagtcatctgttgtgtaaagtattcattcatttgtttccaattagtatattgagaatttggaaaaatgtgttaaacttgaagtactgaatctcagctataatctaatagggaagattgaaaagttggacaagctgttaaaattacgtgaactcaacttatcatataacaaaatcaggtgagttatataacaaaatctttaggcagcattgcagatagctttgttagagaggtagattaatgttatccacattactgaaagaatgatttgacagaaacagaagatatttttatctttattcatcaatcaaatgaatgtctgtctcttcacatatggtaggtaactgtctttatgttttggcattactgaagtacagaataacatctagcattatcaaagagatatatttttgagcaccaaattgtatcttaatttcatttctgacaggaagttttcccagatattgtctgtgatttattaccttattacattaagaatgttgacatgaagcagaatgttttaaccctgccattttgacccccaagatgttctaatctgttttgattctgatgttctttgcttattgctacaagaaatatgctctcaatcctgtttccaattcataatatatattactgtgagaaataaacatactaaaactgacactggctaaaacttcatatagaaaacttgttatagacaaaatgatacaagaatcaaatcttgaaattcttaatatctgcatgcttttcccccaagttagacttggtaaatatgatggccaagaaaatgactagcaatggcagaagttctgatatgacaaaactgaaatgaaaaaaaatgattaatgaaccaaacccttattataaaatttgtataaaaagttgactctgatgaaaatattttcagcaaaataaaattgaaagtagagaagcttagaaatatttacccagtgtagatagaggctttgaagtatttgtgcagtatagaaaattgaccaaagaattaaattgacaaataaattagaagtgacttgggaaaaaccttcatcaatcagaattcattaatatgtgtgataaatgctttatttaaaagttctggttaaattacttatattcctaaatacagtatcatctatgggctcccatatcctgctggcatagctaatctttttatgataacttaagacaataattaggaacatcttttggacaggaatgtagcagataggacagggtgctattgagtttcccaggtctccactggctgtttgctagtactgttcacagtagtcggtgagaatgccatggtcacatttttcttttctatgttatggagttgcaaagtctaataataagattgataggattcctgggcatagtaataaaaagttggcagtttagctgttctggtaaatttggctttagccacttttctttgttctcatttatgaaaagagttgataaattatcattatgaaaagtaatctaacatggagctaaagctgtttattctaaaaatacaatggagagactctataattgtactcactaaattttattttatcctttgctttccagcaaaattgaaggcatagaaaatatgtgtaatctgcaaaagcttaaccttgcaggaaatgaaattgagcatattccagtatggttagggaagaagttaaaatctttgcgagtcctcaatttgaaaggcaacaagatatcatcggtaagttattcaaaatagcaggaatttttagacttgttaaaaaataaaagattaaaaatatctaagttttttaaaaatgggatttcttcttttaaagattttgctcctttgactaaacactagattcagacatagcccatgattttctagattaattaaatacaagcagtcctcattttgcatgggttcctaggtcaacctagggttgacctcttagcatttttacatttatcatttcatgtaagcctcataacattcttgttaagaaggcagtacaaggattatttttgtaacactatgagttaggtagtagcaagtaaggtctaggacaggttaagtcccttatctagagtcacattttgtgccaggatccagatcactgaatgcctagaagaaagttctgggtttttttttttttgacagtattaacttccaatttcaaatttaccagtttattttgattataatgttaggtgttataggaggttgatcactagcttttcataatagagcaactttgttatgatttacatatttggatgatgttgtatatttttctctggaatatagtttatgattttcttatggtatttattcacagctaggtatttaataagcatttgcttagtaaatttgttaatttatttaaatttgtattaaaattgggaaaattgtgccataatttaatgaacatcagttgtagaatagaaaatgaaagatgtgacttcaaagatgggcctctatagaattgccttccatgaccttggagaattctttaatccctctaaaaccactgtttggggaaaacaatccctatactgcctcctttacaggggtattatgggggctcagatgaaatgatagatgtgaaaatgctttaaaaaaaactttaaaacactaaataagtctaaagctatattctttaagccttcaccagtggaggccaataataataagcaatattcatttaatgccatgttgttaacaatacctatgctttctaatttcatcctgtgacagtcaagagcctcagagcccaagcccaaccccatgttgtacagcatcaccttggggctgttgatgctatgggatgatgggaagaggtagccatagatctaaaatttgccataaatattcctgaagtagttgatccttagatagtgtcaacttagtgtcagctgtgcaataggaaaatcaataaatatttatttctaattttgtatgatgtcctcaccccattgatatttgacattggcattatgaagagtgctgcacattcacttgggagagaagatttatttgtactagctatttggagtactgtttctcagcctttttaggttgagaataaactatctgaataaactgtcaattatagcacagttatctgaagatttaccaaaatattttttataactattcatttttttgatttgttaaatcagtataatgaaaagacaaagttgagagttacacaaacttgaattcaaatcctgtttcattcacttacaaggctttgagctttgggcaagtcgcctaacttctttgatcctgaatttcttcatctgtaaaattaagatgatacttacatgataagttgttgtgaggagtcacaaatgaaatagtgtatggaaaatacctaatactgcccaaatacactataaatactcatatactccctttcctgacaccactacttttgggtaattggcttcatgaatagattccttgccatgttaaatttccttgatttgtaacttcctttaagtatgttatgatttttaaattaaattataccaatactaatgttatatcatttcagctccaagatataagcaagttgaaaccgcttcaagatttgatttctctgatcctagttgaaaatccagttgtgacccttcctcattacctccagtttaccattttccacctccgttcattggaaagtttggaaggtcagccagtaaccactcaggatagacaggaggcttttgagagattcagtttaggtaagattaaatttaaaaaataataaatttgggtgagggaggaatttattttcagaagttatctagaaatatgtatcatgaactttataatgctattaaaatgtacatgggaaatggcagcataaatcaattcaacaaatatttactgagtgtgtactgtgcaccaggcaactggatttggcactaaggatacaatgggaaggaagacatatggtgctgctgtccatgcagcttatgttttggcagagaagacagacaaaaaaaaaaacaaaaacaaagtaacaggggaaccctctttgtggcatagaggaatggctttctgagggagtgacatttaacccgaaagcaaagagaagagagggttagccatgtgaagaatggcagtaaggggagggagcagcttgttctttgaggctcaaaagaccctgtgagtttaaggaagtgaaagaagattagagttaaacgtccctgactgacagctttgaagagagtagtggttctcccagcacggagtttgagatctgagaatggacagactgcctcctcaagtgggtccctgacccccgagtagcctaactgggaggcatctcccagtaggggctggctgatagtgcccctctgagacgaagcttccagaggaacaatcaggcagcaacatttgccgttctgcaatatatgccgttctgcagcctccactggtgatacccaggcaaacagggtctggagtggacctccagcgaactccaacagacctgcagctcagggtcctgactgttagaaggaaaactaacaaacagaaaggatatccacaccaaaaccctatctgtacgtcaccatcatcaaagaccaaaggtagataaaaccacaaagatggggagaaaccagagcagaaaagctgaaaattctaaaaatcagagcgcctgttctcctccaaaggaatgcagctcctcaccagcaatggaacaaagatggatggagaatgactttaacgagttgaaagaagaaggcttcagaagatcggtaataacaaacttctccgagctaaaggaggatgtttgaacccatcgcaaagaaagtaaaagccttgaaaaaagatggcacgaatgtctaactagaataaacagcatagagaagaccttaaatgacctgacagagctgaaaaccgtggcacgagaactacgtgacacatgcacaagcttcagtagctgattcgatcaactggaagaaagaatatcagtgattgaagatcaagtgaatgaaatgaagccagaagagaagtttagagaaaaaagagtaaaaaaaaatgaacaaagcctctaagaaatatgggactatgtgaaaagaccaaatctacgattgaatggtgtacctgaaagtgacagggagaatggaaccaatttggaaaacactcttcaggatattatccaggagaacttccccaacctagcaaggcaggccaacattcaaattcaggaaatacagagaatgccacgaagatactcctcgagaatagcaactccaagacacgtaattgtcagattcatcaaagttgaaatgaaggaaaaaatgttaagggcaggcagagagaaaggtcgggttacccacaagggaagcccatcagactaacagccgatctcttggcagaaactctgcaagccagaagagagtaggggccaatattcaacattcttaaagaaaataattttcaacccagaatctcatatccaaccaaactaagcttcataagtgaaggagaaataaaatcctttacagacaagcaaatgctgagagattttgtcaccaccaggcctgccttacaagagctcctgaaggaagcactaaacatggaaaggaacaactggtaccagccactgcaaaaacatgccaaattgtaaagaccatcaatgcaaggaagaaactgcatcaagtaatgagcaaaataaccagctaacatcataatgaaaggaccaaattcacacataacaatattaaccttaaatgtaaatgggctaaatgcccccaattaaaagacgcagactggcaaattggataaagagtcaagacccatctgtgtgctgtattcaggagacccatctcatgtgcagagacacacataggctcaaaataaagggatggaggaagatctaccaagcaaatggaaagcaaaaaaaggcaggggttgcattcctagtctctgataaaacagactttaaaccaacaaagatcaaaagagacaaagaaggccattacataatggtaaagggatcaattcaacaggaagagctaactatcctaaatatatatgcacccaatacaggagaatccagattcataaagcaagtccttagagacctacaaagagacttagactcccacacaataataatgggagactttaacaccccccactgtcaatgttagatccacaagagagaaagttaacaaggatatccaggaattgaactcagctctgcaccaagcagacctaatacagaactctccaccccaaatcaacagaacatacattcttctcagcaccacattgcacttattccaaaattgaccacatagttggaagtaaagctctcctcagcaaatgtaaaagaacagaaattataacaaactgtctctcagaccccagtgcaatcaaactagaactcaggattaagaaactcactcaaaaccgctcaactacatggaaactgaacaacctgctcttgaatgactactgggtacttaatgaaatgaaggcagaaataaagatgttctttgaaaccaatgagaacaaagacacaacataccagaatctctaggacacgtttaaagcagtgtgtagagggaaatgtatagcactaaatgcccacaagagacagcagaaaagatctaaaatcgacatcctaacatcacaattaaaagaactagagaagcaagagcaaacacattcaaaagctagcagaaggcaagatacaactaaaatcagagccaaactgaaggagatagagccacaaaaaacccttcaaaaaaatcagtgaatccaggagctggttttttgaaagatcaacaaaataggtagacccctagcaagactaacaaagaagaaaagagagaagaatcaaatagacacaataaaaaatgataaaggagatatcaccaccaatcccacagagatacaaactatcatcagacaatactgtaaacacctctacgcaaataagctagaaaatctagaagaattggataaattcctggacacatacaccctcccaagactaaaccaggaagaagttgaatctctgaatagaccaataacaggctctgaaattgatgcaataattaagagcctgccaacccaaaaaagtccaggatcagacggagtcacagctgaattctaccagaggtacaaagaggagctggtaccattccttctgaaactcttcaatgaatagaaaaagagggaatccaccctaactcattttatgaggccagcatcatcctgacaccaaagcctggcagagacacaacaaaaaaagagaattttagaccaatatccctgatgaacatcgatgtgaaaattctcaataaaatactggcaaaccgaatccagcagcacatcaaaaagcttatccaccatgatcaagtgggcttcatccctggcatgcaaggctggttcaacatacacaaattgataaacataatccatcgtataaacagaaccaaagacaaaaccatattattatctcaatagatggagaaaaggcctttgacaaacttcaacagcccttcatgctaaaaactcaataaattaggtattgatgggatgtatctcaaaataataagagctatttatgagaaacccacagccaatatcatactgaatgggcaaaaactggaagcattccctttgaaaactggcacaagacagggatgccctctctcaccactcctattcaacatagtgttggaaattctggccagggcaatcaggcaggagaaagaaataaaggatgttcacttaggaaaagaggaagtcaaattgtccctgtttgcagatgacgtgattgtatatttagaaaaccccattgtctcagcccaaaatctccttaagctgatacgcaacttcagcaaactctcaggatacaaaatcaatgtgcaaaaatcacaagcattcctatacaccaatgatagacagacagagagcagaatcatgagtgaactcccattcacaattgcttcaaagagaataaaatacctaggaatccagcttaaaagggatgtgaaggacctcttcaaggagaattacaaaccactgctcaacgaaataaaagaggacacaaacaaatggaggaacattccatgctcgtggataggaagaatcaatatcatgaaaatggccatactgcccaaggtaatttatagattcaatgccatccccatcaagctaccaatgactttcttcacagaattcgaaaaaactactttaaagttcatatggaaccaaaaaagagcctgcattgccaagacaatcctaagcaaaaagaacaaagctggaggcatcacactacctgacttcaaactatactacaaggctacagtaaacaaaacagcatggtactggtaccaaaacagagatatagaccaatggaacagaacagagccctcagaaataacaccacacatctataaccatctgatctttgacaaacctgacaaaaacaagcaatggggaagggattccctatttaataaatggtgatgggaaaactggctagccatatgtagaaagctgaaactggatctcttccttacaccttatacaaaaattaattcaagatggattaaagacttaaatgtcagacctaaaaccataaaaaccctagaagaaaacctaggcaatactattcaggacataggcatgggcaaggacttcatgtctaaaacaccaaaagcaatggcaacaaaagccaaaattgacagatgggatctaattaaactaaagagcttctgcacagcaaaagaaactaccatcagagtgaacaggcaacctacagaatgggagaaaatttttgcaatgcacccatctgacaaagggctaatatccagaatctacaaagaacttaaatttacaagaaaaaaagcagccccatcaaaaagtgggcgaaggatatgaacagacacatctcaaaagaagacatttatgaaaaaatgctcatcatcactggccatcagagaaatgcaaatcaaaaccacaatgagataccatctcacaccagttagaatggcaatcattaaaaagccaggaaacaacaggtgctggagaggatgtggagaaataggaacacttttacactgttggtgggagtgtaaactagttcaacctttgtggaagactgtgtgtgattcctcaaggatctagaactagaaataccatttgacccagccatcccattactgggtatatacccaaaggattgtaaatcatgccactataaagacacacgcacacatatgtttattgcggcactattcacaatagcgaagacttggaaccaacctgaatgtccatcaatgatagactggattaagaaaatgtggcacatatacaccatggaatactatgcagccataaaaaaggatgagttcatgtcctttgtagggacatggttgaagctggaaaccatcattctttgcaaactgtcacaaggacagaaaaccaaacaccgcatgttctcactcataggtgggaactgaacaatgagaacacttggacacagggtgggtaacaccacacactggggcctgtcatggggtggggctagaggggagggatagcattaggagaaatacctaatgtaaatgacgagttaatgggtgcagcacaccaacatggcacgtgtatacatatgtaacctgcacgttgtgcacatgtaccctagaacttaaagtataattaaaaaaaagaaaagtaaaaataaataaaactatccaaaaagaaaagaaaaaaagaaaatcagatagactggaggacagctcaataaaaagtgtgtagacataagtaggtgtgagatggcacagggccttggaattttgattttatttcaggtgcattggaaagccactggcaattttttttttttttttttttttttgagacagagtttcgctcttgttggccaggctggagtgcaatggtgcgatctcagctcactgcaatctccgcctcccaggttcaagtggttctcctgtctcagccttccaagtaactgggattacaggcatgcaccaccacaccaggctaattttgtatttttagtagagacggggtttgtctgatttctcttacggggtcaggctggtcttgaactcccaaccgcaggtgatccgcctgcctcggcctcccaaagtgctggcattacaggcgtgagccaccatgcccggctgccattgacagttttttaaaaagcagcaataggacatcatttttgatacagagaatgatttggagcagggaaaatggagatgaagggacctgttaggaggctagcgtagcaatctaggctggagtctatgccataccatctgaatacattcacaagatcttgaaagctaagcagagtcagccctggttaacacttggataggagtgatccaggttggaaacgtttatggcctgtagttaacatgctggatgtggaaatgaaagatagatggatcagttttgaaggtagaagcagcagcattttctaatggattggataattcccaggcttttggctcaagtaagtaagtggctagatggtgatatcatttataaaaatgaagaattcagagttttatttaggacatattcagtttgaaatgtctgtgagacaactaagtggaggtggcatagagtcagaaatgtgagtctggaatttaaagagatctggactagtcatacaaattttatgctcagtcacatcagcataaaaatgacattaaattgcatgggaatcagctcactcaggcagtggttgggagacgaaagaaaagcagtccgctaaggaagctgagaaagagaggccagcaaggtaggagaaaaccaggaaatagtgggaaatagcccagagaagttttcaagagaggaagtggtcaactctgttgaatgttgctgagatatgaagtgagaagcagagaagtgctttagattggcaacaggtgataatgatcttgacaggagtagttaaggaatagtggggacagatgctagattataatggcttgaagagtgaataggagagagacatttggctggagatttgaaattttttcccataatgtctcttgtagtacttaataaatcatttttttaaaaagatcaaaaattaaaactgaaaaattcaccagtggcttccagaccaggaaatgggcagaaacaacaaatgcagtaaacttcaaagccagaaaacaaaaaaacaaatgaacagaatattcaaaagtggagtggaggccgggtgtagctgttcacacctgtaatcccagcactttgggaggccgaggcagatggatcacttgaggtcaggagtttgagaccagcctggctaacatggcaaaaccccatctctactaaaaatacaaaaattagctgggtgtggttttgggcgcctgtaatctcagctatttgggaagctgagagaagagaatcacttgaacctggtagacggaggctgcagtgagccgaggtcatcccactccacttcagcctgggcgacagagcgagactccgtccaaaaaaaaaaaaaaaaaacctaaaagcaaagtggagaaacaagacatggctcaattcttttggttctggagaagacatgagaatgagattagagaaaaaaaggaaaaatcccttggtaggagtgacactttctccttcagaaaggagcaaagatatgtgcaggtgtgggtagttttgttgctgtggtggtgggaaaatagggagttcttattgatggggtcattttcttaattaaaggtgagataatcaggtgagagagaaaatagaagaaagtgtatgggaagtttgagaagaaagaggaaggtatcaaatagccaatttagagtgttgggaaatgagcctgtctgttcatttgaaattagttttagtctgttttgacctccaaaaatggcaatttcatatggtttgatccaacttgagaaacatggcaagtttttattagtttggaatctccctaactcaatatttattattctgaagtttatgttttggaatcattaaaaatattaataatgcaaaggaaagtcatctagataacttttgggtgaaatggttagactacttatggttccttcatgccttcagatattaattaggagactttaatgtgctaggctattagatctagtctaggtgagccaggtagatgtagtttctgcttttgtgacgctttagtggggaaaggcagacagctaagctatttgatcacattttactactccctgtgtgacaagggccaagcagaatttcagggtagcatgggagtatacctcagaatcatctaacctggtgacaggatagggcctgggcaggcttctcaaaatttttttttaaaacttaagacctgtaggatgcaaaatagcccagtaggaggtagaggaagacagttctagggaaagtgtgtgaataaaagcctataggtgagaagaggcatcacaaatctgaagaaatgggataactttaagaaagctgcagtagagtatgcttgaagatgaggcagaagagggaggttgagtccaaattatgaagaactttatcagcttttcgcaagccttttggatcttatcctaagagtaacaggaagctgttgaaggattttaagataatacagaattttgcaaacatgtttgcagcatccttttaaatgtaattactaatgtctgataaaatattgcatgtttttcaaaggtcacctagaaaagaactcatttatcagcacactaattggattaaatacttggaagtaaagtattatcttttaaaaatatcattgaaatgatgccttcttgcctcaatttcaagatcaggatagtctttttttccaaaaccatggtggctaattttaaaagtagaattgtatttacaatatttttagacttttttcactattgtttgagaaatattcttacctttttaaaaataggaaatataatgataaataaactattaaattttcattggcagaagaggtagaaagactggaaagagacctagaaaaaaagatgatagaaactgaagagcttaagagcaaacaaacaaggttccttgaggaaattaaaaatcaagataaattgaataaatcattaaaagaggaggccatgttacagaaacagagctgtgaggaactcaagagtgacttaaacacaaaaaatgaattggtaagttcatattttacattgctttggctgtattctcataagacagataattctttgcccttgggtctaaaaatacaacttcctgaccatataatggggaagatgtggtttaacagaaatatgtggaaaggcttatgaattgtagttgactgtgtgctagatgatatggcttcccaaaagactaatgctgtcttgagctgcattatgtactcctagatatttgtattttttaaaaacaacattgtaggtgaggctgttcattggcaaaaacatttagaaggcgatctggcaaaattatccaaaattttgtgagttataggtctttttggacatggaatccatcttttattactaagataaaatataatatctttatgctgattccctggtgcacgttactcagcccattgaaaaccttggcaaaatgtcagaccttaagactttccactatcccaaaactatgaactgtagttgcctagttttctcttttgcttatttataatgttattgatatgtttgtgctgtcaataaatgttttgtaaactgtcagaagtttttgctttttttttctatacctatttttgttagaagtcagactgtgctcttctctatgtcattatgttatttttatcattaaccatttaaaaacatgtttatgccaggcgccatcgctcatgcctttaatcccaacactttgggatgctgaggtgcaaggatcacttgaggtcagaaattcaacatcagcctgggcaacataatgagaccctgtctctacaaaaataaaaataaaataaaaacacatttatatacaaaattaatgtatgttcattgtaacaaatttagacaacacaactgtatttagcagaaatgaaagtccactcttccctaccccattccccagatattaatactttgttttccatgcttcttatacagtatacatgtaattacataatgtatatataattaagcatgttatacctttgaatatttttgtaatgaaaaaaggaatgttactgtatacagttattcctctgtatctgtgggggattggttccaggacacccccatggataccaaaatccatggatgctcaagtcctttatgtaaaatggtgtagtatttgcaagtgactttcgtacatcctctagtatactttaaaatcattgctagattacttataatacctaagacattgtcaatgctaataaatattatattgtttaggaaataataattaagaaaaaatatctgtacatgttcaatacagatgcaaccatccttttaaaaaaatatttttaatccgtggttggttgaatccacagatgcagaactcagatatggagagtagactgtatattattattcagcatcttaactttcacaaaacagcatacgtggacaactctccaagttaaaaaatatgtgtacatgcatgtataaagccttcttactctttttaaagtctatgttgtgttccattaaatgtattcttcataatttagttagcctattcctattgatggatatttaggttgctttcacaatttttgctattagagacagtactacagagaaaatctgtgtgtgtgtgtgtgtctatatataccttatgcattcatactagtatttctttagcataaaccactagaagtggaattaccgtgtaatttgcatttaaaattttgataagtgttaatgtacacttcaaaaagcttctaaccaatttatatttcagaagggaagaaaatacccaatttccaactaggtactattattttgaatttgtacatatggtagaaaaaaatggaatcttgttttaattttgaatttttatagttgttggacagttgagtattgcatatatatttattggctattttgtatttcctctttaaattgccagttcatattggttttgcctattatctgttagtcccaaggactattagatgcctaaaataattctgggtcttattctaagagcttatatttgaaaaacatttttattatcttttgcagaatatctaatgataatatcatctgtgattatgtgaagttttccattttaaaaaagtagttgcttgtgcattaggccaattaatgtataaaagaaaagtagcactgaagtaagtcttctggtggccatttaaaccgtagtagtcctgtcctgccaccaacaaatattaaccaaatttactctttgtccttttgcaaattatttaattcctgtgcttcagtttagttatatttaaaatgaggattatttacctgtcctgctagcctcacagaattgtgaggatttaatgagctaataatgaaaataatttgaaatgaatcaagctaagtaatggaaggtagtaaatctataactcagaatgacaataaaatacatccatgtaagaataatgccaatactaaaagccatgtcttcctatggtaagttgtcagtaaagagcaacttgtattattacagtttaactctccaagtgacggtatctgtttgcttcttcttttagcccttgtcttggtttcttgcaggcccttttctgctgattctttattcttccttaaaggtagttcttccaggcctgaactgtgtttttcagggtttgcatgataacttgcattaatatgcttgcttacattttaagttttgaaactggcttgtcttcttgggaaatgtggttgtgtgcgtatgtattatttttttttaatggatgtttatataggagagcaaatttgaatgtgggggaaagaattatttttctgattggtaaatatgttaccttcagtcaactcttgattatccaaagctaatactgtgactagcctactttccagttcatttgacatctattttgcttttattcatgcatttcttcaacagatatttattgagtgcttacaatatgctaagcctggggcttataaaagtcacaaaagtactttgaaatgcacagcctatttattattatttgcctgcagagaccagttcatgtattctctgtgattccagtcacatttgcctgttgtttgccactattgccaatgagttttgaggagagaacccaagattagttgacagtgttgattgtgagttgctttcttgagactcggagacttatgatcattcagtgaaaatatcaatgtgggtaatgtgctggacaccctgcagcagtacatcgaaggcagcatggaagaataggcagtattggatttgaaatcaggagacttggaattgaattctgcctcttccactaccagctgtgaaattgggcaagttatttaacttctctgtgcagcttttatcatcttattgggtggttgtgaagatttagtgcaataacatatgtaaaatgcttagcacaatgtctggcacacattgagtatttggctcaatgttacccattatctaggctattacttccattttgatggataatcaggaggtgactgtgagctaaatcatgcacgactttgatttcctgggccttgtaaaatgtttgtgtttgtttatgttttattctcttcagcttgcacttttatattaatgaaatttttctgcatgttttttctttgatatctaccatcagatactggccaaaaaaagacaaaaatcacttagtggatctttgaaataaactcaaagtttggtttagtagaaaggagctagtactagtagttagttaataaaatatttagtttctgacactgatctaatatgtaactttagacaagtcagttcatcaatctgagacttaatttctgtatttataaattcagagaattagattggatcatttgtcttctccaagctccaaaaatttctaagaataaaaagttatagtagaattactttattaaaattgaatattacatatttggatctggttgagcttattcacatcccttattctttattacaaagaataatattctgaacacttaatactacagcaacaacagtatgacaattaaaaccaagctcttcttttcatccttctcattcctctttatttctctgcagttaatgtcagttatcattttcccttgtaatttgaaactattgttaaagtcggaaagtcagtttaagaaattagtgctaattattggaaaatcaggaagcaggtatttattaggccagttacacaaaaataattgatacaaaaatattttcatgtttaacaaatttaagtgatttttaaaatcattattcattatatcgtgaagcagcagataaacttcaaaggtcttttacatgatctctgatgaaataataattttgtatttcattttttataatttagaagtaagataaaatgttctgagtgttgtgcagcttactgtgaagtttttaaacatatatgattataacttacgatgagaacttaccatatcatcacacctttatactaacttactgatcctgtatgttgtctcatatcaaattgggccaatagctaaaacagaagaccatagaattaacacgagcatgtcagaagcaatatgagctggaacaggaattggccttttataaaattgatgctaaatttgagccactaaattattatccatcagaggtgagttattttaattttttagtaatccaaagttaaagcccacatgggatggaatgggggagggcaggtggtgaggacatgtaagggatttgatcagatatcactccactttcttgttatgagaggattaaactgtattttggttcaatctatgacttatttggctccgggagttagaacagaatcctaaagaggtaaaaaacttcaaaagaatctttgcccatagccatatccattaccaaaagcagtcgtctaactcgcagctatctttcccaggtgtatgggttgatcagctcctttaaatccagacttctgggaaaagtgcttcagtaccatggaatagtcatccccttacatggtttgttcagtaattactgggttcagtattaatcaatcatgactggtacaaatgccataaatgtcactgcaagtgaggaaatgccaaacttctaagacccagtgattccaaccaatatcatatgatatttcatttttaaaaattcaattattaaaatatattatactgatggctacacaccatgtatctgaaaaaaatattagactgagattttatttatatgagccaagaaaccaaaataaaacacccatatttctaatttgagagatcaagcagtgctaaaaatcacataactgtaggcagttctttaatcaatcagtccaaactttcactcttctgtggtaagaggaagaattcttttgagaccatttttagttctaatttccttttttggtatattaagaagaagataaaagaataatatatatctttcagctcctaggcatgtagaatttatataaacttgagcaattctgtgatatgtttgccactaataaaatgaataatgtcatttgactgcttggagatcacttattaaaccataaatctattattttgcttttagtatgctgaaattgataaagccccagatgaaagcccttacattggcaaatccagatacaagagaaatatgtttgccacagagagttatattattgacagtgctcaggcagtacagatcaagaagatggagccagatgaacaacttagaaatgatcacatgaacttgagaggccacacaccactggacacgcaactggaagacaaagaaaaaaaaataagtgcaggttaaaaaaagttattttaaattctttaaaaaaaaatatgaaaacattgaatatgtaggccaattttgttttataagtcttttaattgaacatgttgatggtattgtttccatgaaaagtctaaaacaaaagtagtgattatcaagcagatttatcgagcatttattttgtaatgattcctgttatggttaagaatggagtttttggcagtaatttgatggcagcatgtccaggggattcaagaatgagtaaatcccctccttcaaataagcactggaactatatattcgaagtcacaattagtaataactgaagcaagtaaagaaccacttgattgattactatgcatgtagcaaaaacctaaagcaatgctttgtataagctgcaacagagcattctcctcaggcctgggccgaaggctagcctctgacttttcctgacatgccccatgccccacaatctaattcaagggatcttaataccttctggcaagtcacataaaggaataagtcaaggcagggggacactttagagaccctgccaatgacagactttgaatctatttacccactcagctgcatggatatggaagaaagagaactctgaccagggtttgtgcatccccccagcattatggcccactgtggtgctctcagtcagaccagcggcttatctttccttgactggtagctaagtggaaggcatggaaggcaaatagaggttgacttggtgaaggaagaaaagaaactgagttatttatgtctgcgtatactatatgcaaggctctgggggaaagcaaaaataaatcagatttttatgcagactagctttaaaggggctggctcatagttttataggacagagggagagagaaatcttaaatttgaggttgaaaataattgatttgagatcatcaacagctgggagagagagctcagtagtgaatttcttgatattgaattccatcataaagcatttgcctctaacacaaggttttatgggttatttttaatatcctgaacctaattataacttagtaacatgtaaagtgcatatttcccaataaaagtcttattctctcaaaagggtttactagtgttgggaatagcccctttcatgttgagaattttacaaataaaaggatcaattatagttctataccatataatgaaacagtttattctagagattaataaatagacaaaagcgatcataagtaattactttaaaatttttttgtgagatataatgacagtttaatagagcagggagaaggttattacaaagaaagaatacctggttgaaatttcagaattcaagatttttcttgtttcatattatgtgagcatggtttttaaatttgcagcacaaactcgactatcagaactgcatgatgaaatagaaaaggcagaacaacaaattttgagagctactgaagaatttaaacaactggaagaagctatacaactaaaaaaggtatgtaaaagcaaagcagcaatgctaagaggaaatgaaaaatgaaatgtgtttttcccttcataaccatataaaacaatttaaaaagcagttagctgcctagttaattatggaatgataaatttcagagtcaaatatggttctagaatttgccaattgtaattttcttccatttatgatgacatccaattagcattttataacatgtatagaaataaattacttaattttatgtaaaaaggtgtagtcttgagaagttgcttcctgatctatctcttctattttaattaagcactctccacctttaagatcctgggacttagattaagaaccaggagatatctctgctatagcatgaacattgtcatcaaacacaagccaaaaaaaaaaagagatatgtggtatacaaaaagattgatgtaacatattctcaaaaattaccaaagtgtgttgtaaagtaagcgagtaagcagctcaaatccatgatgtaattgcataggggcaaaaattcaagaaaaggaagttgcttgacattttagtttttaaatgggtaaaaaggttttagttatttgtaacttttaaaaatcagtatttaaaaattatgatggtaactacattcataccacagtaggtagaacaacaatgtgaagtccaaattgtagattcttttaaaagatacactgtattgttactttcagattttatactaactagaaattgactcaagtttattggaaccttactatatgtcagtcactgggctgggcgctgattaatgaacaaaatagacatgtgtccctctcatggacagacttgtgggggaaataaggcaataaacaaaaaggaaaaaaaatatttatttaaaaaaaaggaaagaagttaaaaagcatcagtgttgtaagaaaaaaatagaaaactaggggagatgttaaaagagatatactttagattgtggggattcacaaaggcctctctgaagaggtgacaggctaagatacaaaggatgagaaggagccagtgaggcagagctggcggaaagtattccatgcagaggtgacagtgtgcacaaaggccttcagactagagatttctctgcagaataagggagagtgtagaggaagataaagagtcttgaggttaaagatcatgccaggcttcataggcatttttttattttttatttttatttttttgagacagggccttgactcctgggctcaggtgattctcccaccttagcttccagaatagctgggactacaggcatgtgccatcactcccggctaattttttatatttttttgtagagatggagtctcaccatattgaccaggctggtcttgaactcttaggctcaagcgatctgcccgtcttggcctcctaaattgttcataagccatcttaagaagtttgaattttattttgcatgcaatgggaaatctttgaagggctttagatagttgagtggctgatcctatttgtcactttgccttacttcatgaagagtgaaatggactgagtgagatggaagggatgtgtgcatctgtatctgtcaggaggctgttgttcagtacaggcaagagatgatactagcaccaaccaggaaggtgctggtggatgtggagagaaagccagctgattccaggaaacactggacagtagaactgacaggacttaatgatgggttgaaagtaggagatgaggtagagggagctatcaagacggttttactaatttaaaaagaattttttataatagtactggccaaagctttacatagattgatagatgtaaataatgtacttaattttaaaagaaatagatacttccaaaatatgcttggaaaatagttatttaaatgagttaacattaacagttaataattaataataaagttaatagcctaaatttttgtttatactgttcacttacttgacatgctaacaaaggtaagcttcagctgggttctgattcagtgaaataaaaatctcaatttaataagagtttgctgtattttgaaattatttagtatgagatgattgtccagtgaacacggaattctaaaattttttcctgattataaaggtattgcagttatggggaattacataataatcgtccatattttatttcttttcagtcttttatcttcatcttttttacacttctatacagactcttgagaaatttttatatttgtttaaatctctatgctaaaaactgttagaaataagagatagagtattaagttattacttctatgtcaatactcaatttattggttgactatcttcatattaaaactaattaggtaactgtagcgtagtagtcagtgaaattgtctagagtcacacaaagtcttgcttccacaaactcctagtatgaccttgggcgagatatttaaattttccatgattcagtttctttatctataaaattgggataattatactttttactttatatgttttgaggattagattaaaggatataaagaggctgggcatggtggctcatgcctgtaatcccagcactttgggaggccgagacgggtggatcatgaggtcaggagattgagaccatcctggctaacatggtgaaaccccatctctactaaaaatacaaaaaattagctgggcgtggtagtgggcgcctatagtcccagctactcgggaggctgaggcaggagaatggcgtgaacccgggatgcagagcttgcggtgagccgagatcgcgccactgcactccaccctgggcgacagagcaagactccgtctcaaaaaaaaaaaaaagtatataaagagtttagaacagtgcatggcccatagtaagtgctatataaagttggctattattaatactatgtttattattaataatttacaagttgcctatactattatagaatgacagcttatttgtgcttgctattattagttttcataaacttttataaagtatgattttctacatataagcataaaaatataaaatatgcatggagtgcttagataactcccacatttcacttttatttttaaaaaactgatagaatatagaatacttattaaaattatagacattgtcttaataaatcagtgttgttcttctctgttaattatatattggggtttggggagattagatttcagaagcagggaaagaccttctttacaagcagttgagtggtagactacaacttgtaaataaattacgccaggaagctctggatctagaactgcagatggaaaagcaaaagcaggaaattgccggaaagcagaaggagattaaggacctgcaaatagccatagatagcctggattccaaagacccaaaacatgtgagtaaattaagaaattttgacttgttctgtctacatattacatgtctcatcattgttagcatcagagtccagagtcctttctgaaagtctgttttagtttgatgtacaaatttaagtgatatatacatacagtcagccctccatatccatgggttctgcatctgtggatttaaccaactgcagatcacatatattaggaaaaaaaaggatggttgtgtctgtactgaacatgtacagactttttttcatttgtcattattccctaaacaagacagtataacaactattcacatagcatttatactgtattaggtattataagtaatctagagatgattttaatatataagaggatgtccataggttaaatacaaatattatgctattttatagaagggacttgagcatcagtggatcttggtatctgcagggaatcctgggatgaatcccccatggatactgaaggaaaactgtacatatatgtgtgtatatataatgtatgtatgtgtatatatatgtgtattatacataaatatatgtgtgtgtgtgtgtgtgtgtgtgtgtatacacacacatatatggaatgtgtatgtctaaaacaaaacaacctagggcttgaagaaggtagctttcagtaaatgatggccgcatggtatatttatttttttttaagtggttgaatttcattgtattgcagagcaagggagatttgctccttacctttctctctccttgcctttttttcatctttctttctctctctctctctcttttttttttttttgctctgtcgccaggctggagtgcagtggcgcaatctccgctcactgcaacctccgcctcccaggttcaagcgattctcctgcctcagcctcccgagtagctgggactacaggcacccaccaccacgcctggctgatttttgtatttttagtagagacaaggtctcaccatgttggcgaggatggtcttgatctcctgaccttgtgatccacccacctcaacctcccaaagtgctgggattacaggcgtgagccaccatgccctgccgaagcgattctcctgcctcagcctcctgagtagctgggattacaggcgcgcaccaccacacccagctaatttttgtatttttggtagagatggggtttctccatgttgctcaggctggtctcaaactcctgacctcctgatctgcctaccttggcctcccaaagtgctgggattacagtcatgagccaccatgcccagcccttcatctttcttaagagcagaaaaagctgaagggggttgcgagtcctttttctacctcttctatttaatcctttttgcaaattttccactgaacgtatttgttttttcatactgttttgttttgtccttaaaaaaggaaacattctctggaatgtttcttcctgagatatggctagatatggtcaggtggctggatacagccaggctcttgtctctgtctctactctaagaagttgtactaattgcttatattttagctaatattcctaaaatacaaggaaaaatatcttctacatattctcctggtataccttgaataataggggttttttttttaaagaactttaagatctctggattaatagaaatcatagaatttaacatagtaaggatattgtaattgctttaagtacttgacaagttgtttaactgttcctttaagcattttagtacatatcatatatatttttttgtgggccagctaatttcaataaaggataaccttatgacagatataaggtcttttctaacaaaagcctaaaaattgaaaccaaggtattaatattgaaaccaaaagtagtcttgattattttaaataattttgaggaaaaatggggtattttaagtaatgtataatgtggtcaataatatcttactttattgcatatgtttgttcaatctcccacccatgtaaggtccctgaagacatgaactctatcctactggtatccgtatccccagggaccaaccagccctatgtttatgaatgcttgcattgtggaagggaggaaggaagcagcttatagatcctacccaaaactcctttgcttccccttccagttctgtgatctatgagtctaattagtagctggattatgtgtttgctttcaacaaatgactgttatatttctggcggacagagagttcaattcccactggatttctgtagagaattatacatggaaaggaggtaaatgagacatgggaatggcatccaagttttgaagttagctaaaatcaacctgtgcagtggggatgaaacatacaaaccagatttgaatttcctttttaattttattaaaattactaatagttcttaagtttgcagccttagtcctagcatcagaggacatctcttttaagtttatccagcgggaacatctttttctgattcacaaagtttcatattggctagtgtttggcatcccattttaggctacaaaatgtgagcctttaagcagaagagaaataatcaagagtgagatgcctgcatatttttctatagatataggtagacttttatttaattaatttttatgtaatcagatgaagtatctttctgaatagccaatagaatttaaaagtaaaagcttcactttgatgagatattatagaaagcaacatattaagtgcccacaatgtgtcatacattgtgctgtattttccatgttctggtgaggaacttttattaacatctatccatttttctttcaatttgcagaggatgaaaatgtgatatagaaatattaagtgaattgcccctaagttattgttttagaaagaggtggagcccttgcttatgctaccacaatgaccctctcttcacaaagcaattaaaggtctaaagagattattttaaaattagctcagaactaagcctaggcaggttttcagcaaatataagcatttaactaggtttcaaattcacagactattttagttataaaattattcatagaagcacaaattatcaccggagcaaacataatgaagatttgtattgcttttctctattgggaaatgtcctattggaagcaaaaggtaactgttcgctagagggaacgagctgtagtgatctgttgcaaagtttgggcgtgattggcccctgggagcttcctgtgttatgatttaactcgcggagggtggggcctgcccgcagaggctgctggtgattggatgggcggggccgccgctcactcttggccaagaatgtggtttgaggctctgcgaagttacagaggctcggaggcgcttgcaaaaatgtggctgtcagagagggaagtgcacatgaatttgaagacagcattagaaagcgttccgcccacagtttctctgttctcaacggctcagttttaacaggataaattttaagttaaggtatgatattttttctctctctgtacaaaggacttaaaaggaggaggagtcagagatgtaagttcctgtttttacaataactcttttgtgagctccaccgtggtgtaaatcgcagaatctacttttgttcccatgtatttaatgtacaccattggcatattgaaccagatttttatcctgcgtataaaggttttggtggaatttttaatggtgaattttaaagatttattgatatgagtgcagtcttttaagaaattatttcttgagccataaaaacccgaaatttacttagaatgtaagctgttatatgtagttaacttttcagaaagatttcaaatgggtattttgggagtgtagggaaaagagtttgcaaaataccataaagctttaccagtagtaaattaaaaaccttccagttaagctgccactcttttgttcatcagaaatgaagagacgtttctttcttgtatttggggtaagcaaatacataaaattgagtaatattcttttataatcacatgggtcttagacttgagatcattggtgttcatttttctgactgatacagttccctctttcgataactttctcttcatttattgttgtattcctctgatcctgtgggtaccaacttaagagtcatgaaggtgtgagtgggagggcaaaggttctctggggaattattttgtctccatatgaacagttgcctcaggagacatgcaagtcatttgatggatctgaaattcagttttctcatgtttaaaaggaagggttagactagatcattggctctcgatttgctttccctagcacacctgagaaatacaatccattcttttcagttaacagtagttccctgatgccatgacttcagggtgcgggagggtgtgtgggtgtgtgaaagctctgttttccaccatgggttaagtgtagttgtagaggggtatacctccttagggccctccattttgagactcaccgggctaagtggtctttgaggtccctgtcagctctcagtttattgaaaagccaaatgtttgtttgtgtaagagattgaaagtgaatttgaatttcaagtattttatctatttcatacctctattttcttctaagaaaccttttttaaaaagtagatttaatttttttattaaaaaggcattacttatctactataaaagttttttaaatataaaaatactcattacaaaaggaaaaaatccccatgtaatccttccacccaggtataattcttgttagcattttgggatatagtttttaagtctttttctatagatatatgccataaccaactaattttggaaaccttttttaaaagacacattttaggctgggcacggtggctcatgcctgtaatcccagcgatttgggaggccaaggccggcagatcacttgaggtcaggagttccagatcagcctggccaacatggtgaaactcccgtctgtactaaaaaaaacaacaaaaagtaaaaacaaacaacaacctgggtgtggtggcccgcacctgtagtcccaggtacttgggaggctgaggcaggagaattgcttgaacccaggaggcggaggttgcagtgagctgagatcgtgcctctgcactctagcctgggtgatggagtcagactccatctcaaaataaataaataaataaataaaaaagagagagagagacaatttaatgcaacgcaaataacactgacctacctagctgtgcccttggaaaaaccacttaacctctttgatcctcagttttctcacctgtaaagtggaaatgatttccgtatcaagttatcctgaaatttaaatgaaaactacccatgtgaaaacaatatagggcctgacacaaatagatgcaaattattatatttattttctattcttcctttaaaaatgttgttaagggttattacttttaaaggagtttaaggaacttggagttttgttgatttttttttttaattcagtcccatatgaaggctcaaaagagcggtaaagaacaacagcttgacattatgaacaagcagtaccaacaacttgaaagtcgtttggatgagatactttctagaattgctaaggaaacggaagagattaaggaccttgaagaacagcttactgaaggtaagactttcagtatgatttaaggtaaatcagtgttattgctggtaaaagaaacattataaagacaagcattaatccagatagtagctaaatacagttcacctattagtactagtatttgatagggaaatatttacaggatacccaaaagtagttaatgcaattttaagagttttgtttttgttttgttttgtggcattgatgcctagtgagtcaggtcattccagtcagtaggccagaagtcaatacgtgatcatgataagctctggcatgtgattgtctatgacataaaatccattcaggagcaaagcacccattggcatcagggaattcagtgtctggttataagaagaaagagttttaggatctagttttgcaatgctgatttaaactgcgacatatccataatagtggaaaaggaagacaataggccatagtggtttttacacatagggctcagtgtaaaaagatcctgctctctgttttgctactgtcagctgtgtcgccttggacaagttgtttttatctcaatcattagttgttgggagaattaaatgagctagtattcataggccaggagtggtggctcacgcctgtaatcctagcactttgggaggctgaggcgggcatatcatttgagcccaggagttcgagatcagcatgggcaacatggcgaaaccccgtctctacaaaaaaaaaaaaaaaaaattagccaggcgtagtggtatgtgtgcttgtggcaccatctgcttgggagactgagggtggaggatcacctgagctcagggaggttgaggctacagtgaaccgtgattgtgccactgcactccagcctaggtgacagagtgaaactttgtctgaaaaaaaaaaaaaaagagagagatagtgttcataaagttcctggcacatagtgcgtatccagtactgtacatgggatgtgtgtgtttgtgttctaagtgtttaggttacacatttatgttgccagtcttggattcatcttatatactaggtggtcttgttctttgtatttagcagcaagaactcacagttttggtacatattttttattttatttgtaaattaaactttttttttttttttgagacggagcctcgctctgtcacccaggctggagtgcagtggcgtgatcttggctcactgcaacctctgcctcctgggttcaagtgatcctcctgcctcagcctcgtgagtagcagggactacaggcacatgcccggctaattttttgtatttttaatagagacggggtttcactgtgttagccaggatggtctcgatctcctgacctcatgatccgcctgccttggcctcccaaagtgctgggattacaggcttgaaccaccacacccggccgaaattaaactttttacagcatgaatcaggcattttataagcattgccccctaaatgtactatttttattttatacctgcttaatactcctttgctatctataataggaagaaaatttaacattatgttttgaaaaagaaaaatgataggaaagaattgaaagcttagaatttcactcttggcttataacaaaatgctgagcagacaatgcagtactttaaaaagatatattattaccctttttgcatcttgcttaggccagatagcagcaaatgaagccctgaagaaggatttagaaggtgttatcagtgggttgcaagaatacctggggaccattaaaggccaggcaactcaggcccagaatgagtgcaggaagctgcgggatgagaaagagacattgttgcagagattgacagaagtcgagcaggagagagaccagctggaaatagttgccatggatgcagaaaatatgaggaaggtatgatttttttcctgcctattttccgtagcttcataagtagataatgtccaaattaagttagttggaggaggtaacagtacatttttaagtgggaaaaagtattagtggctatatggtgatttttttcttttaacagttgggcttttttttttcttctttagctgtgatacatttggaattattattttttctttgctcagaaaaggaagattatttaagctgcatttctatccctgaaaggtattgttgccaaataactctaaagaatatgaaatggtagctattacaaatattgtattaaatgctcatattttatttgtgctgaaaaattgagcacagaatggtttttcttagtcttgttgttactggataattttaacattattttatagctaacaaaacagacatattgttttaaattatatccttatgaacctgatttgttgcacattcgtttggagatttcccttgctctattttagttgtttggaaaatgttatcatacatgagaactagagatttccaaacttcttgttcagtagagctggctccagaaattgaattaatatattttaatattatgaaatatctcaggcatatttaaaaaatcacaaataatatttaacatcatgtactgacaacccagcttaagaaataaaacattataggtacatttgaaatcctctgtctactcctttccagaagtaacaaagttctgaatatggttattatttccctgcacctctattcttttattatatatgtaaacatccataagcaatatatagtattttccttgattttaagacttatacaaaatgtatcatagtgtacatatttggccactttctttcttccttcatgtttatgtttttgtttgtttgttttggtttttttttgagatgaattttcgctcttgttgcccaggctggagtgcagtggcgcaatctcggctcactgcatcctccgcctcctgggttgaagcgattctcctgcctcagcctcccgagtagctgggagtacaggcattcaccacctgcccggctaattttgtatttttagtagagatggggtttctccatgttggtcaggctggtctcgaactcccgacctcaggtgatccgcctgccttggcctctgaaagtgctcggattacaggtgtgagccacagcgcctggcctatgttttcgagaattatgcacactgatagatgtagttctactttgttcatttttactgatatatgtaccatcctgctttatggacataccacaaatttattatttattccttctctttttggggtgcatttaggtgatttccagtgttatgctattgcaaacaatgctgagcataacattcctgcacacatcttgaacacatggggactatgctcagaagcagaactgtgggtcagagtatgtccatccttcattaagttcagtagatattgtcaaattacttttcatagtgagtttatcagcttctactcccaccagcaatgtgggggctaccattcttgccacatccttgccaacgctgtagtgttgtccaacttttttttaaagcttatattttgaaataactccaaacttgcaggaaagttgcaagaggaatacaaataactcacatttgcctttcaccgagagtcaccaattactattttaacacatttgctttatctcctcatatgtaatttctacatgattttatatactttttaattattattatactttaagttctagggtacatgcagatttgttacataggtatacatgtttcacgttggtttgctgcacccattaactcgtcatttacattaggtatatctcctaatgctatccctcccccctccccccaccccacgacaggccccggtgtgtgatgttccctgccctgtgtccaagtgttctcattattcagttcctacctatgagtgagaacatgcggtgtttggttttctgtccttgtgatagtttgcaaagaatgatggtttccagctgcatccatgtccctgcaaaggacatgaactcatccttttttatggctgcatagtattccatggtttatatgtgctgcattttcttaatccagtctatcgttgatggacatttgggttggttccaagtttttgctattatgaatagtgccgcaataaacacatgtgtgcatgtgtctttatagtagcatgatttataatcctttgggtatatacccagtaatgggatcgctgggtcaaatggtatttctagttctagatccttgaggaatcgccacattgtcttccacaaaggttgaactagtttacactcccaccaacagtgtaaaagcattcctgtttctccacatcctctccagcatctgttgtttcctgactttttaatgatcaccattctaactggtgtgaaatggtatctcattgtggttttgatttgcatttctctgatggccagtgatgatgagcattttttcatgtgtctgttggctgcataaatgtcttcttttgagaaatgtctattcgtatcctttgccccctttttgatggggttgtttttttcttgtaaatttgtttaagttctttgtagattctggatattagccctttgtcagatgagcagattgcaaaaattttctcccattctgtaggttgcctgttcactctgatggtagtttcttttgctgtgcagaagctctttggtttaattagatcccatttgtctattttggcttttgttgccattgcttttggtgttttagtcatgaagtccttgcccatgcctatgtcctgaatagtattgcctaggttttcttctaggatttttatggttttaggtctaacatgtaagtctttaatctatcttgaattaatttttgtataaggtgtaaggaagagatccagtttcagctttctacatatggctagccagttttcccagcaccatttattagtgatcctttccccatttcttgtttttgtcaggtttgtcaaagatcagatggttgtagatgtgtggtgttatttatttctgcagtctctgttctgttccattggtctatatatctgttttggtaccagtaccatgttgttttgtttactgtagccttgtagtatagtttaaagtcaggtagcgtgatgcctccagctttgttctttttgcttaggattgtcttggcaatgcaggctcttttttggttccatatgaactttaaagtagttttttcgaactctgtgaagaaagtcattggtagcttgatgggaatggcattgaatctataaattaccttgggcagtatggccattttcacggtattgattcttcctacccatgagcatggaatgttcttccatttgtttgtgtcctcttttattttgttgagctgtggtttgtagttcttgaagacgtccttcacatcccttgtaagttggattcctaggtattttactctctttgtagcaattgtgaatgggagttcactcacgatttggctctctgtctattattggtgtataggaatgcatgtgatttttgcacattgatttttgtatcctgagactttgctgaagttgcatatcagcttaaggagattttggctgagacgatggggttttctaaatatacaatcatgtcatctgcaaactgagacaatttgacttcctcttttcctaattgaataccctttatttctttctcttttctgattgccctggccggaacttccaacactatgttgaataggagtggtgagagagggcatccctgtcttgtgccagttttcaaagggaatgcttccagtttttgcccattcagtatgatattggctgtgggtttgtcataaatagctcttattattttgagatacgtgccatcaatacctagtttattgacagtttttagcatgaagggcaattgaagtttgttgaaggccttttctgcatctattgagatatcatgtggtttttgtcattagttctgtttatgtgatggattatgtttattgatttgtgtatgttgaaccagccttgcatcccagggatgaagccgacttgatcgtggtggataagctttttgatgtgctgctggattcggtttgccagtattttattgaggattttcacatcgatattcatcagggatattggtctaaaattctctttttttgttgtgtctctgccaggctttggtatcaggatgatgctggcctcataaaatgagttaggattccctctttttctattcattggaagagtttcagaaggaatggtaccagctcctctttgtacctctggtagaattcagctgtgaatccatctggtcctggagtttttttggttggtaggctattaattattgcctcaatttcagatcctgttattggtctattcagagattcaacttcttcctggtttagtcttgggagggtgtatgtgtccaggaatttatccatttcttctagattttctagtttatttgcataaaggtgtttatagtattctctgatggtagtttgtatctctgtgggattggtggtgataccctctttatcattttttattgcatctatttgattctaccctcttttcttctttgttagtcttgctagcggtctatctattttgttgatcttttcaaaaaaccagctcctggattcactgattcttttgaagggttttttgtgtctctatcccctttagtttggctctgatcttagttgtttcttgccttctgctagcttttgaatgtgtttgctcttgcttctctagttcttttagttgtgttgttagggtattgattttagatctttcctgctttctcttgtgggcatttagtgctatacatttccctttacacactgctttaaatgtgtcctagagattctggtatgttgtgtctttgttctcattggtttcaaagaacatctttatttctgccttcatttcattgtgtatccagtagtcattaggagcaggtcgtttagtttccatgtggttgagtggttttgagtgagtttcttaatcctgagttctaatttgattgcactgtggtctgagagacagtttgttgtgatttctgttcttttacattttttgaggagtgctttacttccaactatgtggtcaattttggaataagtgagatgtggtgctgagaagaatgtatattctgttgatttggggtggagaattctgtagatatctattaggtctgcttggtgcagagctgagttcaattcctggatatccttgttaaccttctgtcttgttgatctgtctaatattgacagtggggtgttaaagtctcccattattattgtgtaggagtctaagtctctttgtaggtctctaaggacttgctttatgaatctgggttctcctgtattgggtgcatatatgtttaggatagtcagcccttcttgttgaattgatcccttcaccattatgtaatacccttctttgtcgcttttgatctttgttggtttaaagtctgttttatcagagactaggattgcaggccctgcttttttttgctttccatttgcttggtagatcttcctccattcctttattttgaacctatgtgtgtctctgcacatgagatgggtctcctgaatatagcacactgatgggtcttgactctttatccaatttgccagtctgtgtcttttaattgggggcatttagcccatttacatttaaggttaatattgttatgtgtggatttgatcctgttgttatgatgctagctggttattttgtccgttagttgatgcagtttcttcctggcattgatggtctttacaatttggcatgtttttgcagtggctggtacgggttgttcctttccatgtttagtgcttccttcaggagctcttgtaaggcaggcctggtggtgacaaaatctctcagcatttgcttgtctgtaaaggattttatttctccttcactcatgaagcttagtttggttgaatatgagattctgggttgaaaattattttcttttaagaatgttgaatattggcctctactctcttctggcttgtagagtttctgagagatctgctgttagtctgatgggcttccctttgtgggtaacccagcctttctctctggctgcccttacattttttccttcatgtcaaccttagggaatctgacaattatgtgtcttggagttgctcttctcgaggagtatctttgtggtgttctctgtatttcctgaatttgaatgttggcctgccttgctaggttagggaagttctcctggataatatcctgaagagtgttttccaacttagttccattctccctgtcacttttcaggtacaccattcaaacgtagatttggtcttttcacatagtcccatatttcttggaggctttgttcatttctttttactcttttttctctaaacttctcttcttgctttatttcgttaatttgatcttcagtcactgataccctttcttccacttgatcaaattggctactgaagcttgtgcatgtgttacgtagttctcatgccatggttttcagctccatcaggtcatttaaggtcttctctacactctttattctaattagccattcgtctaatcttttttcaaggtttttagcttcctttcaatgggttcaaacatcgtcctttagcttgaagaagtttgttattactgaccttctgaagcctacttctgtcagctcatcagagtcattctccatccagctttgttctgttgctggtgagaagctgccatcctttggaggagaagaggcgctcggtttttagaattttcagcttttctgctgtggtttctccccatctttgtggttttatctacctttggcctttggtctttggtctacctccagatggggttttggtgtggatgtcctttttgttgatgttaaggctattcctttctgtttgttagttttccttctaacagtcaggtccctcagctgctggtctgttggagtttgctagaggtccactccagaccctgtttgcctcggtatcacaagtagaggctgcagaacagcaaatattgctgcctaatccttcctctggaagcttcttcccagaggggcacccgcctgtatgatgtgtcagttggcccctactgggaggtgtctcccagttaggctacacgggggtcagggacccacttgaggaggcagtctgtccgttctctgagctcaaacactgtgctgggagaaccactgctctcttcagagctgtcctacagggacgtttgagtctgcagaagtttctgctgccttttgttcagctatgccctgctcctaaaggtggagtctacatgtagaggcagaggtcttgctgagctgcggtgggctccgcccagttcgagcttcctggctgctgtgtttacctactcaagcctcagcaatggtgaacgcccctccccctgccaggctgctgcctccaaggtctatctcagactgctacactagcagtgagcaaggctctgtgagcatgggacctgctgagccaggtgtgggatatgatctcctggtgtgctgtttgctaagaccattggaaaagcacagtatttgggtgagagtgtcctgtttttccaggtactgtcttctgtgaatgtacggcttcccttggctaggaaagggaaatcccccgacgccttgcatttcctgggtgaggcgatgccctgccctgcttcgggtcgccctccatgggctgcacccactgtccaatcagtgccaatgagataaaccaggtacctcagttggaaatgcagaaatcacccgtcgtctgcgtcgatcacgctgggagctgcagaccaagctgttcctatttggccatctcggaacgggattcaattttatatatatttttatacagattttttttcctgaaccatttggaaatcagttgtagacatcatgctcctttgcttctaaatatttcagtatgtatttcctatgaacaaggacattttctaacataaacacagaataattatcaaatttaggaaattcagtattttatcagacttcatgtttgccagtctgctgagctttaaaggacttctttccatctttctattgtgaagatgtttacagttacaagaaagttgaacaaatagtttggtgaacatctgtgaacctcttggattcaataaatattttgatttatttattttctctttctcatagacacatacttttttcctttgctcattagaaagttgtagatatcataacatcatcccttcaacacacatttttttaagagcattttcctgcatcactacgatatcattattacacctaagaaaaatgacggtaattccctaatgtcctctaatatcattattatttttttttttttttgagatggagtcttgctctgtcaccaggctgggaatgcagtggcatgatcttcgctcactgcaacctccgcctcccaggttcaagtgattccgctgcctcagcctcctaagtagctgggactacaggcgtgtgccaccacgcctggctaatttttttgtgtgtgtgttttggtagagataggtttcaccatgttggccaggatggtctcaatctcctgacttcgtgatccacccgccttggcctcccaaagtgctgggattacaggcatgagccactgtacccggccctaaggtcctctaatatctgaaccatattcagattttcttgattgtcccaagaatgtgtgtgtgtgtgcacatgcgtgtgtgaaatccaggctggtattctgtagattgaaccacgttctgggtttgactgattgtttcctcatggtgtgtttaacttgtatctctatgttctatgtaaaatagtatcttaagttaactgcattttcccctggttactggagaggctgatcacctttcatttgctgttcaagtttcctcttgagtgaattccctattctattttttgttgaactgtctctgccttttcttaaagatttgtaggaattctttacatattctggataataatctttggttggttatatgtagtatctatattttaaacaagcagcccaaatgattgaattgccaagtggtttttggacaattcttttgtagaagttctcatcgtagaatcctcctctttaatctgtaatagtttgatcccaagtaaatagatgaaagagataaggtttaatcacaaaacacaaatggactaaaatgaatcagaaccatggtatgctaataaatatgtacttatattcttgttagcactcatttaaggtactcttatcatccttaatattagagagtgccggtcccattttgttcttctgataaatgaacatgctatggtttaatagagagagtatgggctttggagtcggagatctacatttgtatgctgactatcctttttctagctacatagccctgtgcaatttacttagatattcattctacaattcctcatctgtaaaaccgcaagttgccttatacagttattgtgaagatacaatgaaataatgaatatgaaaacattttgtccaacatcagatgaaaaataagcattaaatcttatcctactctttttttccttcctttcttcctccttatgtttttagactcataagtatcacagaactggtccctttgaaaaacaatatgttgggagcttactgactttcttgattacatttagccagggttttgttttccaaccaggatatgcacaacctgaggcttcgtcatattgctactgaaaactttgtggcaggcatcagtagctggccagcatttggtttacagtgctcaagttacttataatgccttgcaaatgcttaagcagcacagtgagggttccatagttaaacccactgaatctttctaggagcttgcagagctagaaagtgccctccaagagcagcatgaggtgaatgcatctttgcagcagacccagggagatctcagtgcctatgaagctgagctagaggctcggctaaacctaagggatgctgaagccaaccagctcaaggaagagttggaaaaagtaacaagacttacccaggtaagtaggagcatgaagccaactgcaaactaaggaccctgtgccttaagatatcatccttcttttatttatgtcttaatttaaaattaagcgttttttcatacaatatatatggagtgatgggaaaggcagaattttggagtcagacattgtgagtgctaataactacccctgtgtgaacacgggcaaatcagttcatagctctgagcctcccagccttttcctcctgtgtaaaatggcttatggggaagataaatgagataatggacatgaaagcacctgacagttgatactcaataaatgctagtttttccttcttagaacaggtttaaggacttttttttttgagacagagtcttgctctgttgctaggctggagtacagtggcatgatgacggctcactgcaacctccgcctcctgggttcaagtgattttcctgcctcagcctcctgagtagctgggactacaggtgcgcgccaccatgcctggccaattttttgtatgttagtagagatggggtttcaccatgttggtcaggctggtctacaaactcccgacctcaggcgatccacccacctcagcctcccaaagtgctgggattacaggcatgggccaccgtgcctggccgagacctcttttaggttgatgataagttgtagtttgctgtctccttttagggttggttgaaagatccactagtttaaattatacttgcaagttacagaaaacatatccaataaatatttattgattggccattgagggccaggtactgtggattctctagggaaagcacagacatggtcaccatcctgtggagctgacagatctctgattggtaaactttagtccagcaagtgaaacaggtatggaagaaagaaagggacaggattctttggccaaggaggaagtagtcagggaagaccaccctacagaaatgatgtttcagctgatggctgatggatgagtaggatttggccacgcagaggggacagggtgaaaggagtaaaggtaaggtatttgtattctaggcagagaggtgaggagagagagcatatagtacatttgaagtgctgaacgtatgcctccaggatgccaggagcagggagaggagtgaggaaagagaatgagaggtaaaggcagagaggcaggcagaggccagttgtaatatattctttatcagattaaaaatacaatttattagccagatgagctgcatcttctttcaggaagcccacctcaacctttcctttctgcctgctgaaaatctgggttcaggactctactttggttttcctataacctgtgcacagtaaaggtatttatcatgcatatgatgatcatctgtttagatgctcctagatgatctgtttgttttaccccagctagactcagagctcagtgaatgcccaaattgtatctgtttgtttctgctttttctgtgcctggcatatgagaagcgtcaatatgtgcctatttgatgaaaatgaaataaataagatattttgaatctcaggaatgcatgtaaaaataattcatatggttagaaaaggaactagaaatatatctggtttattatagtaattatgtatatttctttacttatgagatatcagatcatcacttgacagttgtcaggattgtatttctcgagtaccgagttttgtagaagtatagttgacaagatcagagtctcagaaatcaggaggttttaggaaaacaattaaaataacagtaaatattttaaaataataataaataaaatttctagatggcattttccttaataaattctcctcttttcaagccagactgtactagcttgaaatacactgtcctttgtactttgattggcttttattttcttctcataagtcttgacaaaattattttaagagcctggccttttcaccaattcacttggtattgaaagggacattccccctccctcagcaccaagactgccaggattggtcttcaaaccacacattgagaatatgaagcataacagatctcctgtctctgatctgaagatctacagatctctgattggtaaactttagttgcatgaactcacttgtgatgcttgataaatacagattccttggccccacccactctagagattctgatccagaatctcttttctgagatagagtttaggtgtctgcatttttaacagacatacctagtgttgatacagtttttttgaggaccacagtttgagaaatactagtctaagggaaaggagagcaataattgttggatcacttgcagaacttttaaaggtaggtgcctcggcccacccctgaagattctgatttggtgtatttgggctgagctgattctgatgcttactccttcttaagtgttaataatagtttaaggattgtgtgaaaaaattatctttggtttttaaatttgggagtacaaacataaaattgagttgtaaaactatagctagcaagggattgtgtgtatatgtaaatttatttgtgccttttaaaatcataaattattgctgttttacactttcatgtcattgcttcctatggtgacagttagaacaatcagcccttcaagcagaacttgagaaggaaaggcaagccctcaagaatgcccttggaaaagcccagttctcagaagaaaaggagcaagagaacagtgagctccatgcaaaacttaaacacttgcaggtagagatttgttgttttagaatacattcttacacagaacacccaaagatgatgatatctttagtcaggcacttagcaacctgctctaacatgtagtaagcaatttgaattactagaaaaaagggaattctgggtggagcagcaccatagctcctgttctcttgtgaccattgttttaagattattatttgtgaatctccttttgtttttatgatggtgcaaagagatagaggcagtgtcagtagtaaacaatatactgtgtaaactcatgggcaaaagcagtatcttgcttttcttctaaaagcagatttgtcaccagaccaaactaaaaggatcagattggtgcatcctcttccactgaaatgtctttgtaattatccaggaatttaactagagtgagttgcagtgggatttcttatctgtaaatagttttcactaccctcttctcggaaaggatgctattaaaaatgtcatcattttttatttgtgggaatgtatgtcaatatttttatagctgttctcacagtaatctgctgaacaaactgcaggaaaaacaggtggataggatttttcagataattaaactctcgaagaagacagatgtctgaacaaacaagtacctgaatcatcactcagttctccaaatctgtgaggttgcgggcctcttggctggctgagatggtagctgttatcaccagaaataaaagggcagagtttatgtggcttggaggaagggttccaaaaaaaactacgtagggggatttgagagaaataagactaaactcacccaaatgttctcttcttctaacacttcaaatatttgttccttgaagtttaaagaaatctaataacctggaatttaatttttactgctctcagttccacttctgaagcaaatatcataaaagatatacatgttttccattactatgtgaggtgtgtgtgtatgttgggtcttacttgagttatcattttccatttttagtatagaaatttgcatataacacaaaaacagaatagcttatgacccttatttacccattgcccaacctaaacagttgtcaacattcattgtttcattttgtccacctcttttgttgctggaatattttaaagaaaaatttcatacatctttctttcacctgcaaatacttaagtgtacatctcttgcagaaaaggactaatataatattcttcagggggcttctccaaagtagaaagtgaagtcaactttctagaatgctgacacgtgttgtgggactaccttagttagaactagattctttgattacttggccaactaacctcctgagtacaagttaaacccactctacatgtctttgtcagaaatcatttagttgcaatgaaccaaaacctactcacactagctcaagaaaggagacagcttgctaggaaccagagctgctctgcctttcatgttgatataggggctctctcatttctctttttccatctctccgagcattgtatgtggcccagcatagaccccagccctgatttaacatattttcaggtccagcatttatataggcttgctgtactgaatcttgcttcaaattatggagagaatgagaacctattttctggctagttgatgtgttgactggcctctagtcagatgatctatggccaggattagatagtactacagaaagggctgccttggggcaatgggcatggacagtttacagataaagaggactccagatggaacaggcacttgaaaacatgttaattgcattctaaattcttcatttcagttaacattgttacactgagtttgaagtagattaatcatacggaaattttagaaatttctttttacttgaaagaggcattgtctgaatttagttctgtggtctagatatgtttgttagttcgttagtagtgaaaatatgctggcatgtaatagataatccctatttcatccccctccataggatgacaataatctgttaaaacagcaacttaaagatttccagaatcaccttaaccatgtggttgatggtttggttcgtccagaagaagtggcagctcgtgtggatgagctaagaagaaaactgaaattaggaactggggaaatgaagtaaggaaaaagcaagacctccaagtctagagtgggcctcacaacttgagagttgtgagtgtgaggttcaatgataaactcacctttctaagttctgttaatggcaaatttcttttgtaaggttctccttatgaagttttcatgactgagacaaaagattgtttaatttatttgtctgccactgattgtttttacattttggatcttttttttggtatttaagagtaatatttggtatttaagagttattgtttcttgaaagttaattatatatggtcaggaagtagagccacattatacattttaaatagagaagaaacatcaaaagaaaacataattatttcaaatatatgaaatggacatttattcttggagcaaatattgttagcctgatatgagcctatgttttcagagtggcagcagtcatttgataaagcaataatttgcgcttaggagatggtcagtaaattgctatagattgacaccagtccctgcacacagctttttactctggagctaaagttaatagcatgtttgcagccagcatcaaaaattaaatgtcacatttataccatttttccccctccttactagcatccatagtccttcagatgtcttagggaaaagtcttgctgatttacagaaacaattcagtgaaattcttgcacgctccaagtgggaaagagatgaagcacaagttagagagagaaaactccaagaagaaatggctctgcagcaagagaaactggcaactggacaagaagagttcaggcaggcctgtgagagagccctggaagcaagagtaagacaagggcaagaggcacctggagggaagtgtttggcaaatattaatgtttttcagcaaattacaatgcttcctttgtcatgtaaatacaacataattgttgttattttcacttataacaagtcaagctgggtgtgactaaaactcaaccctgaatgtggttataatgtcaaagtcaggcttgtttgtgacattgtgttttccttgatttagaagcaaaggcaagttattttataacaggcaggtaaataatgccacattcctagagtatggtgtgttgccagaatctggtattttttgatgtgatgattttaatgaagaggcaaacattccaatgactcctagagatcgttcaagataaaaccattcctgacaactcattagtaaaaaattaagttacagcctgttgtaaaatgggtgataattctataaaaagtttttattttgcttaaaacatattttgcctaaaaatcattcttgaaattgtatttcttcacagatgaattttgataagaggcaacatgaagcaagaatccagcaaatggagaatgaaattcactatttgcaagaaaatctaaaaagtatggaggaaatccaaggccttacagatctccaacttcaggaagctgatgaagagaaggagagaattctggcccaactccgagagttagagaaaaaggtaggggagacttagaaaatgagacacataagtacctgctgccagtgtcctgcccactggcaactaggtcagctgagatgggtgtgatctgtagtcacctctggctgcattgctggcacagtgctgaacctgacctaggtgggacctggatgcatgtcattgaatcaagaagctaagaccatgtgttgtggtagatggaaacgagaattgagaatgtaaggagtgactttcaagttaattaggtggtacttaacaaatgatattgggaggagtttgactcctttgaaacctcttgtccagttggatacatccatgggaaattacttttaaactcctcatcatcctttctaatacccctgcctctctttaatggcttttctccattccacctcaaccatctactcccattgtcacattctggactttgtcaagtttaaaaattgcacccacctctgaaatcacaaactgaagtgtcttgctctgatcataaccgcttatcttgctggtatccacacacttaaaatttgtcagccttattgagcttccagttcattagcctcacccccacctttgctatctgttaagcccttgtctttactttcttacttgtccaacttaaattttgtggtctaccaactataacttttttttttttaacaaatatcctcaagttccttgcccttttctactgttttatttccctgacaaaactgaagctctctgctttctttgggccagcacttccactggttgttcctggagaaaaaagtcaccatccagtattgtggtgtcattataaactcatagttaccaatctcaaatagacaatatgacccttttctgtggtgagcttcctctcccatgcctcactgtttcacaccttctcattcctcacacctgctgtctgctttctcccagcctcagtgaatgccttgcttcatccttccctgagaactcttcagtttccaagtcctattgaatccatctctaaaatgtatctggaatatatgtcctttttccttctctgatgctagacccttgtgctgtcatcatctctcttctggatgactactgtggctgtctgatcgatctgtcacttctactcatgaccctgctccccagagcagccaagatgctctttctgaaatgtcaagtggctgtaatcagtctcccctcctgtagcttcctttgttcttaggagtaagaccaaaattcttaagcctacgaggcctacatgatttgcctctgtttagatctctccatttctcactgtgctcctcctatcattttctcaaaaatgccaaattcttgtgccaccatcctatgcccagggcctgattcagtgatttcaaaggcaggttcatccatgccgtggtggtagtgctaggaaatgtttttccaatgaatggatgaagttatgaccactaagattcttgactaagaagacctagtacaagtttctcacagttttgagatctattatttattcattggatatatgtggagtacctcctgtgtatcaagtattgttctaggcagcagtgaacagagtccctaccctcctggagcttacatctgaattcattcctgccaaatgattcatctgtttaattaatatttcttttattttagaagaaacttgaagatgccaaatctcaggagcaagtttttggtttagataaagaactgaagaaactaaagaaagccgtggccacctctgataagctagccacagctgagctcaccattgccaaagaccagctgaagtcccttcatggaactgttatgaaaattaaccaggagcgagcagaggtgagttcacatgtacagaacaggtttccatcaatgatgctgctgtcaaaaaacatggcaacttgtattattgatcttgctatagacattggttattttataaaccactgtaaagttgtctgtttttcttaagacctaaagattatattccccccatcacaacccccaataatttattttgtgctgccatggatactgcgttctactgagccctgaaaggaatcatcaaataaacatgctatccctacctttaagtgtaaggatgcttagggaggtagctgtcaatatctacctggacaagggttcctgaaggattgttatataatccctctgaatctcaaatttttcatctcgtgcagtcatgtgaaaatgttacttcatagtatgactccttactgagctaatgtctgttactgtgctttataggatgcaaatgctaatgagattaagatagcagatcataggagacaaaaatctaatgatgagagcccagagagacataatcatggaagacggtagtaaaagtaaaaaagtaaaaaaattagcctttgttctttctgatgccgcaccttggggttgggagctgggcaggctgcccaacaatgggaacaacacaggagaaggtggggcttggatgtcccttttcatggacagcctggtaggcaatgtgatgaaagcagaagaatcaatccaagaggaagaaatgaagaagacaacctgtgatagcagtggtgcctttctcatacttctgtcccagtaggagttgcaggaagcagagaggttcagcagaaaggcagcacaagcagccagagatctcacccgagcagaagctgagatcgaactcctgcagaatctcctcaggcagaagggggagcaggtcagtgttggtacccagagacctcctctttctcagattcttatcagttcctaaaagacaaaattactgtaggtgatgtctcaaagaattctgaagtgcaatcaatagttaataagtactttatcctctactgtgtgccaggcttggtgcagtttccaagtaatgcagtttcctcactgggaaagtgtaaataaatatagaatcataatcaagttgaaaggataaatgtgtttgggaaagaatgaattcattggcaactttgtatgtgtaatttttttaaatagtttcgacttgagatggagaaaacaggtgtaggtactggagcaaactcacaggtcctagaaattgagaaactgaatgagacaatggaacgacaaaggacagagattgcaaggctgcagaatgtactagacctcactggaagtggtaaagtattgggctttgatttttggcagtggttttgtagtcataaaattaaatcatctcatttgttttttacctttaactgttacaaatcaagtccatgcttgattcagagagctgtggtaattagcttaataagtaaaataaaataaatcagataattttaagagtattttctgtaagtgtgttactgggggacttggttgccaagataagagtttcgtatttgtgggcgagcacagtggctcatgcctgtgatcatagcactttgggaggctgaggtgggtggatcgcttgaggtcaggagttcgagaccagcctggccaacatggtgacaccctgtctctactaaaaaatacaaaaattagctgggcatggaggtgggcacctgtaaacccagctactcgggaaggtgaggcaggagaatcacttgaacctgggaggcagaggttggcagtgagccgagattgggccgctgcactccagactggatgacggagtgagactctgtctcaaaaaaagaaaaaaagagttttgtatttgtaatttcaaaataaataatgtttacaaatcagtttgcctttttttgacttaccaaagggcagactgaaagtcagctttgaggaactgataaaattaattggctctcttagaatctcttttatattttgagaaaggaagtaagtgatttcatatcaatttcatagaatgacttttctttacagacaacaaaggaggctttgaaaatgttttagaagaaattgctgaacttcgacgtgaagtttcttatcagaatgattacataagcagcatggcagatcctttcaaaagacgaggctattggtactttatgccaccaccaccatcatcaaaagtaggaattctgtggtgttgggaatgtatactgaattttcttgaagaaagtgtgacattgtccccttccccaaatttatgaacaggtaccaaaaacaacatttctatgctaagccgtgcattgaggttctgtagcgtttttaatatttgagatgaaaatagggccttcttggggaaggtgacagttgactgttcatactcgggcggtatgtgttagggtccttgaatgtggatgctctaaggagaaaaggtgatttgagcccagagagcctgctgaaatggacatagaattgtgcagagcctccgacagaaaaaaaggcacctggatttcatgtccttttaacgaacattcattcagtgtttactgaagcctaggccaagtgctaggtagtggtggggcatcacaatgaatggtaaagcccctgctctcaaagagttcattggccatgccagcataattgcaaaatggtgacatacctatgacaacagacctgacctgtattctctagttgcagagaggtattaaggattcatctgatgggaagttcaggaaggaatgcttcacaagcagggatgtgaagtcagcacttagcaagcagtgagcgttgggcttttaggagggaggaaacagctcgtatggaagaggagagttattggcttagcaaagacaaatagctttgtggggctagagggtttataggaacagtgtcagatgaagctgaaaagtagattggggtcatgcttttgtttttctttttgttttttgagacggagtcttgctgtgtcccccaggctggagtgcagtggtgtgatcttggctccttgcaactgctgcctccggggttcaagcgattctccggtttctgcctcctgagtagctgggattataggcatgcgccaccacgcctggctaatttttagatttttagtagagatggggttttgccatgttggccaggctggtctcaaactcctgacctcaggtgatctgcccaccttggcctcccaaagttctgggattacaggcgtgagccatcaccgtgcccagcctggagtcatgcttttttaaaagggccttagaatctcttacacttaattatgtaggccataattatgtaggccatgagaaatgggttgtgtactaaaatgatcagagctgtagtttaggaataatattctggctagtatagagtctatacttatggtagggtgagctttcggtggggctctttaaactgattcaggtaaagagtagaagccagagctagatcagtggagctgggaaagaggagatgagattaaaggatgttaaagagaaatggttagggcctggggcctgaatgtgggaagtgaggagaagactggggcctgaatgttgaaagtgaggagaagactataggctgtattcatccaaagcagaggggcctggtgctatcctgctagaatcagccgatgagcaatagtcagggagaagcagctcagacacactaggttctcagggctgtgtagacttaaccagacccctgaagagcagaatcttagattctcccagcaatcctaaaggaagccaactccttggtacaaccagagctggaggtggaagcagtataaattagagcaaaacatataagcctgagctgggtgagggtttagaggatgtacctacagactgagaaggagaaggagggtagcagagtagagctttaaagccatgccaagctcccaggaccacagaagactggtgaccccagatttcttcgaagttcactggtttcctttgcctcagtcactgggccatcaaggatgaggttaaaaacaaaacaaaacaaaaaaccactaggaaaaatgactacagagagaacagaggctgacacccgggagtctcatcactatggagaacttattttcatttctctcttggggagttgctgcataaaattaacccagtcaaacagctagataacatgctttttccattttggtatggccaaggacttgtgagttctagaaaattgtaccaaaagagaggataggagatggatgttttaaaatggcttttgaaaggataaatagacattaatttgtttgctttcaccacactttgagcccttcactttcacagaccagtctgatgtgaccccagccattacccacatagccctcctttctgcatggcttccctgaccctgccatgtcgatcaagtccagagggatgttaataagctgaattgtgtatggaactgcagtttatgtgaccatgtaatcacctcacttctgtgaaaaataaggataatgaaaagaagccaagttctttctcaaccttgctacatctcaactttgctgtagactttgacgtttcttaaaatcagcctttccatttataatagatagtgtgctctgctgtcatttgttttaggtttccagccatagttcccaggccaccaaggactctggtgttggccttaagtactcagcctcaactcctgttagaaaaccacgccctgggcagcaggatgggaaggaaggcagtcaacctccccctgcctcaggatactgggtttattctcccatcaggagtgggttacataaactgtttccaagtagaggtaagtcaaatcacataggaaagttgcatttctcttgcccgtttaataaccttttactgattctctgaaacccctaagacacaatccagactccttagctagctccatgaggtcttctgtgatctggtcttggccagcgacctcttgtcgttgttttaaaccctgtctggaatgtccttcctccttcccttcccatggtgatgcctactcatccttcagtgagacctaggtcctcaaacaatgctcctaaatggagccttcttccaccctgcttcacccaggctgactaagcagcctctttgactgtactggagcatggtgtcttgtgtccttgcatcacggcattaatctcatcctcctaaaatgaagtgttacgggtctgtcttccaaagctccagaggaagagtcagacctgagtaaatctttttcacttattagctgtgtggtcttaggctaattatttagctgctgtgaaactgttaatctgtaaaatgtgaatactaccttctgagaatttgttcattcagaaacttttttttgttttttgtttttttttttgagagggagtctcgctctgtcacccaggctagagtgcagtggcacaatcttggcttactgcaacctccgcctcctggaatcaagcaattctctctcctgtttcagcctcccgagtagctgggattacaggcgtgcaccaccatgcctggctaatttttatatttttagtagagatgagggtttcaccatattagacaggctggtctcgaactcctgacctcaagtgatctgcctgcctcggcctcccaaagtgctgggattacaggcgtgagccaccgtatgtgtccaggaagtgcttattgactgcctgctgtgtgctaggttctctgttgtcagtgatcagcaaacatatttcctggttttagggcagataagttagtaagctatcacgttggagagtgttacatgtcatgacagtggtaaacactgagtgctgtaagatcttgtatgtagcatgaattagatacccagatggtcacttaataaattaatgaataaattagcaaatgcagaaacaaaccaacagataaacataagaaaaactcaagtatcagccatagaaaatactttgaatccatgttttgagctgcttttcaaaaatagttttgacctttttttcagagttttattctcacatctgcagtatcttggcttaaatgctgctgttctctactaaatttgtttacctggtaaaccatgggggtaaaacactcttttgttgaataaactcttctgtttatttctttgaagatgcagacagtggaggagatagtcaggaagagagtgagctggatgaccaagaagaacccccatttgtgcctcctcctggatacatgatgtatactgtgcttcctgatggttctcctgtaccccagggcatggccctgtatgcaccacctcctcccttgccaaacaatagccgacctctcacccctggcactgttgtttatggcccacctcctgctggggcccccatggtgtatgggcctccaccccccaacttctccatccccttcatccctatgggtgtgctgcattgcaacgtccctgaacaccataacttagtaagtggaaagacatacaactctctttccacactgcttccatgggtgactgataaggttatatacttaatgagttgacctatttatgactggattatatggcaaagtgtgtttgtaaggctgatgtttagaactgtgcaagcattctcttattaaaattctcttataaaagcagtggcatgtgcctataatccgagctactcaggagactgagacaagaggattgcttgagcctaggaattcaaggccagccccggtaacagcaaaaaacaaaaaccaaaaaaacaaaaataccatgtacaggagttagggtctcaggccagtctacaaacctgggttagccatttaataacaaatgttttcagtccagaaatttaccgtttttacaaagcttatgtatttttctattgacaagtgttatattaatgtgtatgtatatattcacttactagtgcctgtacttgtacacatacatatatgtataatatgagtgtatacacatgtatgtgcacgtgtatgcacacaggtatggacagcatacagtaaggttttggtggggattatctctaggtaggatttatttattatttattttcatagtttatatttcggtggggataaggttttggggattatctctaggtggtgggatttatttattattttcatagtttatattttattgtacacaatattttgtattctgtttttcctacttaatgttataagcatttgtccatggttttacaaatgtctttaaacaatattttaatgactgtacaacatttctatatttgtaggtactgtagctgactgtaaattcttactgtatctcttaggctagattctaagaaataattatttcctaattactagattacttcctttttcttttttcttcttctttttttttttttttttttttgagacggacttgttctctttcgcccaggctggagtgcggtggcgtgatcttggctcactgcaacctccgcctcccgggttcaggcaattctcctgcctcagcctcccaagtagctgggattagaggcatacgccaccacgcctggctaatttttatatttttagtatagatgggggtttcaccatgttggccaggctggtctcgaactcctgaccttgagtgatcgcctgcctggacctcccaaagtgctgggattacaggcatgagtcactgcgcccagcctcattagattactttctgactttttggttctaaagaaataaaatggaatctaagctcctccttcagactcagaacacctggagttttttccttcctgtcttggcagattgagtggaagataaactagggcacatgtcaagtcaccagtcccattgtaataggtcagactagttttagagggtctgtgtgcatttacaagtttaactgtagtagtcactcacattcttttgcagtttttcttgcacattgtaatttgtaacaatttctttctattcagcatttttctataatctcttaaacgggttcttttactctccaaacttacctggctgtttatatagtttctcaggtgcacttttatacttcccttcgtttgcatgtgttacttcttcagcctaggtctttccccttccgttcgttcttcaaaacccaggcaaaacacctcttcctctgagcagccttctcagaacttttctcccatgtggccagaggaaggagagacttctgtctatctcttctgctagaccccgaactctttggaggcagaggttatccacaagaggcttggcaaatgtttctcagtcatagttggactgtttgaaaaattaaaggttctatttgtctgtcagtttcatccgtgacatttaactttttataccaaagtcttagaatctaccatcattttttgggccattgataccactttaaccacagttaatttcagcttttggcaggaaagagaggaaacatcctgtgatgtttcagcactgcatttttttccccatctcattcaggagaatgaagtttctagattagaagacataatgcagcatttaaaatcaaagaagcgggaagaaaggtggatgagagcatccaagcggcagtcggagaaagaaatggaagaactgcatcataatattgatgatcttttgcaagagaagaaaagcttagagtgtgaagtagaagaattacatagaactgtccagaaacgtcaacagcaaaagtaattaatatattttttataattcagacaaatacgatattagttcattaatgctgtcgaacagaactttctataatcttggaatgttcttgatcttctgtccaaaacagtaaccactagctcagtgtggctgttgagcacttgaaatgtggctgatggagctgaggaacagaatttaatttcaattaatttaatagccacatattgagtaccatattgagcaatacaggtctgagttcttttggccaataatacaaatcagctcttattgtagtccctcttggagagtggtataaccatttcccctctccagttaccctagctaaaaatacagcaggggttctcaactctttcttttccattactctcctgtgcttccagttggtctctaaatcctgctgactgcatccagagagctctcaaactggtccctttctgtcatctccccttctctagcttttaattagtctcatcctagcgattgtaatagtttccacactggccttccatgtcttctctcttggtctacgctgtatcttgacacactgcaaatctgactgttccactttcccatgtgattctcagtcccatcagaatatacacgacccttctccatctgaaatccacccgtctttttcttttatcacagtatttggtctggctcactactttcctgtggtttcctcaaacaccacgttttctcctgcctctacacctttgcatgtactgtcttctccctgctgacccccttacctaactccaacttgtcttcaaaataaaggtcagagatcccctctcttttttttctcattaaaagcctatttcttctcaggtgcccacaattcaaggttagcaaccttggtcatagcactgttcacacaatgttctggggagcccaggagctccttgaaggcagtagctggacctccatctctgtgtcccagcacctgtcatagggtcacttagtgaatgcagcatctgttgattgggttaattatgcaaaagcctatcttttgcagtagtccatgaattatgacagttccccagtttttgtcatttaacccagactggcccagaccccagggtggtagggaggcctgcagaggacacaagtaagtaagacgtggtcactgccatctagcagcagacatctgactaatagtcctggcaagtgaaagcaagggccacacctaaaagataggggctagatgtttgaaggttaggcagatggttatgtctgttatttttgtgggtatacacattggggaatggaatttttttactttgaggtattttggagggagatgatagggtggtaggattgccacttcttttcatagttataaaagtgtaataaatactattctaggaagtttggataacacaaaaatgtcccaagaagaaagtaaaaatcatatgtatgccttcatttaaagataatctgttaaatgttgaatttattttcatatttttctgtcatgcagtcatacatagctaatctaattttcaaataatttcatcatgttagccttaagatattgaattgtgtgtcacagtttttgatgtgtcaaatgttgtcaccagagttttacttcagccgaatggaataaatcacaaaatcaggtagtcttcaagggcagcctatgaactgcccttgaaggatagttttgagggaatggatgaatattgtggtagtggtttgctttatttttatacctcaaaagaatagaagtatcaacattttcttggtcaagtgctgacaacacaataatctttgttgttatatttaaaagggcaaacaattccatgtcatgcattttacatattatgcatttattgccaataggaattccatgtttaataagatggtaaacctagaccttgaacaaaatcaaatgtagcagtctttcttacctattctcatataaaattagaaaatcattgtagatctttttagtagttaggctacaagtatctgtattgtctacatttaacattttttaatgggtgtatatattattttttagggacttcattgatggaaatgttgagagtcttatgactgaactagaaatagaaaaatcactcaaacatcatgaagatattgtagatgaaattgagtgcattgagaagactcttctgaaacgtcgctcagagctcagggaagctgaccgactcctggcagaggctgagagtgaactttcatgcactaaagaaaaggtttgtcttcttgtggtttggggtgtgagctcagtgtgggtgagtcagcttactgtccacctgaaggattagaaagagaatgtgtgtgataagaggacagttgtccaagtcagacagccaggttccaggctggactctgctagttaagaagatgtgagaatttatgcaagtcatataagtcccctggctttgcttttcttatctataaattcaggctaagaatacgtaggcttttcggcatggattaaataaaacagcgtatttaaaattcctgaagttacttagttcctagcacaccccacgtccttatcctgtgtgtatcttttatatttaattatttgggttctgctacctgtgtttttttaaataggtcaatctttatattcttattaagctacaatggacctcacaagtattactttggtcttcaggttgataatgatacaaaatattttttggtcagagataattttcttttttttgtttgagatggtgtctcgctctgtcacccaggctggagtggagtggcgcaatcttggctcactgcaacctccgcctcccgggttcaagcgattctcctgcctcagcctcctgagtagagacggggtttcaccatgttggtcaggctggttttgaactcctaaccttgtgatcctgcctcagcttcccaaagttctgggattacaggcgtgagccactgcgcctggcccgataatattctttagaccacaacacagagggaagttggggagaaaaaggagttaccttttattgagccactgctgtggctacacatggccattttgtaaatgtttcatttaaccttcctggcagccctgtgtagatgatgttagcttggtttactgatgtagctcagagaggctcattactggcccagagtcacatagccaagggctcttttagttagatgagaattccaggatgaaaagagttccttacccacatgaaacacctcaggaactattatttgtattttgctatttcaacatgaatctatttaaattaaaagcagtctattacctaggaactaaattatttattaaagaaattctgtgagtaattaagaatggaaaaagtccttttcagatgagctgttccttctgttgtcatatgttggattactgtgagagaaaatagatgtgagcagaactagaggaaaaaaaatcactggtataataatatataataagatattttgataatatatcaaaatatcactggtatattttgattataaattttggtatattttggttatatattaatatatataggtatagatatataaaatcatcaaaagaaaattgatggcagtggtagtaggcagaggtagtaagtcaaccaaggctggtaagttctttcaccttcatcctcccaaaatgactcagggaggcagcttggtaagaaggaggaggagagagaaagtagtggtgttttggaaggagtgtgccagacatgttaaaacctgacatagaaggagacaaaaaactatttggtggcttttctggaatgcatagccagttttatccagtgctttgctggtgaaactgacagaaacaagctatctgaaatggaaagacgtatggtaaaatatgtagctctctgggagcttgccaacccttttgcatccacacagatatttaataggcaaatttaacatacggactcctctggctttagtacaatggcagacttcagttttttttggctgaaggtgagtcactgctcaaccaagtgcaaaccacactctatttatttttggaacttttgatgtcattgttttaagcatcttatgttaggcagaaaaagaaaccaagttgattaaaacaaatgtgtttttaccaaatcttatataggaagattttaaacatttgcaaagtatttaatgtttgtgtttgtcagccgtaattacattatcaccagatcaatgcatttttacttcgcttgataataactatagagtgcagcaagaatttctgtgtggaggaaatcttggtaaaatcacttccttcccacttagttgggtagatagttttaatatttaaaatgatataatagtattacagattattttgaaataaaaagcatctttagttccactactttcaaatgactgtatttatttttatatagtctttctgtctttgttgacacatgtagttttacacagttgctctcacagtgcttataccattttaaatttatttttctcagccaacataatattaacattcttccgtgttgctacattgtcatctgatcatttgaaaggctacacagtattccactttgttaatgcattatcacttagcctattattatttgtcaggtcttatattattatacattgagcatttttatatagtagttctttgcttctgaattatttaccgagaattagagttacagtgaatggacatttttatgtctttctgtaccatcttgttttccaaaagagctgtactggtttacatggccagtagctgtgagtgagtattgtaactgaatggcttttaatgacagtttcttttctagacaaaaaatgctgttgaaaagttcactgatgccaagagaagtttattgcaaactgagtcagatgctgaggaattagaaaggagagctcaggaaactgctgttaacctcgtcaaagctgatcagcagctaaggtaggtggattccctaagccgttgatgtatacattgagatgaatgaaaagtttgcttctaaggggataataattggtttatgataaataatgcatggtaagtctacaggacctggggggaataaagcaatgtgctttagatcgctccaggctgatgcaaaggatttggagcagcacaaaatcaagcaagaagaaatcttgaaagaaataaacaaaattgtagcagcaaaagactcagacttccaatgtttaagcaagaagaaggaaaaactgacagaagagtaagtaaggcctctgtagggctacaaggggtttgtgctggaagacagctctggggttccgagtcccttaggatctgctctagtgttgctggtgctttgtaggcttcagaaactacagaaagacatagagatggcagaacgcaatgaggatcaccacctgcaggtccttaaagaatctgaggtgcttcttcaggccaaaagagccgagctggaaaagctgaaaagccaggtatggcaatagacaccttgaaaaaacaactgacacagcactttatgattataaaagtaatacatgtttaattgtagaaaagaataaatgcggctatgtattatagttgttaagcatgaagtctgaactaaatttgaatcccaactcaatacaatacttctgaataaaaaaagtgggtctcaaaacatggtatactctatgagatcatttctgttaaatgcctttatcaacacttatggttgtatttttagtcaataccaaagtacaaaagtggtcatctgataaggggggattttgagtattttctgttgtcttccttttgcatatctgcatggtcttcttttttttttgtaaacaaatacgtattgtctttaaaattgcaacgaatttttaattttaaaaatgaatacattttaaaaatctctgactaacttccatcaccaaggatgtcaaaatggaattagggtataaaaataaaagttcttggaaaactgtaacctgagggatgatcatgattatcatattgttgttcttactgtgatcactgtgatttgagtggttttaagtatgtgagctcaaggttttcattaggcatttcacccttgcactccttgcctggcttttctgactcttgggggctaggatattagctcctgattttacctcacaactaaattatctccaggttagcactgagggctgtatggcctttgtcaaacttactcttcccttttctttaatacaggtgacaagtcagcagcaggagatggctgtcttggacaggcagttagggcataaaaaggaggagctgcatctactccaaggaagcatggtccaggcaaaagctgacctccaggaagctctgagactgggagagactgaagtaactgagaagtgcaatcacattagggtgtgttttttattagggttttctgaagagtcgtaggacagtgctataggtttactttgatgtattttcattgcttctccccaaatgaaaatataaattcctgaaatcttgcctcctctgtaaaatcagtttggtgttgttacatatccatgcagtggctgtcatgtgtagttccccctctgttgttttctggatatgctcaaagttctcctgcccctgtacctttctcataccatttcttctccaggaattccctttctcccctatcactagccagatcccacctgtttctcatggcgcagcttcatgccacctcctcttagaaaacttctggccgggtacagtggctcacatctgtaatcccagcactttgggaggccaaggcaggcagatcacgaggttaagagattgagaccatcctggccaacatggtgaaaccccatctctactaaaaatacaaaaattagccaggcatggtggcatgcgcctgtaatcctagctactcgggagactgagataggagaattgcttgaaattgggaggtggttggttgcagtgagccgagattgcaccacggcactcttgaacccgggaggcggaggttgcagtgagccgagatcgtgccactgcaccctggctggtgacagagtgagactcaatttcaaaaaaaaaaaaaaagaaaacttctctgacctttttctttcttctggaagaaggagtttccttcttttgagtttagaaacactctatctgcatgtttcctagggcatgaaggcctagccttttgtgatcatgtttatcttccctgccttaccactcaacaaggtactaagcccctccagagcaggagccatgtctcagtcaggcttttctctctatagacgttgccttgcttacagtaatgttgcaaatatatttagatgaagagaatatgttactttcttctattatatagaaataggtttctgtaaaatataatgctgttcttgacataaaaggcaaaaatgagcttgtttccaaattagaatttctatgatataaaacaataaataacagaacttattttgaagtaattttcatttacagtcacaggagggaataactttttttttttcaaacacaggaagtaaaatctcttctggaagaactgagttttcagaaaggagaactaaatgttcagattagtgaaagaaaaactcaacttacacttataaagcaggaaattgaaaaagaggaagaaaatcttcaggttgttttaaggcagatgtctaaacataaaaccggtaagtttaaaggaaaacaatcatacaaagtttgaggttggaaatgtctgtattacaagtcacagaaaaaataacaaatggccaaaaaaactttaaagtttaaccttactgctaataagcaaagcaagcaggttataaaaggaatatgatattttctgccattttaattgataaactttatttaaaagcaaaataatcatgctcattgctgatcagagtgtgctgaaagaagagcactcacagtctatcaattgaggtataaactggaacaatctcccagtgtttcaaggctcttaaaattcacacctgttgaactagtcagcccatttctactcctccagaaagggcaagtatgtacatcgcagcaatatttataatgacaaaatttggaaacaggctgggtgtggtggttcatgcctataatcccagctctttgggaggctgaggcaagaggattgcttgagcccaggagttcaaaactacctgggcaatgtatgagaccccatctctacaaaaatattcaaaaattagcgatgcacattgatgtgcacctatagtcccagctattcagaaggccaagcagggaggatcccttgagctcaggagatcaaggctgcagtgagctatgattatgccactatgcttcagcctgggaaacagaggaagaccctgttccaccacaccccccaaaaaattggaaacagatgaccaatttaaaagccatatttttaacctttaatgacatgcaaacatgaccatgagaagaatgaaaaaaagtaggtaaaaaatgaatatggagtatagtcccagtttattttaaaatgtgtgagagtgtgtgtgtgtgcgcgcgtgctcacgcgcacacacatgcattcttagaaggaaatacatcaaaatgctattgtaaaagtgatttggggtggtgaaataatggtgggttttcatttttttctcttatgctttttttttgtattttccagcttttctacagtaagcaagtatctctatgatcagaaaaaaagttaatatttaaatatctgtatttcaaaggccaaaaaattgttatataaatctcagtctgtatttcaaagtatttttaatttattttgatcaattttatataaaatgcttttagttgattcttttatgtagaagcaaatgctttggaaccagatctttgttaattaaatgtttttgttaaaatgtttgtctgtttatttatttatatagagatgggatcttgctctgtcaaccaggctagtctcaaacccctgggctcaagcagtccttacacctcagcctgccaaatggctgggattacaggtgcgtgctgctgcacctggcttgttaaaatgtttttaacaaattaaatagtatttagcgatacttttagagaattttttattaaaaataaaattagcaccattaattcagctcaacaaaatttttaaaattgtcttgtattagtcaatagcattgttttctgtttcattttgtaaatgttttccaagttcatttaatatcatggaccatgctttgtttctatcccttagaactaaagaatattctggacatgttgcaacttgaaaaccatgagctacaaggtttgaagctacaacatgaccaaagggtatctgaattagagaagactcaggtggcagtgctagaggtaatgaacaaagccagtgtacccttaagaaactgaagtctttctcatttaagatgtttgagtcctcttttatctgatttaggagaaactggagttagagaatttgcagcagatatcccagcagcagaaaggggaaatagagtggcagaagcagctccttgagagggataaacgagaaatagaacgaatgactgctgagtcccgagctttacaatcgtgtgttgagtgtttgagcaaagaaaaggaagatctccaagagaaatgtgacatttgggaaaaaaagttggcacaaaccaaaaggtgagagcaagaacaaataagcttgcaggatcacttcttcaggccaaagcattataaacacactataaaaaatttggaaaatagagaaaaagataaaatacaccacaaacttggtatcataatacattttgccagttgcatttttttggagaatttccttctagctttttttttttttgctcaaaagcatttttttaaaatctattttgttttttttaagtaaaatgatacatgctggaaataaatggagatatatatcttgttcatggaccaaaagacaacattgttaaagatttagttctgttcaaattgatctctagattcaaaacagttaacaattaaaatctcaatagcctttccttgtggaaattgacaagctggttctaaaattatatgaacctagaatcgaattattctaagacctagaatagaatttatacaattttttaggtatgacaccaaaacaacttttagaaagtagaacaaaaatttaggactaacactacctgatttgtaacacttttataaacctgtagtaatcaaaacactgtggtattagtgtaaagataaacacatagatcaatggaacagaatagaaagtctagaaataaactgacatatatgtgaacaactgattttgataaagataaaaaggcatctttttcagtagagaaaagatggtcttttagaaaaatgttggctgaaacaattggatatacaaaaccaaaaaaagaatctcaattcatacctcactatgtataatatataaatatgaatttaaaatgaggccaggcacgttggctcatgccagtaatcccagcattttgggaggccgaggcaggaggatcacttgagcccaggagtttgagaccagcctaggcaacatagaaagaccctgtctctgccaaaaaaaaaaaaataataataaaaatagccaggttgggaagctgaggtgggagaattgtttgagccagggagattgaggctgcagtgagccataatgataccattgcactccagccagggtgacagagtgagaccctgtttcaaaaaaaaaatatatatatatatacatatttattttatatttatatataggaccataaacatatatgtaaaacctaaatataaaacttctagaagaaaacataaaacatagcagaaaacttttgtgaccttggagtgggcaaaaattcttggtatgacaccaaaagcatgatccataaaataataaattgataaaattagacttcaaaatttaaaacatctcctcaaaagacacaaggtaatgaaaagatatgtcacaggttgggaaaaaaatatttgcaacccatgtatctgataaaggacttgtattcagaatacatgtataaagaactctcaaaactcaataagaagacaacccagttatttaaatgggcaaaagatttgaatagacatttcattacagaagataaatggatggcaaataaacacatgaaaagatacgcaggataattaatcattagagaaatgcaaattaaaaccacagtgagatatcactacacacctattagaacaacagccataccaaatgttaatattaaccaggaactttttttttttttttttgagatggagcctcgctctgttgcccaggctggagtgcagtggcgctatcttggctcactgcaagctccaccttccgggttcacggcattctcctgcctcagcctcttgagtagctgggactacaggcacccgtcaccacgcctggctaattttttgtatttttagtagagacggggtttcaccatgttagccaggatggtctccatcccctgacctcgtgatccacctgcctcggcctcccaaagtgctgggattgcaggcatgagccaccgcatctggccggaactttcatatatgattgaggggcatgtaaaatggtattaagtaactgttaaactttggaagacagtttaacagttacttaaaaatcaaacatacgccaatcggaagatctagccattccactcctaggtattatatttattcaagagaaatgaaagcatatttctacacagtatatatgctaatgttcatgacagccttatttgtaatagccaaaaactagaaatgacccaaattgtctatcacctggtaaatagataaacaaattgtggtatatccacactgtagaatactactcagcaataagaagggaatgaagtattgatatacacaacatggatgaatctcaaagtaactacgttgagtgaaagaagccagaccaaaagcaagtccaaactgtatgactccctttatgtactacaatacatgctcatgcatgtctgctatatggacagatcctactgtacacacaattgttttctactctttcgattgtcacagctccatttttatcagatttttggaattctgaatgttatccatgtttttaatccatgatttttataaaacttcaatttagtgagtcagtttttgaaaaaagtctccacttagaaagctgataataagattctgaaaatgagttgagtcttaaattttgtgaagatttataatcatttatactttccataactgtatgttgtgaaaggataacactgttcctcagtcatctcctgtgtgtgcttgtatatttgacagtctgacttactctctgtggtagggttttagcagcagcagaagaaaatagcaaaatggagcaatcaaacttagaaaagttggaattgaatgtcagaaaactgcagcaggaactagaccaactaaacagagacaagttgtcactgcataacgacatttcagcaatgcaacagcagctccaaggtataaggcagcaaaacagtgaaagtgtgtgatttccttgcccttcgttagattctttgatttttcttacgacaagtaattcctgctaatgagcatggtgtttctttctaaaattagattgtggtaatgtttgcacaacttggaatatactaaaagcctttgaattgtacactttaaataggacatgatatgtgaattttatctcaataaagtcagttaaaaaaaaaaacctaattcatgttccttagagaacaattttaaaacagcaaaaagaaataaaaattgctgttgacctcactcctcatagattcctagtaacagtttggtgaatatccttccagatttttcctaggggtgtgtctagtttgaaaaacaaaaacaaagatgtaaataatgaagattttaaaattaccaaatgtttataaatatgataatttatttagaagaaattgctgagtaattctagctaataatatacttgttgaacattttttatatccttggtatttcattttctcacttaatcctcataacatttttatgagataaaaattattttactcatttgtaaataaggaaactgaagcttagttttcttgtgactgcttaaatgagaagtgacttgctagaggtcacacagctagtaattgacaaagccaatatagataaaaaatttattcccaaattgccttcctgaaaggttaagtttctatttctaccagcaatgcagaaggtagctgtttttaaacacctaacattaagtattatctgtaattttttcgttgtgagattttgaacatgaaaatctttaaaaacctgagctccaagcccaaatctggattgtgcatgtaactctcttttggcctttaatgagatagtgtggcatagtcatacatgtaacaggagtaagcttaaaacaacttctctactttttgggaatgctaatgggaatctgtacagtaaatacgtatgtatttcttatttcatgagaatgtcatttctttagaaaaacgagaagcagtaaactcactgcaggaggaactagctaatgtccaagaccatttgaacctagcaaaacaggtaaggttaacaaatgtaatattctagtagtatactgagggtatgcagaccattggtttaaataacaaagaaatcaagtaggctggttcctcttcacaacagcagataccgtagggccatttatgtaacataaccatcacataaataaaagttttgatggagagcagtggtttgctaatttattttagccttagaactcttgatacaaacagttttactcaaagctagtaagtagggtggtggctagaccagagcccagcagcagtctctcagcagcccttcttggggtttcagggaccagatgggccatctctcatccatgacacagatgaggcctctaaaggctgggcttagatttgattactccttgagccatagagtacccgccaaatctgggcctctatcttgtcagatattgaatatagcagatttttgaccctcatacttctaatgattttcttaaaggtaattcagtgttgtcctgtgagactagtgctgtaattcaaagcacttcaaacaagttctagacttcagtttctattatgtaaattaagagttatgccaggtgcagtggctcacacctgtaatcccagcactttgggaggccaaggcgggcagatcacctgaagtcgggagttcaagaccagcctgaccaacatggagaaaccccatctctactaaaaatacaaaattagccaggcgtggtggcacatgcctgtaatcccagctactcgggaggctgaggcaggagaatcgcttgaacccgagaggcggaggttgccgtgagctgagattgcaccattgtactccagcctgggcaacaagagtgaagctctgtctcaaaaaaaaaaaaagttaacattagacacaggccatcccagcactttgggaggccaaggcaggtggatcacttgagcccaggagttcgagatcagcctggccaacatggtgaaaccccgtctctacgaaaaagacaaaaaattagctgggtatggtggcatgtgcctgtagtcccagctactcgagaggctgagacgggaggattgcttgaacctgggaggcagaggttgcagtgagccgagatcatgccactgcactccagccttggcaacagagcaagactgtcaaaaaaaaaaaagttggattagacatctaaattctcttgtacctgtaagtttattgagataataaaggaaataaacttttatgcctctcgttctgtcagacttagtagatactggattggcactgaccacctctagtaaagatggctttattagtagtttccacttgttctttcacctaaaggacctgcttcacaccaccaagcatcaggatgtgttgctcagtgagcagacccgactccagaaggacatcagtgaatgggcaaataggtttgaagactgtcagaaagaagaggagacaaaacaacaacaacttcaagtgcttcagaatgagattgaagaaaacaagctcaaactagtccaacaagaaatggtactacacatttatgattttacataaaaaaagcattttgtggctcatgtgagcctatttttcccctggcagaaagctgctgagaaatatccccaatgggactatgtgtcccttaactgccctgtgtagccatgggtggcatttataccaactgtgtgactctcttacagacctttaacgatcatagaacatcagtcctgtaaagatacttaacagccacgtgccatttgctgcttgaatcccctcctcacatgctggccagatagcttcccaagccctcttgatcacctctgtaatggaattgtccctgtgggctgtcttctactttcttttgacctggaatctgtctcatgtccatgcaggttctctgggacactatttgttgtttaatgactaatcaagattattctttattaagatgtttcagagactccagaaagagagagaaagtgaagaaagcaaattagaaaccagtaaagtgacactgaaggagcaacagcaccagctggaaaaggaattaacagaccagaaaagcaaactggaccaagtgctctcaaaggtgctggcagctgaagagcgtgttaggactctgcaggaagaggagaggtggtgtgagagcctggagaagacactctcccaaactagtatgtattctggaacttctcactgggagatggggtatggattggctctgctggttgtcttgcaaaagtatttaaagagatccggaccccagccagagcccaggagaggaggcaggagaagtaaagcaggaggtatgatagccctgtgaaagatgaggaagcaggttcagaggagatacaatcctgagactgaccagcaagtccttccttgctcatattgtctcctttgagaatgccatctcaagaaagtggaacattcacgtgaataattgccaaaagatactcttaaagtatattacctatgagctttgggaataatgatctacttcatctcaagtgtcaaaaaaatcatattaacagttcttttgtccagatttggcatagtgaatggtaccagaatacaggtgtttgcttttaggtcagtttgttctctcttgaaccatatataaatgaagttgacgtgggaatccagggtaaatgattgttctcacatcagtaaatggtttttctctttcttaggctccagggtttaataatgcttggaaaatgttgtgggcttggggatctgaaagggttgttattcctttttccctgggaactcttgatatacccagacccaatcatttcattatgaaaatgaaacttaaaaaaatatgtcgagttctgatcatgccagagttgttgaaaagtaaaatctgggcagggtgctcctctagggtgataagaaaaatattttttaaatgtcacttttatttcgtaagcattatctgtcgagtactcactatgtaccaggcgtttgcacacattattccaattgaacatcaggaaatgttttcctcttctataaaatggggctcatgccagtgtaggagccagctccaaatcctgtgcactttccactgcactgcctcctgtggaaggaagtagtactggtgtgtctccctttatgaaaatcaatgtttataaaaaacatttcagctgttccacacacttcaggattggtgctgggtttcctctcactggtctcaaagacttgaaagagaagatagtagctatctgtcactctgggatcaggccctccaggaaccaattacttcaaaaggcacccttatctgggttttttctgggcctttggtgtgggtcagggtaggcttgtacgactttgtaatggaggaaagcacctgcatgggtagcatatcaccattatgcatctgccacaagggaaggggagctctgcccacagctggctcggggtctttggctaaacctactgaaaatgctcatttcagaacggcagctttcagaaagggagcagcaattggtggagaaatcaggtgagctgttggccctccagaaagaggcagattctatgagggcagacttcagccttctgcggaaccagttcttgacagaaagaaagaaagctgagaagcaggtggccagcctgaaggaagcacttaagatccagcggagccagctggagaaaaaccttcttgtgagtacctgctgccgtggcagtttgtgaggaaatgataaatttaaaattttaaactgcaacaccacttcaacacagagaaaataaattacccatcaacccagtcctgaacccagctgttgttattgatgtatttatgcatcatttgtccttgaagttgatggtaagttttacctgggacgggtgcagcctcaatggagctctggctggctggggagactgttggtgtgaacagccattatcagcacaaagtagacagcatgttctgccagcaagcctcagtttacacctccactggcagggaggagggggtgttgaagaagccttctctagacggttgttttttaagatggcatcttgctttgtctcccatgctagattgagtggcgcaatctcagctcactgcagcctctgcttcctgggttcaagcgattctcatgcctcagcctcctgagtagctgggactacaggtgtgcgccaccacgcccgactaatttttgtatttttagtagagatggggtttcaccaggttgaccaggctagtcctgaactcctgacctcaggtgatccacctgcctcagcctcccaaggtgctgggattacaggcatgagctaccgtgcctggctcatagagagtttatttttatttttattttcaagacagagtcttgctctgtcgcccagtctggagtgcagtggcatgatctcagttcactgcaacctccacctcccaggttcaagcaattctcctgtctcagcctcctgagtatctggaattacaggcgtgtgccaccatgcctggataatttttgtatttttagtagagacggggttcaccatgttggccaggctggtcttgcactcctgaccttgtgatccacacgacttggcctcccaaagtgctgggattacaggcataagccaccgcgcctagccagttttattacactgctgtagtcagtgcctacaaatttttctcatcctgccctttttggccaacattagctttaatcattatcctaaaaccaggaagctcaatctaccatgctttcatccttgaaataaatttgggaagtgacactcaggtcagaataatttatggtggatggagacaggtgagcagcaatggaactgtcaagggggaggatttttccactaccctctggaggggttagtggagccctgttgtatgaaaggaacttttaaaccatgtgtgtctctcaaaggggatacgctgataactagtgataggcagatcgtcataaagatggaatatagatgtctaaaatttaatcctaccagtaaccctgtgatgatgggtattattattctcattttacagacaattaatgaagactcagaaagggatagtagcttattatcaaaggtaatgctaacagactctgacgtgtatatacgcccagctgtatttgatctgcccatgaaaggccgatagaattatccccatttgacagctagagaagctgaggcccagaaggggaatgaagttatagagctagtgagtgtgtaagccagcaaaccacacctccatgtgttagatcgcagagttattttcttcctcctgtgctaggagcaaaaacaggagaacagctgcatacaaaaggaaatggcaacaattgaactggtagcccaggacaaccatgagcgggccaggcgcctgatgaaggagctcaaccagatgcagtatgagtacacggagctcaagaaacaggtgtgtgcccagaaagcccagctggccagcctggggagagaggactcactgggctcaggcagattgtattgtttttaatatcccttctatagtagtatagaaaagctgattataagaatgttctttaagtcaaatctggttttttagccttaaaatttagaaacacaccttgactattaaaaatataaatttctcttaaatttgacaagctcttaaaatgttagtttttcaaggaaaaaaggtaattcttgagcatcatatttcatgtcccaaagaactatgttgaaatgctagattttatgccataaacaagtctataggagccaaaacctcccctaccccttgagcaagaaaagatggtccgggggaaacctttgatatcacataatgtagccaggcagagagtattaaaccagttcatgcctggactggtagagtctctaatccttgatatctctggtgtcctttagagcatctgggccatccctgaactctagtcgggctgctgtagccactcatttggccctgctatacttagtcttttgggtgaccccacgtggccattctagtttcatctgtgcttccaatcccctgatgccccacatatacccaccatttaattcaagaaaaaataaccaaaaaaaaattatttaaagaccacaagcccttagtgattttgcctttgcaaatttggtaaggcaattagcagtaggtataaatttcatatttcactaagctctatatggggtagagccacatagagtagtctcaggcatcaaatgcagttggtaacactttaagaaacctctaggctgggtgcggtgctgcattcctgtaatcccagcactttaggaggccaagataggtggatcgcttgagctcaggagttcaagaccagcctgggaaacatgccgagaccccgtctctactaaaaatacaaaaagtagctaggtgtggtggtgtacacctgtagtcccagctattcgggaggctgaggggggaggattgcttgagcctgggaggttgagactgcagtgagccaagattgtgccaccgccctccagcctgggtgacagagcaagaccctgtctttaaaaaaacaaaacaaaacaaaaatgtatattgccaagccaccagattcttcacttataaaattccagcattagcatttataatccagatcacttatgacttatttcagtaaatggcccttttctcatttgtggcttatttactctagttgccagttgggtgccactgaggtgcttcatgtaaattctcacttagtttttacatttctgagcagaaggtatttatctccatgtataaatgaggtaatggaggatcagatgttagccaacttgccctgtcatactggtaatactggaaatcagattggtaactagctttgtctgactccaaagagattgtcttctatagagtaattcaccttcaaggaactttatgcacatggcttttctaaatgaaagttgttccagttaaaatgccaataaaataatttattcagtagcttatagagtcttgagtatctgaaaaatcacaagtttttacagttctagtaatcatagtagttgatatttatagatctttaaatacatggcacatcatacagctcaattccaagtaagtctgaaattttatacaatgatatttgacaccaactcactgtttagatggcaaaccaaaaagatttggagagaagacaaatggaaatcagtgatgcaatgaggacacttaaatctgaggtgaaggatgaaatcagaaccagcttgaagaatcttaatcagtttcttccagaactaccagcagatctagaagctattttggaaagaaacgaaaacctagaaggagaattggaaagcttgaaagagaaccttccatttaccatgaatgagggaccttttgaagaaaaactgaacttttcccaagttcacataatggtaagggtttatcctgctattctctgggttcgtaggattgaccacctcccccagctaagctaaaacacagatgtgggggtgctggggtaggggagggaaaggctggttggcttccatttgtagcagcagatgattcatgatatctctattttccctctgagaaaggatgaacactggcgtggagaagcactccgggagaaactgcgtcaccgggaagaccgactcaaggttgccctttaaaacaaacaaaaaatcagtatgagatactgggcacattggggaggggaggggaaagttacatttacctgatgctttcacatccatgctgttgcagccctgccagcagtgtcagggatggcatgtctgaagcttcgaggagttggtgtcacacagtaaatggcaatcagtgttcaaaaccatgacttcttgtgttgactccagtgttctttaacctatgtaatgctgctttacctcagctagaaccgatagaatctaagtatttgggagaggaagtagaaacacagtgatgaactgtaaggttatcataggccagtggtggcaggaaagatttgggatactggaaaagtaggctgaatgtcaggtaaggaattgtttggctcagaacatgttgactttgaaggccttgtgagatatccagggaaggatatctgtctgtaggcagccaaaaataggagtctaggattactgatcagtgttgacctaaagatttgagagttaagagtataggtgggaggttacatttatgtggggggaatggctatgtagacagcatgggatgagagagtgcagtgctatagtattgagtggagccctgtgatgtccaacaatagtctccagccatgtgtggttatttaaattttaataaattataattaagttaaaaattcagttattcatttgccacatttcaagtgcttaatagccacatgtgtctagtggcttctatatttatagccagaggtagaacattcccatcattgcagaaagttctgttggacagcgctgctatagactttgagagaataatttgattatagcaggggcaaaagccaaaaagtagtatgaagttgaggattaaatacctaatcatttatagacaagaaactaagacttaggaaaaaatacataatcaggagacactccagttgtcaagtataaactgatcttctcagtcataacagaaaaggaaaaaagagatgaggcaataatttaatggagaagcaagggatacagaaatcctaagcactgctagcatggaaaaactgggccaagtgaaagaccccgttaatgacaacacagaaaagtaaaggtttatgcacactaagtatccacctggcacctcctacaattctttttaaagatgagcatttttgacagccattcctactgttagccagatttgcctatcaaatgtatgtgaggaagctgagcggcagttctggtacatttcttctgtgtaaaaccctaagtcttatcacacttttcaggcccaactccgacactgtatgtccaagcaagcagaagtattaattaaaggaaagcggcagacagagggcactttacacagtttgaggagacaagtagatgctttaggggaattggtcaccagcacctctgcagattcagcgtcatcacccagtctgtctcagctggagtcttccctcacagaggactctcaacttggacaaaatcaggtaagcagcagctctttttaaaaacaaaacaatagcctgaggttgttttttgtcttttttgagacaaggtcttgccctaccgcccaggctggagtgcattggtaccatcacagctcactgcagccttgacctcccaggctcaagtgatcctcccacctcagcctcccatgtagctgggactacaggcacacaccacttggcttggccactttttaaaattttttgtagagatggaggtcttgctgggttgccagggctggtctcaaactcctgggctcaagcgatcctcctgcctcggcctcccaaaatgctgggattacaggcgtgagccaccacgctgagccaagaggaaactcgtaagataggatttaatatattacatagaaagtacttaaaagccgtggggtgtataatctagaggagattcagaaaaatatagattatgccgccttcaactctctgaaaaacttgtcttagcaaagacttggtagaggtagataagctgatggcttaggaaacagactacgactgcagattggatgacctggcagggatatagttaattctactattcatgtcctccacttctggatttatttatttcctactctgtcaatataaagagcttagacctgtgaggccaatatgagtcctagtttagtatgtctccctgcattttgtaacttacatttacagagttggaattcagacctcttaacctaaggtctataaaaaccctgaatttcacaaaggttttctgtgtgagcttagataaggttaataagcatttaagaggaacatgaaatatactcatggaactggtaagtagtagcacacacaactgtcagagataggtaacagcttccattttccagtgcctattgtgtgcacatacaaaactttatatatatcatctaatttttacatccttggaggtaggacttatccttttatatagataaggaatctgtacaaaatgataaatgatttggtcaaggacatagcaaaggacaacagcaggacttgcgggctaatctatctttaccacagagcagtatattttaatggtggagccacaaggagctttcaaggacagttgcctctttaatgtgcccaaggtgggcaagtgacttacctagttcacacagctaattagcagcagggccattagcagcagggccatctgaatatgattatcttaacaccatctgtggtggacccagtcaggtaaaggccaaaatcatcatgggccttagggcagggttcgaggaggagtgtgagaggcactgggcattgaatagggaagctttggggatgagacagcccagagtagtgagagaagagtagagtgcacaagggcttaaaagccagcttcaattaccagctcaaggtggcagccagagttatttagttgctttaaaggcaaccaacgcacagtgggtaggggcgagattggtagaattatttagaagtctggggttgtaatccaggcctatatgggataaaagcctgaactagttaaaagttagggggctggcttctgagcgtaacattttatttccctttttttctggtaagaacagatactacacttgatcttagtcaaaaggctgagagctccttccagcaagttctgcaaggtccatcagaaccactagacagttactgacactgatgccatccctgctcacaggatagatgttacagatttttttttaaactagaacttttaattggaggatcttgaattttagcagttttaagaataaccgtttaattttttctctcagaattttgtacactggttcatcttaaaacatttttccaaagaggtactcaaatatgtcatttacctataagccatcatgccatcacttagttaagactgtttttactgtttcaagaatttgatttatccttccttttgtcttactgtaggaaaagaatgcctcagccagatgaggaatactgtcttgtgtaaatatattcaaggaaaacacctccactacctcactgacttcataattggaatgtcacatggtttttttaatcaagatgcagtgaactgagattctgaaactccactgtagtttactttgcctgtaccattaatgccaatgtttttataaatcacttgtacatagtacatatgggaatagttgcatatgggaatttaaaccaacatgtggctgagcctttttttttttaatcttcgtaacatgtttaaaaaaaaacagtgattttaactgcatatttgaacctacaaactggtaaatcttattaacaaaaagaatgtacttaaggccctctttatttatagtgtcgagttatttttgaattttgcttaaaatctatttttcatatgaaaataaaagataacaatc

SEQ ID NO: 1678 - DNA, 2491 bp, Homo sapiens
tatgacagagaaattccttttcctttatctttccctccttcccatgcccctactctcacaggcacagtggaatgaaaattcccttgtcagtttttccaaaataattgcttcgggaaaccatctaagcaactgttggatctgccacaacttcatcaccaggtcctcatcttaccaatatattttggtaagaaatttttctttaaacctaacatttggttcaggaatccctgaaggccaacataaatctgttccgctccaggtttcgcttgctaactcagcgcaccaagtcccctgcctggatctcactccacctttcaatcaaagctctaaaacttctttctatttctacaactgctcttctctaaaccaaacctgttgtccatgccctgaaggacactgtgacaggaagaacacctctgaggagggattccccagtcccaccatccatcccatgagcttctccccagcaggctgccaccctaacttgactcactggtgtccagctaaacaaatgaacgattatcgagacaagtcaccccaaaaccgctgtgcagcttgggaaggaaaagagctaatcacatggagggttctatatttgcttcccaaggcacacactgtccccacatggccaaaatctactgttcccctgggagggcctctatcccctgcatgcaatcaaactattccagcagggtggaaatcgcagttacacaagtggttcgacagccacatcccccggtgggcctgtacccctcctggctatgtatttttatgtgggccacaaaaaaataaactgccctttgatggaagtcctaagataacttattcaaccccccctgtggcaaacctctacacttgcattaataacatccaacatacgggagaatgtgctgtgggacttttgggaccacgggggataggtgtgaccatttataacaccacccaacccagacagaaaagagctctgggtctaatactggcagggatgggtgcggccataggaatgatcgccccatggggagggttcacttatcatgatgtcaccctcagaaatctctccagacaaatagacaacatagctaagagtaccagagatagcatctctaaactcaaggcctccatagattctctagcaaatgtagtcatgaacaacagattggccttagattacctcttagcagagcagggtggagtctgtgcagtgatcagtaaatcctgttgcatttatgtcaataacagtggggcgatagaggaggatataaaaaagatctatgatgaggttacgtggctccataactttggaaaaggtgattcagcagggtccatttgggaggctgtgaagtctgccctcccctccctcacatggtttgtccctttactgggaccagctgcacttaatagcctgctttctcctctttggcccttgtctctataattcactaattaaatatgtctcttccaggatatggcaatttcacacagagcccctaaaaatggaaagagatcatccaatcttccttggaggtcccagcacctacaagtacatatctcccttggatgccagtgggcaaagattctgcaactacggaggggctccttccctgacagagagcaagagagggagaccctgatgacttcttcgtcccacgtcagcaggaagtagttacagaagacccacgacgtccttatgcccaaagcttttcagggtctccaactcttgagggggaatactgttagggtaggcaggtagccagacaagagcaggcaaggaagcccctgggaaaggaatctttagaaatgcagcccgctgatggcctccttggaaacgctgcacgctgagtcagcaaaaggaggagcgtggctacactggctacacctggccttgtggctgcattcctctgttccagaagggaacttatcaaggcccagccagaggttaccaaggtaggagctattccccactaagaagcatgtatacttctctaataattcaccctaatataccattttgttcattaaaataataaaaaaaaccacacacctgtgtggagattttattttttaaccagaaattccttgttagactttagatccaaatgacatggcacatgtgtgcccagaccagttcccaacacatgcttactagtaacgcccctgcatgaccccttcatgaataatcatgtaaaattctcataagaagcatctccccagccaggtgtggtggctcacgcctgtaatcccaacactttgggaggctgaggcaggcagatcacctgaggtcgggagcgcgagaccagcctgaccaacatggagaaaccccgtctctactaaaaatacaaaattagctgggcgtggtggcgcatgcctgtaatcccagctacttgggaggctgaggcaggagaatcgcttgaacccgggaggcagaggttgtgttgagccaagatcgtgccattccactccagcctgggcaacgagaggggaactccatctc

SEQ ID NO: 1679 - DNA, 58651 bp, Homo sapiens
ctctgcagcgcccctaccgacccgcgctccgcagctcctgagggctttcgagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggtaccacttcccagacctccagcctccccactgatgatagatacacaaaggtcatcttgtttctttatgaggcaatggattgtgttcacctagccgagttgttaagcataagagaatgtatgaaaagtaattacaaggttcaaaatcctgagctttgataaatgatagatatgatgatgagcacatgttagtgatattactgctctgcgggacgtctgaatcagtaattgctgtcttttaagcatctgttgtgtgccaaatactgcactaggcactttacgggcattgctcttgtttaagtcgtctggtcaaagttgcctagacaataaacagcagagcaaggattttaacccaggtacagctgacactgctgcctctatgcttagcagttaaactggtttttatgtttcttgtttgtacacccctccttcaccagtcacttgtagattcaccttgtgaagagctaattcttccctctaataataatactctttgaccatttactatatgtcaaaccgtattttaaggactttaaaggtattaattcgtttaatcttcacagcaatcctgtgagtaggtattattaataccttcactaagacacaggcttagaaaagtcgattaacttttccaaggtcaaacaaccattaaggagcagagccagattcaaacccaagcagacagaaccctgaacctgtgtttttaattcctgttttaaactgcctcggtagtacggtaagacttcattagcgctaggtccatgcctgtttgtgcaccattatttccctgacagccagcatggtacttgttcaatatttgaacatttgatgaatatttgaacactggaaaaggaaaaagcttaaaaatgaagtataaataatgatttaataaattccaaaagatatcaaattcaacaagattccatagttcagcctaatccgggcctgggagttagaaatattactctgtaaaaattgccttcaattaaacattgtattggaagttctggtcaatgaaataaaaaaagacaaatatataaaaggcatccaagttggaaaggaagttgtagcactgcatttatttgcataagaaaattgtggaatactacaaaaaagctgctagaactcataagtgagtttacaaaagttgcaagatacaaaatcaaatatacaaaaatcagttgtatttctatatactagcaatgaacaattagaaatggaaaatttttaaatatctcttatcagcaaaaaaaaaaaaaaaaaaaaaagcagcaaatttgggacaaatttgaccaaagatgagaaagacatgtatactgaaaactataaaatattatggaatagcaaagacatggaatcaacccaggtgcttatcaatagtggattggataaagaaagtgtggtacatatacgccatggaatactatacaaccacaaaaaggactagatcatatcttttgcagcaacatgaatacagctggaggccattgtcctaagcaaaataatgcagaaacaggaaaccaaataccgcatgttctcacttataagtaggagctaaacgttgagtacacagacacaaagttgggaacaataaacactggggattccaaaagggtagaaaaaactactattgggtactatgttcaccacttgggtgacctggatcattagaagcctaaacctcagcattgttcgatatacccatgtaacaaaactacacgtgtaccccctgaatctaaaataaaataaaaaacattgttaagagaaattaaagaagacctaaataaatagagatacattatgttcatgaatcagaagactgagcatttttaagatatcacttctgcctaaattgacctacagatttaaggaaattccaataaaaattctagcagatttctttttgatggaaatgaccaaactaattctaaaatttatatggagatgcaaaggacctaggatagtcaagactttcatcaaaaaaaacaaagttttgggacttacactacctgatctcaagacattataataagagctactcaacacagtatagtataggtatgaaaatagatagagtaatggaacagtatatagaacccagagatgtatctatacatatgtcatcaattgattttcgacaaatatgccaaggcaattcagtgggggaaaagataatcttttcaacaaataaacctgaaaaaattgaatagcatatgccaaaaaactcttaatatcttgctcctttcctcatactgtcacaggatccttggagtgttgctctgccagccagaaacctctgtggccggtggctcctttgcccgagttttgctcaggcccactgggctcattctgcccatttggccttgcaggctgcactcggctcatgccactggcccagatcccatgcctgccaaggacgagccaggcgcaaagtggtgaggggtgcgtgagcaagtgagcgcgaggtctggccgctgtgcacagctaggcacgccagctgtggcggggcgggtggctccaggtgctggcatgggcgctggctcctgcaaagctgtggctggaccaggagtaccacaagcggcttccactgctggcactagggaatgtggtggcacctggaagctttgagatgccaggaaatgcagagcccccaagagggtgttacagtcctggctcagggagctcttaggtctgggcttctcgaagtgtcaaagctcttctctccttctctcttctgtccttctcatcgcttgcaacatggggagtgagggggtgtttcagccctgtttgtgttacagttctttcagtcctgccatttggcaggtcccaagttgttgtcccacatccaggaataatgaggtatgcagacaattggagggtgagtagggtgaagaggtgctttattgagtgacagtatagctctcaggagactctaagtgggtagctcctttctgcaggcaggttgtccggttgtctgcccagctctcagctgagaggagacccacagtgggtggctcctttctgcaggcaggtcgtcaggatgtctgctgagccctcagcagagaggagatctggagtgggtagctcctacacgcaggcaggttgtccccatgtttcttgagtctggctgagcctaggatatttatgggctcaagagggaggaagtgcatgctgattggtccatgggcagtagaaaaagtgccataagttctcactccagtctgaggacctggcagcccagcccccaggcttcagactctcagttgcctaaaggtagggtttcactgaggacccacccctttttgcccaggagccagtctgcctcatgccactgtccatggcaccaaggctgtttgtgccagcgggagcctgcaggcccacactgagctgccctcagcgccccctcagcttcccctcccatgctcatcagtgtccaaagtccagagggggctgaggtggcagggggctggcatgtcagtgttgccccaagcatgcacacacctgccagattgtgacagcgtctgggcttggccacaactttgctctgccccagaagcagggagaggccagacagcaggagcaggcactttcaagcctgtgggggcaaggggcttcctgggcccctgagagcacaaggatgcccaggtccacagctgtggttgggcagctgcagctgtgcccaggagggtggggctcccaccccaccaactcagaagcaggtggggctccagcctgttcctgttttcatggttctgtggagtgtgcagccctggccaggcctccctcactgcagcttgcatctttgcagcagctgctccagacgggctgccactgccatcaatactatatgtaaaaattaactaaaaatggatcatacatctaaatgtaagagctaaaatcacaaaacttctagaagatatcttagtgaccttggatttctcaaagacttcttaaagatggcacaaaaagcacaaactataaatgaaaaaaaaaaaaaaggatgaattgtacttcatcaaaattaaatacttctgctttttaaaagactctgttaagaaaataaaaaggtaagccacaaacttggagaaagtatttgcgaaacatatatttggcaaaagacttctaactagaatacataaataactcttacaacccaataagaagacaacccaactttttaaaatgggcaaaatatttgaacagacatttcaccaaagatttataaatgacaaaataagtgcatgaattaataccattaatcattagggaaatgcaaatcaggaaaataataaggtttcactgtgcactgtagctactagaatggctaaaatttgaaagacagatcatatcacatgttgacaaggatgtggaacaacagaaattcttgtatactgcatgttggaaatgtaaaataatacaacaatttggaaaagagtttggctatttcttaaaaagctaaatatacacctaccacatgatctaaccattttactcctaggtatttacccaagagcaatgaaggcatatgcctacacagaggcttatacatgaatatacatagctttaactgtaataggcccaaactggaaacaaccaaatgtccatgagtaggtgaatggaaaataaattgtggcatatccacaaaatggaatattactaagcaataagaaggaatggttgattggtatacctcaacaacatggatgagtctcaaaataactattttgagtgaaagaagccagatcctcccccgcaataaaagagtacctgtggtgtgacgccattcatatacaattctaggcaatccaaactaatgtatagtgacaaaatgcagatcagtggttgcctgggaatgcgggagcagtgttgtggagatgggtgggagggtagtaccacaaaggagtgggaggaaactttttggagtgatggatatgttcatcttcttgattttaaatgatggtttcacagatgcatatgttgaaacttctcaactcgtacattttaatcatgcacagtttattgtatgccaattatacctcaataaacttgtttaaaaaagacatagctagttgaattttaaagggttttgtattgtggcctaaacagtcatgaaaagtgctctgcacaaattgccttcaactttgtaaaatagagccattactccttcttatatctcatggggagtatagtgaggattgacaaggaaaagactaaaagactaaaatatttaaaatcagtattaaattaatattattaatgacatctctagataccttctcatcacaacagctttcttcttcttacctttgcatgagcataatgaattaattagaatgtaaaacagaacaagacagtaataaagattatcttaaaaaacaaaatagaagagattagaaatcctctgtggaataggaattttgaagctactttgcagcagaataaggaaaactttatttttcttacatataaaaaagtataagaaaaatatttgtaggaaaccacatatataaatagtaaaagttatggaagaagaaacctctaagttttttataagaagaaggatcattttgccatgagtcttgtaatttgtaatgtatgttcagattttcatagttttttaaataagtattttccagttaaagaaaacacagaggctttgataaattctagtaaacatggtcctgtagtcaagatcaggaaaattggagacttttggaatggtatattttttcttccatttatttatttatttatttatttatttatgaggtggagtcttgctctgttgccaggctagagtgcagtggcacaatctcggctcactgcaacctccgcctcccaggttcaagagattctcgtgcctcagcctctcgagtatctgggaatacaggtgtgcgccaccatgcccagctaatttttgtatttttagtagagatggggtttcactatgttggccaggatgatctcgatctcctgacctcgtgatctgcccgcctcggcctcccaaagtgctgggattacaggtgtgatccactgagcccagcctggtatatttttttctaggaaagtatgtccaatgtctcctgcttttttgtaaggtcactaagcatctgtgttaggactgtgggaatatatgaggaagaccctgagtggctatggattgtaaacatttttaactttccgtatgtaattcataaaatcataaagttgaaaaaagactgcctaacaatcgcctggtccaatattcttcttttagaggtgaggaagctgagacccaaagatggaaagtgattcatctaaggggtacagagcaagttaattaaactgggttagaatccagatttcctggccactagtccagtgcttttcctaacaatacactactgcttttaattctgtcagtgtagaataagaggaacacctagtcacctaaaattaagacgaaagcttcatcattttctaggactttgaggcttttctatctcattgatttcttctttctggctgcttctactcaaactttgttctcagccttctgctcttattttttaaatgtttggggccggggggcggtggtgctcatgcactcacagctttaattttcaccagtgttgagatggtttccaaatctacattgccaattgttatctttcattggtgttctaatccggtatttccatatttacacataatatctctcataggaatgaatgtaccacagcaagggtgccttgatttccatactaaagtggcttcagaattccagcgtatctgtgctggtgtcagtcaatagcaaccgcaatagttcttggcagagatggcagagcctagagaattctgtggttgctggaggaaaaggcagcagtctccagtggacaagacatcatgtagagaagtagcactgttacttggtagatgccacctaggatattaccagggaatcagcagtagagtctggcagagtcagcagttccttgtgggtgtggcagtgcccagaagatatagaagcagtgcctagtaggggcagcagtaccagctagatgtggtgatacctagaggaaatagttatggaggaagatggacaaaacaaggggaagtggtcagtgtgcctagcgggagatatgatagtattcactggagtagaattagtggaattagtggagtagaccagtgggaaaacacttaatgctatgtggaaggtgatcacacttgcttgtgagcatatttgagtcacctgcttccagataaacctagaagtttgttgttctgcggggagcaggattctgctttaatcgattcagagaaaagttacattggtgcatcccaagccatcattctgggaaaggagaataaaagaagtttggatattacaacaaaaataattatctttgcccccatccatacttcatttatatcaggtaataaccctcagtgcagagttctctgagaaaactcttttaagcatatggcttaagcctggaggcctaagtaggatccacgaagagaaagatgcaacaggggctgagtccagctatctaactccatatgtggaatagaagtaatggtagaaagtggctaacctgcgtctagggcgcaagtcctgccagaggctgagacaggaagcagagaagtgagtgccatgaatgggtgctgagctttaaggtagctcagctaccttgaagtttaaggataacctcatcaatcaataaaatgtgtgtgcctaccattgaaagtcttggtctttgtcagtaggtttagcgactcctcttcctatgagtggggaattggaaaggggacatgaagaagtgggagcaaggatgggaatattctcttgcttatgttacagtccgaactgttccccagctctgattgtcaccacatgacttttttccttcatgcagatgcagattcctcagctttcccactgactactgaatgattattatgtcattttgtttgagtatattagtgctttgatctacctgcctcggggtttcaggcttggggcaagatctcttgcaggcaaagccttgcttctgtccaaatcaggatcaaatttgcctcttgcctctgcccagataccagtcaataccaagggtgagatgacatcatttctgatgcctactaatggtatgtgcctcatcccaccctcctttctggattgaccacccagacatattttccatgctggatcttcatatttaaacatcctctccccatatttttactacatagaaatttctgttatgttctttaacttgacggtatatctttgatacattattttactaatctttactaatggagaaaacataatatgattttaagatatttggttatgatactataacatcgtatcgatgttatataacatcaatgttttataacattgaagtctttgttattactgttatcatttatgatgttgactttgctgaaatgttgatcttcataggtaaaagaatatgcacagtggagtactgaattaggtcttttggtattcttttttttttttttttgagatggagtcttgctctgtcgcccaggctggagtgcagtggtgcgatctcggctcactgcaagctccacctcctgggttcacgccattctcctgcctcagcctcctgagtagctgggactacaggcgcccgccaccacgcccggctaattttttgtatttttagtagagacggggtttcaccgtgttagccaggatgatcttgatctcccgacctcatgatccgcctgccttggcttcccaaagtgctgggattacaggtgtgagccagcgtgcctggccagtcttttggtattcttaattgattttgtctttttttctatcacaaaaatattttcaacttcactgaaggcaaaattcaaacaaaataacagtggagtggtaaaatgagtctggaagttatcaaaaaggattctaattttcagaaaatgatggcaatctaaaattctgcactaaatgctaagaaagcgtcctaggcttcaaagactaaaatagaaatatagagaccaaggaatcaaatttttgccaatacttattagctttgttgttactgagggaactcaatttgtttttaattacccacagtccaaaacacactgcagtttagtttctctattaagataaatatcagtttgacttacagaagtgagtcaatggccaactcagagagtaaagttcaagtatagtagcctttatgcattcttctggcttgttcatagttgcattctacaccaaaataaagtattcaagaagaacaaaatttaagtggacagaaacagttagccctgtactgagtgaccttagcacttaatgcagataactggataaaggtataacttgcagctcatgaaatctcagtgaataaatgtatacatgatgaatgtatatacatgtattcattcaacatttactcacagcctactcagtaaatgtgctagatttacatatactacccaagtgctaagaatgcaaggaaaaataaaatatgtacacaattaacataatacaatgtggcatataacacagatgtgtaaacaaattttaaaaagaaagaatgagaaaaattcattaatgtgataggaggcagccttctaaaatggctcccaatgatctcctcatcttggtattcatgcccttgtataatcccttccacttaagcatgggctggacatagtgacttgcttccaatgaataaaatatggcaaaaataatcggatgtcacttcgaagattagatctaaaagattataactttcatcttgccagcacgcttcctctctggctcttcttgcttattgctctgatgaagcaaaccgctattttgtgagctgtcccaaaggggaggtttgctaggaaagaactgagggtagcctttggccaactgcaaacaaggaattaatcctgtcaacaaccatgcgagtgagcttgaaagttaattctattccagtcaaatcctgagatgactaagccctggaagacagttgaattgcagctttgtgagagaccccgaagcaggggacccagttacccatgcctggtttcctgatccacaacaatgttagataataaatgctgtaaaagtcatgaagtttttagataatttgcttttcaacaattgataactcatacaattaggaagaaaaggaaggtgattaaaatagaaggaatggcagttgcaaaatgagagggcatcgtacagattaaattctagaatggtaaatgaatttgtgtagccatagcatgaagtatccttgcaggaatgaataagatttgagaagaggattcaaggtcaaattgtaaaatgcactcagtgtcatttatttcactgttcccttacagaaaacttgccaactattttaaacaacaaaaaaaagtttaagacaggaaattaggtacttataaaattattggaagggctggagaaataatttctggtctcagccccaggaatgcctcccagagcaattatctctgaatgggtccactagggaagcttccgtctcctctataataagaaaagtggggaagcaggagatgcaactgtaataggtctgttgctcaatgtgcatgggaagtcaatatgccaagacgcaggggttgcagcagagaaagaggtttaatcatagatagggctgctgaacaaggagacagaaggaaacttcaaatctgtctcctcagaaaatttgaggctaaggtttttaagggtttcggagtgggccagagtatggaggtcattgactggtcaaagagtgcaggggaagtcatgtgacaggaaggtaaagaaatgatattctctctctctaaagaaaaggagggggcaagagctcattgaagaaatggttgattctagaaccagggcaaaataagatacaaaaaaagatacaaaataagaggacactggagcatcttatagtgccagaaagtagggaagtgcccaataaaaacacgaagaagggaatatgtcaaagggatacaggagcaaatggaaagagctcccaatagtcccaatagtcagtcttcgaaaaaattgagcaacaacataaataaaatagtattgtattattacctaaagtagaaaatattcttgagtccatactgatatgaataaattatttaaaaaataaattaatgagggggaatagatgaatctcctgtacaggaaaagcccaaataatttatgtagatattccacttttgaggaagcagagcataactcctttctaattaggtgtgggttgtgcatagtgacatcttttcaaagaatatggtatagagaagaataactttacagtggagaaacctgacaaacactacctcagccaggtgcttaaggtgaacatcagcagtgatagatcatgttgatataacatgatgaaaatggcactgtatttctgtggtcttccttcccaaaacatacagctccggtgtagtcataagaaaacatcagagaaatcccagctgagagctatcctatataatacccaaatagtactcctcagaactgacaaaattatcaagaacaagagaagtcagagaagctgtcatagccaagaggacacgtgatgactaaatgtaacgtggtgtgctgggtaggctattagaacagtaaaaggacattaggtaaaaactaaggaaatcagaataaagtatggacttcagttaataatagcatatcagcattgtttcattaagttacaaatgcaccatactaatatcagatattaataacgggaaactggtgtggatgtatgggaaatctttgcactattttcacatttttttggtaaatttattctgaaataagtttttttttttaaaaaagcaaatagtcttctagatgctaaaggaggaaatcttaaatcacatcagcaccgtttggaaatgtgggcatttcctgaggaacatagagagaggagagaattcctatttgattttagtattacgaaaaatgctcttagatcaaacttgaccttatatatagactattacaggagtaacccactaaattttacttattttaactagaaaatccaactaacaaagaagtgctttccctcctgtttagaggctatgatattacgattatataaatattaatatattggttttcatccacagttcctggctcataactcccagagtccttgttacagtcttttgttacaatgttgaggtgctttagggctcaggagcaggtctcaggaaacagaatctctctttttttttttttttttggagacggagtctcactctgttacctaggctagagtgcagtggcacgatcttggctcactgcaacctccgcctcctgggttcaagcaattctcctgcctcagcctcccgagtagttgggactataggtgcacaccaccgtgcctggctaatttttttgtattttagtagagacggggtttcaccgtgttgcccaggcttgtctcgaactcctgagctcaggcaatctgcctgcctcggcctcccaaagtgctaggattataggcatgagctaccgtgcccggccaacagaatctctttctctgaccttctcctgtcctccttttacctgctccaaggcaggactctaatctgattgtgggtcaaaagaccctcattgcagacagagtcctgccccataatctggaggatgaaaagctgcacagagaggccaaggagaacctgaacaggcaggccttgctgggcttcccaactcagtctattagtatgaggtcataccctttttgtccaatcacatttctacacagttgtcaatcatgcctatgtaaaaaacaaaaaggacagggtttggagagcttccggatggctgaacacatggaggttcctggaagatggcgcgggtatggaatctctgcaccccttcctccctacctggccctatgcatctcttcatctgtatccttcgtaacaacatttataacaaacctgtaaatgtgttactctgagttctgtgagcagctccagcaaattaattgaacccaaagagggggtcatgagaacccctacttaaagcgggttgtcgggagttctggaggcccagtcttgtgactggtgtctgtggagtgggaggcagttttggggactgagccctcaccctgtgggatctgacgctacctccaggtagatagtgtcagaatttaattagaggacacccagctggtgtctgcggcttgttgtgtggggaaaacccccttaccttttgtcattgagttcttttgttattgagttgatgactgttgtggtggtgtgagagcagaggtaaaacaaggctcgggagtttttctgaaacagaggcttaattttttttttttcaagcatgatatttattttttgtctttttttattattatactttaagttctagggtacatgtgcacaatgtgcaggtttgttacatatgtatacatgtgccatgttggtgtgctgcacccattaacttgtcatttacattaggtatatgtcctaatgctatccctcccccctccccccaccccacgacaggcccggtgtgtgatgttccctaccctgtgtccaagtgttctcattgttcaattcccacctatgactgagaacatgtggtgtttggttttctgtccttgtgatagtttgctcagaatgatggtttccagcttcatccatgtccctacaaaggacatgaactcatccttttttatggctgcatagtattccatggtacctgtgtgccacattttcttaatccagtctatattgacggacatttgggttggttccaactctttgctatctacaactagaaataccatttgacccagccatcccattactgggtatatacccaaaagattataaatcatgctgctataaagacacatgcacacgtatgtttattgtggcaccattcataatagtaaaacattttctttttggtgtgagagaccctcccattccttagtaaaaacgtatttacttgcatgttattattgtccttacaaacttgtttttccctagagcaattgattttgctttaggtactagctgaaggtctagaggcaatacaatttaggatccttgtctagaaatcaatatgattcaattcttttcaagccaaatgatatctgtagactccagttgtgtgcaagccctgtgtggagcctcaagtcatctgcgttagtccagcttcctattcttggaaatcagctttgcttgattggacctatattggcatgttaatgtttgatggtggcctggcctttataaaagcatacaattttgcagatgactccttctcaggatagagtgtctttgctcaaaggagtggatttattctgtgtgagccagggaggcaggcatgaagaaggggcattctgaaagggcagggaagatcctttgcaccagctgaaaatgccatcacgtggctctccacctgcctcttttgaagactggctgtggcgaggtggactgtaggtctgaagtggggagatctcttgcattcttccaatttctctttgttcagtggagaataaagaaaatttaaataaggaggagatttctagaccaagccctaactttagctacctgtgacattggtagcttcattttatttactctgtgaatgaagggtttagaggaaattattctggatccttctgagccttatattttctgaccctatgaactggctcaggtaggtctttgttgaggctggtgtctacatcaatgaggaggcagttctcaaagttctttagtggttctctttttctccttgtcattgccaacggatttaagatagattctgtgaagttgacacaggagtcctaagttgttttccttacttcacccctgttgtttgtgttaagtgtccaatctcaagcttgcatattggaatagtttacatttctatattgtcatttgcaagagaagcactgtggagtagggaaaggagcatgggctttgcagtcactctgacctttaccatttaactagacctgtgacctcagaaagtgatttaacttctctaaacatccagttttctaattaataaaaatggcagtaattatcctcacctctcagggaaagtgtagagattaaatgaggcaacatgtaaaatgactgtcacttagtagatgctccataaatcagccagcccacccttccttccttccttccttccttccttccttccttccttccttccttccttccataatcatggaagttacattcttatcagtatgtttgcacatgatatttgggctattgagtgattttatgtggctgggcagggttttctcctccccacttcctcctcctggatacggcacaaacctgtttaacaggagaaggtggtagcattctaatatgtagtagatgcccacaagatgggagatgtggtgtgggagatctgttttttttttttcagctaacacacagagggaagatcactacttaggcgctttccctcttttcttctttactccctgagaaatggatgaagctgataaagcttaaggactgacaaaccagtttcaaactcatagacctactggggcaggcaggtgatatatatgagggacgtgggctgggtgtgaagaaaaggccacagtgttacaaagttcataggaaagggcacctttactttggcatgagtgtgcaacagagagtcatgaggactgtggtgaaacaaaaagagcagaccccattgaaaggggacagctgctactcagtatcagataatgattgctatgagggaacatgggttctttacttccagatctttccatttttagagggaacccagaaatgtaaccatgtgaaatctcttgatttttaatgcctggaaatgaaatcaaattttaagattatactccgtgggccaaccggaaaagattatgccagcaggttgtggcatctgggccgaaggaaccacggagctgtggggtcactggtgaggggaagaagacaattagcagtctaagcgggagggaaagagaaaactagagaagcagggcggtcaaaagtgagacgaatgagccatcctggatctctggctccctggtgaattctgaaatggatggaaatggagggccagcatctctagtaaaggactgtttaatgtgtatgtacttggccaactcaaaataaaatgtttggagcatgaatagccccatatgatatatgctgtttggttgacatatgcttgtattttaacaaccaacattgtcccttttatttttgcaaacaatatgatatgatctggtcctcactttaattttacatgaaaggtataatgcatctacgtaaataagaaagcaaagaagttttctaaatgctttaattttttgtcacaaatatttctgcatctctcagtcccttcttgttggaaaaaggagggctagtgatacatttgttaatggcacttttaaaatgtgctttggtatatagaggtaacaatgtacttcttaggtatgttaataataaattaaggttataatggttgccatattagagaaaatgaataagattagtctcagcaaaaataaaaattagtttggaagtagataagctagaaatatcaaaactgaaaaaaatagcttcccagatagcgttctactatgtgcaattttttgaggaataatattcaattacagagtgtaataccttgcacagcacttgacatatagtagctattcagcaaatgtttgttgaattttattactttttaaacaaattactgagtaatcttccttagtaatcatttctgtaactcagataaaaatagaaatttataagagtttttatttttgttacttgtaaaagtatatttcctagagaaaatatcagcagtggtagagaccagaaaaagtaagtgtgtgtgttctaaacagtgattccaactcaatgtgttcagagaaaacactttgaccctgtctgtgtttacagtccctgctgacagtgtactgtcgtatcctcagccttgttctatttctttattttagctttacagagattaggtctcaagttatgagaatctccatggctttcaggggctaaacttttctgccattcttttgctcttaccgggctcagaaggacatgtcaggtgggatacgtgtttctctttcagagctgaagaaagggtctgagctgcggaatcagtagagaaagccttggtctcagtgactccttggctttcaacccacctagcctcagacagccaggaggcctttttaccactggatactgatgagatgttttaggtccttgcactttgcaaaactcctttctcccagtgggatattattaggacatagccaggctagaaaggccgtgggaagctttggaggtaggaggataggatccagacagggttacaataaggagaagggcattctctttggtgcactccatagtccaatggcagtcctgagctgattccagttaggaaccaagggtggactttcttctttggttctttggcccttttgatttccccagctggggcagggtaaggagcatgaaagaaaccagcctcaggtgtgtctcctcatttctgtctcatctaaacttcagcttccaggcatcgcacggtagttttgcttggactcttggactcttctgggtttttatcagttttctttgattcctcattagggttgctatcattggccttctcctcctttactactttggtttcgatcatttccttctgctgattcttgtttgtaaaagggaaggccttcacatacctttaggcagaaacatgaaattaaagtgagagactctcacacataacgatagataacactttttggccatggtacatattggcacagtacactggatacctttatttcagagtgatgccagcacatgcatgctctaatacattaagacatcaccaccttaatggattcatttaaattggacaatatgtttgcaggccagactttaggctgaccacataactcttccaacaaaaacaaagaaccaaaaatcaaataaagcatataaattttccccagatgtcaattttttttaatttcttgattttcaaaggacagtcattgactgatggctggacgacatgcatgtcctgaaatagaaaagattgggctgaagggaaagagatgagatgagggagaaatttatatcagaggactgctatctccattttgatcagcaaaatgccaacagtgaccctgaaaaagcacaggatagaaacatgacaaagattacaagactagcagtgcaccaacaaccctaccttttgacatagcaaaatccaagaccagctgcagcaccaaagaagaggagagcaagcactagcagagccgtggggacacctgcaaggaacagagacaaggcctgttggtccttcacttaaacattgtgtgtaatgctcattgcatgatccaggtgattgagacagtagacagtacaggagaaaaaccttctctgtagccctttatgatattgggcccacaccagcttctttgcttcatgcttgtagaatcattggccttgcttctcacactctcaattctatcagttgcaatatgacagagttcatttctcctccatggccttgagacctactctagtcaacaagcctgcctgagaaagagatgactagaataaagtcataggcctttagggtatatattttaaaaagaacttatgcataggaacagatagtgatttatttttaaaagtcttgagttttcaacagtgaaattcttttatacttacactttttagcttaatcactaaggttctttacagctctcagattctatgacttcatgaaagttgagtttgtgttaagcttttattagtatttgacaggtcctgagcgcctcatctaaagacaggcaggattctatgaattatctgttatacatgaacatacatacacacgtaacatagacacagaaaccatttacctccaaacccagcagcttcattcttgaatgctgctttattttcaacaaatggttcagtttctgtagacatggtgctagtttccataaaaacttctgtgacacaaatcaatttttttctccgtggaatagaagtggaagctggagcaggaggagtagtagtaggggcaggtattgtagagtaaggggatgccaccgagtaggtactgtcactgacaataaattctgttgtttgtgttgcagtttgagtgttgaatatgggatctttggtggtgataatttctggaatgcacgagttagtccaagtatctgttgggatagggaaacatggaataaaagtattgcaacagcctcctaactgttcttcttgcctctagtcttactacctccaaaccccttataccgcagctggaatggtctttaaaaagcaaatctaaccatatcactttcttccttagaagccttcagtggctatctttgttgtatggcctacaaggccttctgtgatttggcccctgctaacatgccagcctcatctgctctttttctctcattgcccctgccatactgaaattacttgaaattccttgatacactttatcttacatccaagccttgcaccacgatgctttattcacctttatgactctttgcctctctttatttagcttactctgactcatccctcaggtctcagattgaccctgtctttctcaggcagacttgttgacttgattggcatatgttcttgtacttccttgtcacagttctcattacactgttccccactggactgcaagctctctggcagcagaaaccccgtctgtcttggtcagcatggtatgagcactgtgtgtggtacatagcacatgctcaataactatttgatgaatagggaaggaaggaaaagggaaaggaaggaaagtatagattggaagaccaaatatacacatgtggtgtcacttcaggacaaagatatgctaagacctgatatttctgggctcattaaaaaaagaagtgaacaaaaagggaccaggagagggataagggtttgctttccaatctgttgcatgtgctagagaggaaacacttgttaaagcatcttaatctgagttgaccatggcagtaagtgtttaaataggtatctcattgaacaatattactaaacccttgtttacacaggaggaaactgaagtttagagaaattgaataactcgcccaaagtcacagagctagtaaatggcagagccatgcaatatattataatataaatttgcatctattttaagtccctaattatttgtggcagtgggtagcatcagctggggttggggggtgggctagcagagggatagcattagaagaaatacctaacgtaggtgacgggttgatgggtgcagcaaaccaccatggcacatgtatacctatgtaacaaacctgcacattttgcacgtgtatcccagaacttaaagtataataaaaataaaataataaaataaaattatctctggaaaaaaagaaaagaaatacatgggatgggagtacaagttaaatgaaaccatgaggaaatagacaaatccaagtcctcttcctctggctcttctctgtttagtcagagggctgggtatcatcacattgccagctggcaggaaggcagttaaaaagcaaagccatttgacaggcatgggctggctatgaggtatgcaggcatatgtagctcaccaattccccagccagtgatgatagaccaaagaggcagagaagggaaggaagatgggaaatacactgttaggagaagccctatgtttcagtcttgattctgccactaactgaccgtaggaccttgaacaagctaagcccgtgttctgaactgtagttgtttcatccatgaagtgagggaactggtcaaagtttctccatgggccttttctgtgccaaagccctctggatcagggaactacttggatcctatattgcctttctgggacagtttttgctaatattggctggtgcacatttatctctcggatcttcgagaatgatcttgaaatctatcctgtgtatgacctctcagccacctaaccttcagaaggtcagatagatgagtatgtgtgaaaagtaataatcagacaggggtccttatgacaaactgagagcaagtgagtatttagtaaaagaaaaactttaggagaagtacttaggtgaagcacttgggctaaggcagccaaggtcttcaagcaaggttagtgggtgacttcatgaccacgaacaaatcagtgctgccctccaggtgtcaatcttttccttcataaagtggagactgggtctggttcttaaaattataaaggaatgtggaacagtggaaagagtgcggtttcagagttagacctgagtctgaacctttacagtaatgagacgttagacaaatgtgtttacatcctttgaactcggtttctttttttttttttttttttttttttgagacggagtctcactctgtcgcccaggctggagtgcaatggcatgatcttggctcactgcaagctccgcctcctgggttcatgccattctcctgcctcagcctcccgagtagctgggactacaggtgcctgccaccacgcctggctaattttttgtatttttagtagagacggggtttcaccgtgttaggatggtctcaatctcctgaccttgtgatctgcccgcctcggcctcccaaagtgctgggattacaggcatgagccactgtgcccggcctgaactcggtttctttatttgcaaagtggggatgataaagcatatctcatagggatctgtagattccatataggtggaagcaaccaaccttggattgaaaatatttgggaaaaaaagaaaaataacaatacaacaataaaaaagcaaataatacagtacaatgactgtttacatagcatctacattgtattaggtattataagtagtttagagatgatttaaagtgtacaggaggatgtgtgtaggttatatgcaaatatgaccccattttatatcagggacttgggcatctgtagatttttgtatatgatggggtgccggaaccaatctcccactgacactgagggacgactgtgcatcactttgtccataatggatgcattacatacatctgtacctttgttccttcccttctgcctgcttatcttataggatgcagggatggtggcagtggtaattgagcctcctgaatgtcttctcgtgtgttgccattcagttatatctctcctaactttttcctttgaggggcatattgccacccctagcctggccagagagacagtgtcgggagaattagatggccgtggctgtgattgcttctgctgctgctcagggttactcttcccagacaggtctcagagtgagagatacccagagaatgccacgtggaaaggttgcagatcagactcaccagatgagttgtaacaataggctgcaaactgtcggctcactggaaccttccaaatcaggacacccaccccatttttcccacacttggggtttgggctaatcctagagatgaccacgaatccatctccaacccagccatagctgtaaaagaatacacactagttgaacagaaaaatgattagaaggcttcatctctattgctgaacaagaacacagagctaaaaaagaactccagcagtgacagtgaaaccagctttttctcacctgcaagtttcaaagctagctttcaaggctgtttcaacttggtccttgccggccaaacttagtcccagcagcctacaggcctccttagcttctgtgaaattcagctgctggttcgcctttttgctcacaagggtgatccccataattctgcatgacacctggatggaaagctctgcaaaggaatcacataggtcctcagtttgctgctgtccttgtttccagcccttagactctccttcccagcagagtatatcgtcctgatgcgcagggaggtctatctggctgggactggggtttagaataacaggacacagaccaggcattttccacaaggaccatctgctgggctagatggatgcttgttcttgtccaagctgtaaatgtcgcccaatcaaaatctatcccatcccactgcattaagatgccttgctcaccatataggggctttggctacctgttgttggggtgcagtctaagggatgcagttactgcaaacctttctggagtctgtaaaatgaagcatctgagactttgagaaagatagaattcagggctctagttcatagaatagttagcaataccccaaaccaatgtggtttggggacactactatttgtgagatgggctgaaaatgtcacacttgttataaaagaatgtgagtgctctcagttccaggtcttttggccactgggggacaggcttactcagaagttcctggaggagctggcagtaaactttgaatggcagaaaaactaaatgaagaaagcagaattttagagtcagacttgggcttagatctagcatatgtcatttgctagctctgtgaccttagcctagatacttcatctctttaatcttcagctctttgagcctccttgtttataaattcaagggagtaacagtgtctactgaatagggtagtgaaagttaagtgagtaaattctaatacaaatgtttagcatagtgcctgccacatggtaggtgcttaataaatccacataacattatcattatcgttaaagcattttggttttggtctgctaatgattgattaccccacagaagctgaggctgttgaataggtaagatatgaataatatttctactcaaaatctaatggatttgggaattcttttgaacccttttctctgggttctgggatgtacagacctgtataaaattgccaagttgtattgtattcaaatacattattcctactgggcttcatccacaaacatccataaaagggcatttaaatctctcaagtaattgcttgtacgcagctctgtgtattggatgctcagtcaaatgctttgaccacttcctaggttgatatctaatggaagtttctttttgaaaacatggaaggagcatttctaagtcctccatatgaaccttgctgtggtggcagattaggagcacacactcaattatgcctgattctaaaaccccagttcctcttttttccttcttctttcccaagagatggatcttgctatgttgcccaggctggtcgtaaattcctgggctcaagcaatcctcccacctcagcctccctgagtagctggaactacaggtgtgcaccagtatggccaagcaagaaccccagttctttttttttttttgagacggagtttcactcttgttgcccaggctggagtgcaatagcgtgatctcggctcactgtaacctccacctcctgggttcaagcgattctcctgcctcattctcccaagtagctgggattacaggcatgtgccaccaaacctggctaattttgtacttttagtagagacagggtttctccatgttggtcaggttggtcttgaactgccgacctcaggtgatccacccaccttggcttcccaaagtgctgggattacaggcgtgagccactgtgcctggcccttttttttttcttttttgagacagagtctcgttctgtcacccaggctgcagtgcagtggcgtgatccatgctcactgcaacctctgcctcccgggtccaagcaactcttgtgcttcagcctcctgactagctgggactacagacgcgagacaccatgcccagctaatttttgtattttttgtagagatggggtttcaccatgttggccaggctggtctcaaactcctgacctcaggtgatccacccacctcggcctcctaaagtgctgagattacagtcatgaaccaccgtgcccaacccggcccccagttcttaacaatgacactgttttacctttcacagtgctataaggaaatgaacacacacagacacacacacacccctaggctgaactccctgaacacaccgtttgctctgaaatttggctcttttagctcatgagcttgctattgctcaggtctcttatagctacttctttgggaatggattgcagaggtttatttgtcacattatcaattggtcttactaccctctcatcatatgtcatttgtactctaaatactattatttagaggagtgatagacttattctaggtggatagacttagctttgaatattttttctattgttaactggctgttgcgacatcaggcaagtcagcattctcatctgaaaatggggatggatatatcttcttcacatgatttttatcagaattaaattagataacttgtacctagcagaggcggggcccagtaggaagtcaacaacattagtcattttatgctttcctatttcatttagggatcaaaagagggagctggaatttaagggagtactccagtaactccttccttaagatttctcaggaaacagcaaacatagtagaaatagtgtatgcttaggagttagatataaggatgtggaatcagataatagcatatgcttaggaatcagatagggctgaattcaaacccaatatttattatgtactgcctgcatgacattgggcaagtcacttcacctataaactgtctttttgagaggattaaatgaaattgtatatacacacctagctctggatcactatatacttggccctcaaatatagttcccacccctattcacttaccttcatcaactactttattctgcagtcatggttatgctgacttttggttgtttccaaaaatgtaatttccctagaaaatctttttcccttgctgaggatagtccagagtgtgatggagtcattttcaaaaaacagtgtccaatagtttgaataatggcagcattgtggggaaaaatagtctccccagaggatttcaaagaggaccaaacttatttgaaagtaacagtattttaaaaaactaatcatataactctgacctttcttataaaatgtaatgcaacaacatataaatcaactctgaatgtctgtttctagcatattttatatctcaggtcatcttccagcataggaacacacattttcctattaaagtgctcagattttcatttgcccagagctgcaatgagtgatttgtggttacaatttttttgcctacagtgcaaaatgaggtttccatttaggcatctcaaaagcccagcgatcactttaagtcattcctttagtagacagccgatggcttaattttcaaacttatatttttacagatttttttcagctaatttgctatttactgaatatttttttaaaacattgcacctcattcatggtatgataaaatcaaaattaaaataattatgctaacactcccaaaaaacataaaaacaggccaattttagtgaaagttacccattattcccaagcttagtgattgctttaaattttttacaatcatggtttgcgtcttcaatgaaatacttaaaaaaaaattattacttctggatgcagtggctcatgcctgcaatcccagtactttggtaggctgaggcaggacgatcacttgaagccaggagttcaagaccaggctgggcaacaaagcgagatcccattgctacaaaaaatttaaataccacccatacaaaaaagagtaaaaatcaaatggtttctcttcagtgttttatttcaaaatgtcctcattaaaaatattccataaccaaaagtaaaagtccagatgatacaaacgtaaatgtcaatcattttggtgaagttgacaatatggtggtacatttttggcagagcagtaccaccaattagacctgctgttgacactgagggtcaccctcattcccagaaatccatagtcaacagcttaggaggcttaggactgaagccttgcttcagtttggaaatctggtgagaaacctaccttctgcacgcaaagagccttggaccaggagcctcgtggtccagatggaagtgagaagcaacaccaggctgaagcacctggccatcgtgcctaccccttcagagccagggaaacacctcagatggccactggtgatatgagaggcagatgctcaataactagtccggatggagagttctggaactatgttgaggctcacactcactgctccacttcataaccgagacatccggatttccctgctttcaagcttctgacttgtcaaggtcactgggggaaatgaatgacgtcccttgaacgcccaggctgtactttgtggatggccttctggaaaatttagctaatgctgactcagaaaacacacaaatgaggaaggcagatagcacagtgtgaactgctaaaggttctcccaattcccatattccctgctgttcctcctcccccagcagctcagttctcacaccattcactgttactgcctgtggagtccatcgtttatgtactcctagaaacatctctgtccctaaaggagactgagcataggttgtgcctcttttcctcccgcaatcagtgatttttccacccagctgttcggccttgtgatctgcagggtatgatgctgaagctcatgaaagtaaatgtccacttaaatactgagtctagaaccttctgccttcctttgagtctccttttacacatttgaaatctctacaccactacaggtgattcctttttcaaagaaaccaggcacatataaacattcacatttacataacacaagtaggagggcaatttacaaaattaaacattttacactttccccaaggatttttaactttacaatagtaatcaccacaggggtcttttatgaaataactttctcttaataactcctttcatattctggtaggccagaattcaagtcagactccacctttgttgttcgatgaacatgaggtttatctgtgctgtgtaccagcagagtgtattctatgtttttccagccggattttcagtggtttttgcttcatggtaattatggagttctggcttgtaagcaatgtcttgggcaaaggtttatgagatttttccaaaatgaatgtcttttataggaaaagtatatggataacgaattcttttttatataagtggtactggtcataaagttagatatttgtgtgaaaaatatcaataacaaaaagagaatctgctctaaacaaatgcagggaacttctaaaagaccagggtaacagcccttacacatctccaataccgacctcatgatctgggtgagcacaagccccagtttctcagaaacatgcatgactctatcatcacagcaccagggaggcagacaggcagagtcctggcctcttcatgattattcttaaagcctaacaccatgcccgaaagagagctagctttctagcatttgttcacttattgcaaaaagaacgaaggaagacaggaaggggaagaatgaatcagggaaggcaaggctttgtgtcaaggaggagaatgagagtcacagtgatcaccagccatagaatttctggaataccaatgaagaggccttagaaaggtcgctgtgccagctttctattgctgtccaacaaattaccatagacttagcggcttaaacagtactcatttatcatttaacagcttctatatgtcagaggtctgagtgggctcagttgggtcctctgccctgggtctcacgaaactgacattaaggtgctggctgggctgggctcttacccagaggctctggggaagaatccacttcgaagcacatttgggttgttggcagaattcatttctttgaggttgtgggaatgaggtccctgtttccttgcagggtgtcagccagggaccattctcttctcctagagcccttccattttcaaagcagcaatgacacactgagtccttctcatacttctagtctctctttcacttctacagttagccagagaaagttctctgctcttttaagagacacggtcttgctctgttggctggagcgcagtggcgccatcgtgactcactgcagcatctacctcctgggctcaagcagagctctctactttttttttttttttttttttttttgagacagagtctcactctgttgcccaggctggagtgcagtggcgtgatctcagctcactgcaagctctgcctcctgggttcatgccattccttgcctcagcctcccgagtatctgggactacaggcgcccgccaccacacccagctaattttttgtatttttggtagaggcagggtttcactgtgttagccaggatggtctcgatctcctgacctcatgatccgcccgcctcagcctcccaaatgctgggattacaggcgtgagccaccgcgcccggcgagctgtctgcttttaagggctcatgggcccacctggataacctccctatcttaaggtcaactgtaccatctaatgtaacacaacaaagctccatacccctggagctcctattcaaaggctccagggattagggtgggacatctttggagggctattctagaaattctgccttccacagtcacttaaccttgatttgattctgatctgctttctgagagaaacttccacatccactgttttctgcggccctttgcatccctctgggagattcatttgcatataatcttgcttgtccacatttgaagtggatattagggagtatgccttccttgggaatagcacagcttttgcagtctgcttcctgccggcataagctaagatcccaaaagttttcttaattttaaaaaaattttatttttaatcaatacataattatacacatgtacattttgatgtttccatacaaacaagatgtagtgatcagatcaggctaattagcatatccatcatctgaaacatttatcctttgtgttgggggtgttcaatatcttctcttccagctatttgaaaatatgttattgttatctatagtcatcctatagtgccataaaacactataacttgttcctcctaattttatgtcctttaacaaatctgtcttttcctcctctcttccctttccagccactagtatcctctattctgttttttacttccatgagatcttttgttagcttccatgaattagaacatgtggtgttaactttctgttcatggcttattttacttcacataatgacctccatttccatctatgttgctgtgaatgccaggatttcattttttacggctgaatactattccgttgtgtatgtacaccatgttttctttatccactcatctgttgctggacacattttaataccatatcttggcgattgtgaatactgctgcaataaacatgagggtgcaggtatctctctgatatattttctttcctcctcaaagctgtttcctcacctgaacaatgaaaggggtttttagtcctggcttgtgtttctttgtaaattccctcacaaagttagatttctgcttccatgtgccaataatcataccccaaatcctttcccagtcataattctcaagaagtatttcctgtttctcagcaccatacccctcaaatttagtggtgaatacactaagttcatttgaactcacaaagggccacatccttaatctagcctttgccataaggctgagtcgatctgttcaactgagaaattttattggctcccactcaaagctctttttagtctgtctgggatttagaagtggtcaggttttctcacccttcaatctttcacatttctgaatactctatattctttttcatttttgctcccacatagccaattatttctcctgccataccttgccaaaggcagccaagagaagtttccataccccaacgctgattctttccaccacttataaataggctaaccatgagatgctttccaagttatcacaggtaagactttactatcttaccatctttctagcagttttgtttcttgccatgtaactggtaagctagaacctcatattttggaattttgctattaaagtacacaatttctggttcaaatgtatgcattagggtaggctaactgctataaacatcctggaatctctgtggcttaatatactaaaatcttatttcttattcatgtcacagttcaatactgggagtgctcattcaaagacccagcttccgtctagtggttctgccattttctcgggtctcagtgttctcatctgaatcctctggctttggtaggcagagaagggagtaaaaaaaggtgtgaagtattgggcaggagagtttatttttagggaactagatttggaaagtccacattcccctgcagctagctgtaagaaagacaaaaatagttcagctgtggaaatcaggttggttaaaaactcagcagactcaatcacagcaaactgtgttaattaaaaaaatcatagaccaggaagatacaggaaaccaggatcaggaatggggaagggaagaggaggaactgatccagcccctgtgaggtagcccatagtataacgaccaagggttggggacctctgacttggttctggaatgcactaatatatccaaaggcatctaattctgggttggggtaagactgtaattcaactccataaaatgaggaggcatttggctgctgccagaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaactta

SEQ ID NO: 1680 - DNA, 58694 bp, Homo sapiens
gccccgccccccgcgcgttgccgggagacggcgcccaaccttcctctgcagcgcccctaccgacccgcgctccgcagctcctgagggctttcgagcccagatggtcatctgagacgagaggtggcggcgaaggagagtctcgcctgtcacgctcccggagcaggggcttcatgaggtggccatggaaacagcctggcagactcccatctctcctggtgccatctccggagcggaaagtggagcgccccgctggcgaccaaggccgcactgagagccctggtttggtcaacagttgggctccaaggtaccacttcccagacctccagcctccccactgatgatagatacacaaaggtcatcttgtttctttatgaggcaatggattgtgttcacctagccgagttgttaagcataagagaatgtatgaaaagtaattacaaggttcaaaatcctgagctttgataaatgatagatatgatgatgagcacatgttagtgatattactgctctgcgggacgtctgaatcagtaattgctgtcttttaagcatctgttgtgtgccaaatactgcactaggcactttacgggcattgctcttgtttaagtcgtctggtcaaagttgcctagacaataaacagcagagcaaggattttaacccaggtacagctgacactgctgcctctatgcttagcagttaaactggtttttatgtttcttgtttgtacacccctccttcaccagtcacttgtagattcaccttgtgaagagctaattcttccctctaataataatactctttgaccatttactatatgtcaaaccgtattttaaggactttaaaggtattaattcgtttaatcttcacagcaatcctgtgagtaggtattattaataccttcactaagacacaggcttagaaaagtcgattaacttttccaaggtcaaacaaccattaaggagcagagccagattcaaacccaagcagacagaaccctgaacctgtgtttttaattcctgttttaaactgcctcggtagtacggtaagacttcattagcgctaggtccatgcctgtttgtgcaccattatttccctgacagccagcatggtacttgttcaatatttgaacatttgatgaatatttgaacactggaaaaggaaaaagcttaaaaatgaagtataaataatgatttaataaattccaaaagatatcaaattcaacaagattccatagttcagcctaatccgggcctgggagttagaaatattactctgtaaaaattgccttcaattaaacattgtattggaagttctggtcaatgaaataaaaaaagacaaatatataaaaggcatccaagttggaaaggaagttgtagcactgcatttatttgcataagaaaattgtggaatactacaaaaaagctgctagaactcataagtgagtttacaaaagttgcaagatacaaaatcaaatatacaaaaatcagttgtatttctatatactagcaatgaacaattagaaatggaaaatttttaaatatctcttatcagcaaaaaaaaaaaaaaaaaaaaaagcagcaaatttgggacaaatttgaccaaagatgagaaagacatgtatactgaaaactataaaatattatggaatagcaaagacatggaatcaacccaggtgcttatcaatagtggattggataaagaaagtgtggtacatatacgccatggaatactatacaaccacaaaaaggactagatcatatcttttgcagcaacatgaatacagctggaggccattgtcctaagcaaaataatgcagaaacaggaaaccaaataccgcatgttctcacttataagtaggagctaaacgttgagtacacagacacaaagttgggaacaataaacactggggattccaaaagggtagaaaaaactactattgggtactatgttcaccacttgggtgacctggatcattagaagcctaaacctcagcattgttcgatatacccatgtaacaaaactacacgtgtaccccctgaatctaaaataaaataaaaaacattgttaagagaaattaaagaagacctaaataaatagagatacattatgttcatgaatcagaagactgagcatttttaagatatcacttctgcctaaattgacctacagatttaaggaaattccaataaaaattctagcagatttctttttgatggaaatgaccaaactaattctaaaatttatatggagatgcaaaggacctaggatagtcaagactttcatcaaaaaaaacaaagttttgggacttacactacctgatctcaagacattataataagagctactcaacacagtatagtataggtatgaaaatagatagagtaatggaacagtatatagaacccagagatgtatctatacatatgtcatcaattgattttcgacaaatatgccaaggcaattcagtgggggaaaagataatcttttcaacaaataaacctgaaaaaattgaatagcatatgccaaaaaactcttaatatcttgctcctttcctcatactgtcacaggatccttggagtgttgctctgccagccagaaacctctgtggccggtggctcctttgcccgagttttgctcaggcccactgggctcattctgcccatttggccttgcaggctgcactcggctcatgccactggcccagatcccatgcctgccaaggacgagccaggcgcaaagtggtgaggggtgcgtgagcaagtgagcgcgaggtctggccgctgtgcacagctaggcacgccagctgtggcggggcgggtggctccaggtgctggcatgggcgctggctcctgcaaagctgtggctggaccaggagtaccacaagcggcttccactgctggcactagggaatgtggtggcacctggaagctttgagatgccaggaaatgcagagcccccaagagggtgttacagtcctggctcagggagctcttaggtctgggcttctcgaagtgtcaaagctcttctctccttctctcttctgtccttctcatcgcttgcaacatggggagtgagggggtgtttcagccctgtttgtgttacagttctttcagtcctgccatttggcaggtcccaagttgttgtcccacatccaggaataatgaggtatgcagacaattggagggtgagtagggtgaagaggtgctttattgagtgacagtatagctctcaggagactctaagtgggtagctcctttctgcaggcaggttgtccggttgtctgcccagctctcagctgagaggagacccacagtgggtggctcctttctgcaggcaggtcgtcaggatgtctgctgagccctcagcagagaggagatctggagtgggtagctcctacacgcaggcaggttgtccccatgtttcttgagtctggctgagcctaggatatttatgggctcaagagggaggaagtgcatgctgattggtccatgggcagtagaaaaagtgccataagttctcactccagtctgaggacctggcagcccagcccccaggcttcagactctcagttgcctaaaggtagggtttcactgaggacccacccctttttgcccaggagccagtctgcctcatgccactgtccatggcaccaaggctgtttgtgccagcgggagcctgcaggcccacactgagctgccctcagcgccccctcagcttcccctcccatgctcatcagtgtccaaagtccagagggggctgaggtggcagggggctggcatgtcagtgttgccccaagcatgcacacacctgccagattgtgacagcgtctgggcttggccacaactttgctctgccccagaagcagggagaggccagacagcaggagcaggcactttcaagcctgtgggggcaaggggcttcctgggcccctgagagcacaaggatgcccaggtccacagctgtggttgggcagctgcagctgtgcccaggagggtggggctcccaccccaccaactcagaagcaggtggggctccagcctgttcctgttttcatggttctgtggagtgtgcagccctggccaggcctccctcactgcagcttgcatctttgcagcagctgctccagacgggctgccactgccatcaatactatatgtaaaaattaactaaaaatggatcatacatctaaatgtaagagctaaaatcacaaaacttctagaagatatcttagtgaccttggatttctcaaagacttcttaaagatggcacaaaaagcacaaactataaatgaaaaaaaaaaaaaaggatgaattgtacttcatcaaaattaaatacttctgctttttaaaagactctgttaagaaaataaaaaggtaagccacaaacttggagaaagtatttgcgaaacatatatttggcaaaagacttctaactagaatacataaataactcttacaacccaataagaagacaacccaactttttaaaatgggcaaaatatttgaacagacatttcaccaaagatttataaatgacaaaataagtgcatgaattaataccattaatcattagggaaatgcaaatcaggaaaataataaggtttcactgtgcactgtagctactagaatggctaaaatttgaaagacagatcatatcacatgttgacaaggatgtggaacaacagaaattcttgtatactgcatgttggaaatgtaaaataatacaacaatttggaaaagagtttggctatttcttaaaaagctaaatatacacctaccacatgatctaaccattttactcctaggtatttacccaagagcaatgaaggcatatgcctacacagaggcttatacatgaatatacatagctttaactgtaataggcccaaactggaaacaaccaaatgtccatgagtaggtgaatggaaaataaattgtggcatatccacaaaatggaatattactaagcaataagaaggaatggttgattggtatacctcaacaacatggatgagtctcaaaataactattttgagtgaaagaagccagatcctcccccgcaataaaagagtacctgtggtgtgacgccattcatatacaattctaggcaatccaaactaatgtatagtgacaaaatgcagatcagtggttgcctgggaatgcgggagcagtgttgtggagatgggtgggagggtagtaccacaaaggagtgggaggaaactttttggagtgatggatatgttcatcttcttgattttaaatgatggtttcacagatgcatatgttgaaacttctcaactcgtacattttaatcatgcacagtttattgtatgccaattatacctcaataaacttgtttaaaaaagacatagctagttgaattttaaagggttttgtattgtggcctaaacagtcatgaaaagtgctctgcacaaattgccttcaactttgtaaaatagagccattactccttcttatatctcatggggagtatagtgaggattgacaaggaaaagactaaaagactaaaatatttaaaatcagtattaaattaatattattaatgacatctctagataccttctcatcacaacagctttcttcttcttacctttgcatgagcataatgaattaattagaatgtaaaacagaacaagacagtaataaagattatcttaaaaaacaaaatagaagagattagaaatcctctgtggaataggaattttgaagctactttgcagcagaataaggaaaactttatttttcttacatataaaaaagtataagaaaaatatttgtaggaaaccacatatataaatagtaaaagttatggaagaagaaacctctaagttttttataagaagaaggatcattttgccatgagtcttgtaatttgtaatgtatgttcagattttcatagttttttaaataagtattttccagttaaagaaaacacagaggctttgataaattctagtaaacatggtcctgtagtcaagatcaggaaaattggagacttttggaatggtatattttttcttccatttatttatttatttatttatttatttatgaggtggagtcttgctctgttgccaggctagagtgcagtggcacaatctcggctcactgcaacctccgcctcccaggttcaagagattctcgtgcctcagcctctcgagtatctgggaatacaggtgtgcgccaccatgcccagctaatttttgtatttttagtagagatggggtttcactatgttggccaggatgatctcgatctcctgacctcgtgatctgcccgcctcggcctcccaaagtgctgggattacaggtgtgatccactgagcccagcctggtatatttttttctaggaaagtatgtccaatgtctcctgcttttttgtaaggtcactaagcatctgtgttaggactgtgggaatatatgaggaagaccctgagtggctatggattgtaaacatttttaactttccgtatgtaattcataaaatcataaagttgaaaaaagactgcctaacaatcgcctggtccaatattcttcttttagaggtgaggaagctgagacccaaagatggaaagtgattcatctaaggggtacagagcaagttaattaaactgggttagaatccagatttcctggccactagtccagtgcttttcctaacaatacactactgcttttaattctgtcagtgtagaataagaggaacacctagtcacctaaaattaagacgaaagcttcatcattttctaggactttgaggcttttctatctcattgatttcttctttctggctgcttctactcaaactttgttctcagccttctgctcttattttttaaatgtttggggccggggggcggtggtgctcatgcactcacagctttaattttcaccagtgttgagatggtttccaaatctacattgccaattgttatctttcattggtgttctaatccggtatttccatatttacacataatatctctcataggaatgaatgtaccacagcaagggtgccttgatttccatactaaagtggcttcagaattccagcgtatctgtgctggtgtcagtcaatagcaaccgcaatagttcttggcagagatggcagagcctagagaattctgtggttgctggaggaaaaggcagcagtctccagtggacaagacatcatgtagagaagtagcactgttacttggtagatgccacctaggatattaccagggaatcagcagtagagtctggcagagtcagcagttccttgtgggtgtggcagtgcccagaagatatagaagcagtgcctagtaggggcagcagtaccagctagatgtggtgatacctagaggaaatagttatggaggaagatggacaaaacaaggggaagtggtcagtgtgcctagcgggagatatgatagtattcactggagtagaattagtggaattagtggagtagaccagtgggaaaacacttaatgctatgtggaaggtgatcacacttgcttgtgagcatatttgagtcacctgcttccagataaacctagaagtttgttgttctgcggggagcaggattctgctttaatcgattcagagaaaagttacattggtgcatcccaagccatcattctgggaaaggagaataaaagaagtttggatattacaacaaaaataattatctttgcccccatccatacttcatttatatcaggtaataaccctcagtgcagagttctctgagaaaactcttttaagcatatggcttaagcctggaggcctaagtaggatccacgaagagaaagatgcaacaggggctgagtccagctatctaactccatatgtggaatagaagtaatggtagaaagtggctaacctgcgtctagggcgcaagtcctgccagaggctgagacaggaagcagagaagtgagtgccatgaatgggtgctgagctttaaggtagctcagctaccttgaagtttaaggataacctcatcaatcaataaaatgtgtgtgcctaccattgaaagtcttggtctttgtcagtaggtttagcgactcctcttcctatgagtggggaattggaaaggggacatgaagaagtgggagcaaggatgggaatattctcttgcttatgttacagtccgaactgttccccagctctgattgtcaccacatgacttttttccttcatgcagatgcagattcctcagctttcccactgactactgaatgattattatgtcattttgtttgagtatattagtgctttgatctacctgcctcggggtttcaggcttggggcaagatctcttgcaggcaaagccttgcttctgtccaaatcaggatcaaatttgcctcttgcctctgcccagataccagtcaataccaagggtgagatgacatcatttctgatgcctactaatggtatgtgcctcatcccaccctcctttctggattgaccacccagacatattttccatgctggatcttcatatttaaacatcctctccccatatttttactacatagaaatttctgttatgttctttaacttgacggtatatctttgatacattattttactaatctttactaatggagaaaacataatatgattttaagatatttggttatgatactataacatcgtatcgatgttatataacatcaatgttttataacattgaagtctttgttattactgttatcatttatgatgttgactttgctgaaatgttgatcttcataggtaaaagaatatgcacagtggagtactgaattaggtcttttggtattcttttttttttttttttgagatggagtcttgctctgtcgcccaggctggagtgcagtggtgcgatctcggctcactgcaagctccacctcctgggttcacgccattctcctgcctcagcctcctgagtagctgggactacaggcgcccgccaccacgcccggctaattttttgtatttttagtagagacggggtttcaccgtgttagccaggatgatcttgatctcccgacctcatgatccgcctgccttggcttcccaaagtgctgggattacaggtgtgagccagcgtgcctggccagtcttttggtattcttaattgattttgtctttttttctatcacaaaaatattttcaacttcactgaaggcaaaattcaaacaaaataacagtggagtggtaaaatgagtctggaagttatcaaaaaggattctaattttcagaaaatgatggcaatctaaaattctgcactaaatgctaagaaagcgtcctaggcttcaaagactaaaatagaaatatagagaccaaggaatcaaatttttgccaatacttattagctttgttgttactgagggaactcaatttgtttttaattacccacagtccaaaacacactgcagtttagtttctctattaagataaatatcagtttgacttacagaagtgagtcaatggccaactcagagagtaaagttcaagtatagtagcctttatgcattcttctggcttgttcatagttgcattctacaccaaaataaagtattcaagaagaacaaaatttaagtggacagaaacagttagccctgtactgagtgaccttagcacttaatgcagataactggataaaggtataacttgcagctcatgaaatctcagtgaataaatgtatacatgatgaatgtatatacatgtattcattcaacatttactcacagcctactcagtaaatgtgctagatttacatatactacccaagtgctaagaatgcaaggaaaaataaaatatgtacacaattaacataatacaatgtggcatataacacagatgtgtaaacaaattttaaaaagaaagaatgagaaaaattcattaatgtgataggaggcagccttctaaaatggctcccaatgatctcctcatcttggtattcatgcccttgtataatcccttccacttaagcatgggctggacatagtgacttgcttccaatgaataaaatatggcaaaaataatcggatgtcacttcgaagattagatctaaaagattataactttcatcttgccagcacgcttcctctctggctcttcttgcttattgctctgatgaagcaaaccgctattttgtgagctgtcccaaaggggaggtttgctaggaaagaactgagggtagcctttggccaactgcaaacaaggaattaatcctgtcaacaaccatgcgagtgagcttgaaagttaattctattccagtcaaatcctgagatgactaagccctggaagacagttgaattgcagctttgtgagagaccccgaagcaggggacccagttacccatgcctggtttcctgatccacaacaatgttagataataaatgctgtaaaagtcatgaagtttttagataatttgcttttcaacaattgataactcatacaattaggaagaaaaggaaggtgattaaaatagaaggaatggcagttgcaaaatgagagggcatcgtacagattaaattctagaatggtaaatgaatttgtgtagccatagcatgaagtatccttgcaggaatgaataagatttgagaagaggattcaaggtcaaattgtaaaatgcactcagtgtcatttatttcactgttcccttacagaaaacttgccaactattttaaacaacaaaaaaaagtttaagacaggaaattaggtacttataaaattattggaagggctggagaaataatttctggtctcagccccaggaatgcctcccagagcaattatctctgaatgggtccactagggaagcttccgtctcctctataataagaaaagtggggaagcaggagatgcaactgtaataggtctgttgctcaatgtgcatgggaagtcaatatgccaagacgcaggggttgcagcagagaaagaggtttaatcatagatagggctgctgaacaaggagacagaaggaaacttcaaatctgtctcctcagaaaatttgaggctaaggtttttaagggtttcggagtgggccagagtatggaggtcattgactggtcaaagagtgcaggggaagtcatgtgacaggaaggtaaagaaatgatattctctctctctaaagaaaaggagggggcaagagctcattgaagaaatggttgattctagaaccagggcaaaataagatacaaaaaaagatacaaaataagaggacactggagcatcttatagtgccagaaagtagggaagtgcccaataaaaacacgaagaagggaatatgtcaaagggatacaggagcaaatggaaagagctcccaatagtcccaatagtcagtcttcgaaaaaattgagcaacaacataaataaaatagtattgtattattacctaaagtagaaaatattcttgagtccatactgatatgaataaattatttaaaaaataaattaatgagggggaatagatgaatctcctgtacaggaaaagcccaaataatttatgtagatattccacttttgaggaagcagagcataactcctttctaattaggtgtgggttgtgcatagtgacatcttttcaaagaatatggtatagagaagaataactttacagtggagaaacctgacaaacactacctcagccaggtgcttaaggtgaacatcagcagtgatagatcatgttgatataacatgatgaaaatggcactgtatttctgtggtcttccttcccaaaacatacagctccggtgtagtcataagaaaacatcagagaaatcccagctgagagctatcctatataatacccaaatagtactcctcagaactgacaaaattatcaagaacaagagaagtcagagaagctgtcatagccaagaggacacgtgatgactaaatgtaacgtggtgtgctgggtaggctattagaacagtaaaaggacattaggtaaaaactaaggaaatcagaataaagtatggacttcagttaataatagcatatcagcattgtttcattaagttacaaatgcaccatactaatatcagatattaataacgggaaactggtgtggatgtatgggaaatctttgcactattttcacatttttttggtaaatttattctgaaataagtttttttttttaaaaaagcaaatagtcttctagatgctaaaggaggaaatcttaaatcacatcagcaccgtttggaaatgtgggcatttcctgaggaacatagagagaggagagaattcctatttgattttagtattacgaaaaatgctcttagatcaaacttgaccttatatatagactattacaggagtaacccactaaattttacttattttaactagaaaatccaactaacaaagaagtgctttccctcctgtttagaggctatgatattacgattatataaatattaatatattggttttcatccacagttcctggctcataactcccagagtccttgttacagtcttttgttacaatgttgaggtgctttagggctcaggagcaggtctcaggaaacagaatctctctttttttttttttttttggagacggagtctcactctgttacctaggctagagtgcagtggcacgatcttggctcactgcaacctccgcctcctgggttcaagcaattctcctgcctcagcctcccgagtagttgggactataggtgcacaccaccgtgcctggctaatttttttgtattttagtagagacggggtttcaccgtgttgcccaggcttgtctcgaactcctgagctcaggcaatctgcctgcctcggcctcccaaagtgctaggattataggcatgagctaccgtgcccggccaacagaatctctttctctgaccttctcctgtcctccttttacctgctccaaggcaggactctaatctgattgtgggtcaaaagaccctcattgcagacagagtcctgccccataatctggaggatgaaaagctgcacagagaggccaaggagaacctgaacaggcaggccttgctgggcttcccaactcagtctattagtatgaggtcataccctttttgtccaatcacatttctacacagttgtcaatcatgcctatgtaaaaaacaaaaaggacagggtttggagagcttccggatggctgaacacatggaggttcctggaagatggcgcgggtatggaatctctgcaccccttcctccctacctggccctatgcatctcttcatctgtatccttcgtaacaacatttataacaaacctgtaaatgtgttactctgagttctgtgagcagctccagcaaattaattgaacccaaagagggggtcatgagaacccctacttaaagcgggttgtcgggagttctggaggcccagtcttgtgactggtgtctgtggagtgggaggcagttttggggactgagccctcaccctgtgggatctgacgctacctccaggtagatagtgtcagaatttaattagaggacacccagctggtgtctgcggcttgttgtgtggggaaaacccccttaccttttgtcattgagttcttttgttattgagttgatgactgttgtggtggtgtgagagcagaggtaaaacaaggctcgggagtttttctgaaacagaggcttaattttttttttttcaagcatgatatttattttttgtctttttttattattatactttaagttctagggtacatgtgcacaatgtgcaggtttgttacatatgtatacatgtgccatgttggtgtgctgcacccattaacttgtcatttacattaggtatatgtcctaatgctatccctcccccctccccccaccccacgacaggcccggtgtgtgatgttccctaccctgtgtccaagtgttctcattgttcaattcccacctatgactgagaacatgtggtgtttggttttctgtccttgtgatagtttgctcagaatgatggtttccagcttcatccatgtccctacaaaggacatgaactcatccttttttatggctgcatagtattccatggtacctgtgtgccacattttcttaatccagtctatattgacggacatttgggttggttccaactctttgctatctacaactagaaataccatttgacccagccatcccattactgggtatatacccaaaagattataaatcatgctgctataaagacacatgcacacgtatgtttattgtggcaccattcataatagtaaaacattttctttttggtgtgagagaccctcccattccttagtaaaaacgtatttacttgcatgttattattgtccttacaaacttgtttttccctagagcaattgattttgctttaggtactagctgaaggtctagaggcaatacaatttaggatccttgtctagaaatcaatatgattcaattcttttcaagccaaatgatatctgtagactccagttgtgtgcaagccctgtgtggagcctcaagtcatctgcgttagtccagcttcctattcttggaaatcagctttgcttgattggacctatattggcatgttaatgtttgatggtggcctggcctttataaaagcatacaattttgcagatgactccttctcaggatagagtgtctttgctcaaaggagtggatttattctgtgtgagccagggaggcaggcatgaagaaggggcattctgaaagggcagggaagatcctttgcaccagctgaaaatgccatcacgtggctctccacctgcctcttttgaagactggctgtggcgaggtggactgtaggtctgaagtggggagatctcttgcattcttccaatttctctttgttcagtggagaataaagaaaatttaaataaggaggagatttctagaccaagccctaactttagctacctgtgacattggtagcttcattttatttactctgtgaatgaagggtttagaggaaattattctggatccttctgagccttatattttctgaccctatgaactggctcaggtaggtctttgttgaggctggtgtctacatcaatgaggaggcagttctcaaagttctttagtggttctctttttctccttgtcattgccaacggatttaagatagattctgtgaagttgacacaggagtcctaagttgttttccttacttcacccctgttgtttgtgttaagtgtccaatctcaagcttgcatattggaatagtttacatttctatattgtcatttgcaagagaagcactgtggagtagggaaaggagcatgggctttgcagtcactctgacctttaccatttaactagacctgtgacctcagaaagtgatttaacttctctaaacatccagttttctaattaataaaaatggcagtaattatcctcacctctcagggaaagtgtagagattaaatgaggcaacatgtaaaatgactgtcacttagtagatgctccataaatcagccagcccacccttccttccttccttccttccttccttccttccttccttccttccttccttccataatcatggaagttacattcttatcagtatgtttgcacatgatatttgggctattgagtgattttatgtggctgggcagggttttctcctccccacttcctcctcctggatacggcacaaacctgtttaacaggagaaggtggtagcattctaatatgtagtagatgcccacaagatgggagatgtggtgtgggagatctgttttttttttttcagctaacacacagagggaagatcactacttaggcgctttccctcttttcttctttactccctgagaaatggatgaagctgataaagcttaaggactgacaaaccagtttcaaactcatagacctactggggcaggcaggtgatatatatgagggacgtgggctgggtgtgaagaaaaggccacagtgttacaaagttcataggaaagggcacctttactttggcatgagtgtgcaacagagagtcatgaggactgtggtgaaacaaaaagagcagaccccattgaaaggggacagctgctactcagtatcagataatgattgctatgagggaacatgggttctttacttccagatctttccatttttagagggaacccagaaatgtaaccatgtgaaatctcttgatttttaatgcctggaaatgaaatcaaattttaagattatactccgtgggccaaccggaaaagattatgccagcaggttgtggcatctgggccgaaggaaccacggagctgtggggtcactggtgaggggaagaagacaattagcagtctaagcgggagggaaagagaaaactagagaagcagggcggtcaaaagtgagacgaatgagccatcctggatctctggctccctggtgaattctgaaatggatggaaatggagggccagcatctctagtaaaggactgtttaatgtgtatgtacttggccaactcaaaataaaatgtttggagcatgaatagccccatatgatatatgctgtttggttgacatatgcttgtattttaacaaccaacattgtcccttttatttttgcaaacaatatgatatgatctggtcctcactttaattttacatgaaaggtataatgcatctacgtaaataagaaagcaaagaagttttctaaatgctttaattttttgtcacaaatatttctgcatctctcagtcccttcttgttggaaaaaggagggctagtgatacatttgttaatggcacttttaaaatgtgctttggtatatagaggtaacaatgtacttcttaggtatgttaataataaattaaggttataatggttgccatattagagaaaatgaataagattagtctcagcaaaaataaaaattagtttggaagtagataagctagaaatatcaaaactgaaaaaaatagcttcccagatagcgttctactatgtgcaattttttgaggaataatattcaattacagagtgtaataccttgcacagcacttgacatatagtagctattcagcaaatgtttgttgaattttattactttttaaacaaattactgagtaatcttccttagtaatcatttctgtaactcagataaaaatagaaatttataagagtttttatttttgttacttgtaaaagtatatttcctagagaaaatatcagcagtggtagagaccagaaaaagtaagtgtgtgtgttctaaacagtgattccaactcaatgtgttcagagaaaacactttgaccctgtctgtgtttacagtccctgctgacagtgtactgtcgtatcctcagccttgttctatttctttattttagctttacagagattaggtctcaagttatgagaatctccatggctttcaggggctaaacttttctgccattcttttgctcttaccgggctcagaaggacatgtcaggtgggatacgtgtttctctttcagagctgaagaaagggtctgagctgcggaatcagtagagaaagccttggtctcagtgactccttggctttcaacccacctagcctcagacagccaggaggcctttttaccactggatactgatgagatgttttaggtccttgcactttgcaaaactcctttctcccagtgggatattattaggacatagccaggctagaaaggccgtgggaagctttggaggtaggaggataggatccagacagggttacaataaggagaagggcattctctttggtgcactccatagtccaatggcagtcctgagctgattccagttaggaaccaagggtggactttcttctttggttctttggcccttttgatttccccagctggggcagggtaaggagcatgaaagaaaccagcctcaggtgtgtctcctcatttctgtctcatctaaacttcagcttccaggcatcgcacggtagttttgcttggactcttggactcttctgggtttttatcagttttctttgattcctcattagggttgctatcattggccttctcctcctttactactttggtttcgatcatttccttctgctgattcttgtttgtaaaagggaaggccttcacatacctttaggcagaaacatgaaattaaagtgagagactctcacacataacgatagataacactttttggccatggtacatattggcacagtacactggatacctttatttcagagtgatgccagcacatgcatgctctaatacattaagacatcaccaccttaatggattcatttaaattggacaatatgtttgcaggccagactttaggctgaccacataactcttccaacaaaaacaaagaaccaaaaatcaaataaagcatataaattttccccagatgtcaattttttttaatttcttgattttcaaaggacagtcattgactgatggctggacgacatgcatgtcctgaaatagaaaagattgggctgaagggaaagagatgagatgagggagaaatttatatcagaggactgctatctccattttgatcagcaaaatgccaacagtgaccctgaaaaagcacaggatagaaacatgacaaagattacaagactagcagtgcaccaacaaccctaccttttgacatagcaaaatccaagaccagctgcagcaccaaagaagaggagagcaagcactagcagagccgtggggacacctgcaaggaacagagacaaggcctgttggtccttcacttaaacattgtgtgtaatgctcattgcatgatccaggtgattgagacagtagacagtacaggagaaaaaccttctctgtagccctttatgatattgggcccacaccagcttctttgcttcatgcttgtagaatcattggccttgcttctcacactctcaattctatcagttgcaatatgacagagttcatttctcctccatggccttgagacctactctagtcaacaagcctgcctgagaaagagatgactagaataaagtcataggcctttagggtatatattttaaaaagaacttatgcataggaacagatagtgatttatttttaaaagtcttgagttttcaacagtgaaattcttttatacttacactttttagcttaatcactaaggttctttacagctctcagattctatgacttcatgaaagttgagtttgtgttaagcttttattagtatttgacaggtcctgagcgcctcatctaaagacaggcaggattctatgaattatctgttatacatgaacatacatacacacgtaacatagacacagaaaccatttacctccaaacccagcagcttcattcttgaatgctgctttattttcaacaaatggttcagtttctgtagacatggtgctagtttccataaaaacttctgtgacacaaatcaatttttttctccgtggaatagaagtggaagctggagcaggaggagtagtagtaggggcaggtattgtagagtaaggggatgccaccgagtaggtactgtcactgacaataaattctgttgtttgtgttgcagtttgagtgttgaatatgggatctttggtggtgataatttctggaatgcacgagttagtccaagtatctgttgggatagggaaacatggaataaaagtattgcaacagcctcctaactgttcttcttgcctctagtcttactacctccaaaccccttataccgcagctggaatggtctttaaaaagcaaatctaaccatatcactttcttccttagaagccttcagtggctatctttgttgtatggcctacaaggccttctgtgatttggcccctgctaacatgccagcctcatctgctctttttctctcattgcccctgccatactgaaattacttgaaattccttgatacactttatcttacatccaagccttgcaccacgatgctttattcacctttatgactctttgcctctctttatttagcttactctgactcatccctcaggtctcagattgaccctgtctttctcaggcagacttgttgacttgattggcatatgttcttgtacttccttgtcacagttctcattacactgttccccactggactgcaagctctctggcagcagaaaccccgtctgtcttggtcagcatggtatgagcactgtgtgtggtacatagcacatgctcaataactatttgatgaatagggaaggaaggaaaagggaaaggaaggaaagtatagattggaagaccaaatatacacatgtggtgtcacttcaggacaaagatatgctaagacctgatatttctgggctcattaaaaaaagaagtgaacaaaaagggaccaggagagggataagggtttgctttccaatctgttgcatgtgctagagaggaaacacttgttaaagcatcttaatctgagttgaccatggcagtaagtgtttaaataggtatctcattgaacaatattactaaacccttgtttacacaggaggaaactgaagtttagagaaattgaataactcgcccaaagtcacagagctagtaaatggcagagccatgcaatatattataatataaatttgcatctattttaagtccctaattatttgtggcagtgggtagcatcagctggggttggggggtgggctagcagagggatagcattagaagaaatacctaacgtaggtgacgggttgatgggtgcagcaaaccaccatggcacatgtatacctatgtaacaaacctgcacattttgcacgtgtatcccagaacttaaagtataataaaaataaaataataaaataaaattatctctggaaaaaaagaaaagaaatacatgggatgggagtacaagttaaatgaaaccatgaggaaatagacaaatccaagtcctcttcctctggctcttctctgtttagtcagagggctgggtatcatcacattgccagctggcaggaaggcagttaaaaagcaaagccatttgacaggcatgggctggctatgaggtatgcaggcatatgtagctcaccaattccccagccagtgatgatagaccaaagaggcagagaagggaaggaagatgggaaatacactgttaggagaagccctatgtttcagtcttgattctgccactaactgaccgtaggaccttgaacaagctaagcccgtgttctgaactgtagttgtttcatccatgaagtgagggaactggtcaaagtttctccatgggccttttctgtgccaaagccctctggatcagggaactacttggatcctatattgcctttctgggacagtttttgctaatattggctggtgcacatttatctctcggatcttcgagaatgatcttgaaatctatcctgtgtatgacctctcagccacctaaccttcagaaggtcagatagatgagtatgtgtgaaaagtaataatcagacaggggtccttatgacaaactgagagcaagtgagtatttagtaaaagaaaaactttaggagaagtacttaggtgaagcacttgggctaaggcagccaaggtcttcaagcaaggttagtgggtgacttcatgaccacgaacaaatcagtgctgccctccaggtgtcaatcttttccttcataaagtggagactgggtctggttcttaaaattataaaggaatgtggaacagtggaaagagtgcggtttcagagttagacctgagtctgaacctttacagtaatgagacgttagacaaatgtgtttacatcctttgaactcggtttctttttttttttttttttttttttttgagacggagtctcactctgtcgcccaggctggagtgcaatggcatgatcttggctcactgcaagctccgcctcctgggttcatgccattctcctgcctcagcctcccgagtagctgggactacaggtgcctgccaccacgcctggctaattttttgtatttttagtagagacggggtttcaccgtgttaggatggtctcaatctcctgaccttgtgatctgcccgcctcggcctcccaaagtgctgggattacaggcatgagccactgtgcccggcctgaactcggtttctttatttgcaaagtggggatgataaagcatatctcatagggatctgtagattccatataggtggaagcaaccaaccttggattgaaaatatttgggaaaaaaagaaaaataacaatacaacaataaaaaagcaaataatacagtacaatgactgtttacatagcatctacattgtattaggtattataagtagtttagagatgatttaaagtgtacaggaggatgtgtgtaggttatatgcaaatatgaccccattttatatcagggacttgggcatctgtagatttttgtatatgatggggtgccggaaccaatctcccactgacactgagggacgactgtgcatcactttgtccataatggatgcattacatacatctgtacctttgttccttcccttctgcctgcttatcttataggatgcagggatggtggcagtggtaattgagcctcctgaatgtcttctcgtgtgttgccattcagttatatctctcctaactttttcctttgaggggcatattgccacccctagcctggccagagagacagtgtcgggagaattagatggccgtggctgtgattgcttctgctgctgctcagggttactcttcccagacaggtctcagagtgagagatacccagagaatgccacgtggaaaggttgcagatcagactcaccagatgagttgtaacaataggctgcaaactgtcggctcactggaaccttccaaatcaggacacccaccccatttttcccacacttggggtttgggctaatcctagagatgaccacgaatccatctccaacccagccatagctgtaaaagaatacacactagttgaacagaaaaatgattagaaggcttcatctctattgctgaacaagaacacagagctaaaaaagaactccagcagtgacagtgaaaccagctttttctcacctgcaagtttcaaagctagctttcaaggctgtttcaacttggtccttgccggccaaacttagtcccagcagcctacaggcctccttagcttctgtgaaattcagctgctggttcgcctttttgctcacaagggtgatccccataattctgcatgacacctggatggaaagctctgcaaaggaatcacataggtcctcagtttgctgctgtccttgtttccagcccttagactctccttcccagcagagtatatcgtcctgatgcgcagggaggtctatctggctgggactggggtttagaataacaggacacagaccaggcattttccacaaggaccatctgctgggctagatggatgcttgttcttgtccaagctgtaaatgtcgcccaatcaaaatctatcccatcccactgcattaagatgccttgctcaccatataggggctttggctacctgttgttggggtgcagtctaagggatgcagttactgcaaacctttctggagtctgtaaaatgaagcatctgagactttgagaaagatagaattcagggctctagttcatagaatagttagcaataccccaaaccaatgtggtttggggacactactatttgtgagatgggctgaaaatgtcacacttgttataaaagaatgtgagtgctctcagttccaggtcttttggccactgggggacaggcttactcagaagttcctggaggagctggcagtaaactttgaatggcagaaaaactaaatgaagaaagcagaattttagagtcagacttgggcttagatctagcatatgtcatttgctagctctgtgaccttagcctagatacttcatctctttaatcttcagctctttgagcctccttgtttataaattcaagggagtaacagtgtctactgaatagggtagtgaaagttaagtgagtaaattctaatacaaatgtttagcatagtgcctgccacatggtaggtgcttaataaatccacataacattatcattatcgttaaagcattttggttttggtctgctaatgattgattaccccacagaagctgaggctgttgaataggtaagatatgaataatatttctactcaaaatctaatggatttgggaattcttttgaacccttttctctgggttctgggatgtacagacctgtataaaattgccaagttgtattgtattcaaatacattattcctactgggcttcatccacaaacatccataaaagggcatttaaatctctcaagtaattgcttgtacgcagctctgtgtattggatgctcagtcaaatgctttgaccacttcctaggttgatatctaatggaagtttctttttgaaaacatggaaggagcatttctaagtcctccatatgaaccttgctgtggtggcagattaggagcacacactcaattatgcctgattctaaaaccccagttcctcttttttccttcttctttcccaagagatggatcttgctatgttgcccaggctggtcgtaaattcctgggctcaagcaatcctcccacctcagcctccctgagtagctggaactacaggtgtgcaccagtatggccaagcaagaaccccagttctttttttttttttgagacggagtttcactcttgttgcccaggctggagtgcaatagcgtgatctcggctcactgtaacctccacctcctgggttcaagcgattctcctgcctcattctcccaagtagctgggattacaggcatgtgccaccaaacctggctaattttgtacttttagtagagacagggtttctccatgttggtcaggttggtcttgaactgccgacctcaggtgatccacccaccttggcttcccaaagtgctgggattacaggcgtgagccactgtgcctggcccttttttttttcttttttgagacagagtctcgttctgtcacccaggctgcagtgcagtggcgtgatccatgctcactgcaacctctgcctcccgggtccaagcaactcttgtgcttcagcctcctgactagctgggactacagacgcgagacaccatgcccagctaatttttgtattttttgtagagatggggtttcaccatgttggccaggctggtctcaaactcctgacctcaggtgatccacccacctcggcctcctaaagtgctgagattacagtcatgaaccaccgtgcccaacccggcccccagttcttaacaatgacactgttttacctttcacagtgctataaggaaatgaacacacacagacacacacacacccctaggctgaactccctgaacacaccgtttgctctgaaatttggctcttttagctcatgagcttgctattgctcaggtctcttatagctacttctttgggaatggattgcagaggtttatttgtcacattatcaattggtcttactaccctctcatcatatgtcatttgtactctaaatactattatttagaggagtgatagacttattctaggtggatagacttagctttgaatattttttctattgttaactggctgttgcgacatcaggcaagtcagcattctcatctgaaaatggggatggatatatcttcttcacatgatttttatcagaattaaattagataacttgtacctagcagaggcggggcccagtaggaagtcaacaacattagtcattttatgctttcctatttcatttagggatcaaaagagggagctggaatttaagggagtactccagtaactccttccttaagatttctcaggaaacagcaaacatagtagaaatagtgtatgcttaggagttagatataaggatgtggaatcagataatagcatatgcttaggaatcagatagggctgaattcaaacccaatatttattatgtactgcctgcatgacattgggcaagtcacttcacctataaactgtctttttgagaggattaaatgaaattgtatatacacacctagctctggatcactatatacttggccctcaaatatagttcccacccctattcacttaccttcatcaactactttattctgcagtcatggttatgctgacttttggttgtttccaaaaatgtaatttccctagaaaatctttttcccttgctgaggatagtccagagtgtgatggagtcattttcaaaaaacagtgtccaatagtttgaataatggcagcattgtggggaaaaatagtctccccagaggatttcaaagaggaccaaacttatttgaaagtaacagtattttaaaaaactaatcatataactctgacctttcttataaaatgtaatgcaacaacatataaatcaactctgaatgtctgtttctagcatattttatatctcaggtcatcttccagcataggaacacacattttcctattaaagtgctcagattttcatttgcccagagctgcaatgagtgatttgtggttacaatttttttgcctacagtgcaaaatgaggtttccatttaggcatctcaaaagcccagcgatcactttaagtcattcctttagtagacagccgatggcttaattttcaaacttatatttttacagatttttttcagctaatttgctatttactgaatatttttttaaaacattgcacctcattcatggtatgataaaatcaaaattaaaataattatgctaacactcccaaaaaacataaaaacaggccaattttagtgaaagttacccattattcccaagcttagtgattgctttaaattttttacaatcatggtttgcgtcttcaatgaaatacttaaaaaaaaattattacttctggatgcagtggctcatgcctgcaatcccagtactttggtaggctgaggcaggacgatcacttgaagccaggagttcaagaccaggctgggcaacaaagcgagatcccattgctacaaaaaatttaaataccacccatacaaaaaagagtaaaaatcaaatggtttctcttcagtgttttatttcaaaatgtcctcattaaaaatattccataaccaaaagtaaaagtccagatgatacaaacgtaaatgtcaatcattttggtgaagttgacaatatggtggtacatttttggcagagcagtaccaccaattagacctgctgttgacactgagggtcaccctcattcccagaaatccatagtcaacagcttaggaggcttaggactgaagccttgcttcagtttggaaatctggtgagaaacctaccttctgcacgcaaagagccttggaccaggagcctcgtggtccagatggaagtgagaagcaacaccaggctgaagcacctggccatcgtgcctaccccttcagagccagggaaacacctcagatggccactggtgatatgagaggcagatgctcaataactagtccggatggagagttctggaactatgttgaggctcacactcactgctccacttcataaccgagacatccggatttccctgctttcaagcttctgacttgtcaaggtcactgggggaaatgaatgacgtcccttgaacgcccaggctgtactttgtggatggccttctggaaaatttagctaatgctgactcagaaaacacacaaatgaggaaggcagatagcacagtgtgaactgctaaaggttctcccaattcccatattccctgctgttcctcctcccccagcagctcagttctcacaccattcactgttactgcctgtggagtccatcgtttatgtactcctagaaacatctctgtccctaaaggagactgagcataggttgtgcctcttttcctcccgcaatcagtgatttttccacccagctgttcggccttgtgatctgcagggtatgatgctgaagctcatgaaagtaaatgtccacttaaatactgagtctagaaccttctgccttcctttgagtctccttttacacatttgaaatctctacaccactacaggtgattcctttttcaaagaaaccaggcacatataaacattcacatttacataacacaagtaggagggcaatttacaaaattaaacattttacactttccccaaggatttttaactttacaatagtaatcaccacaggggtcttttatgaaataactttctcttaataactcctttcatattctggtaggccagaattcaagtcagactccacctttgttgttcgatgaacatgaggtttatctgtgctgtgtaccagcagagtgtattctatgtttttccagccggattttcagtggtttttgcttcatggtaattatggagttctggcttgtaagcaatgtcttgggcaaaggtttatgagatttttccaaaatgaatgtcttttataggaaaagtatatggataacgaattcttttttatataagtggtactggtcataaagttagatatttgtgtgaaaaatatcaataacaaaaagagaatctgctctaaacaaatgcagggaacttctaaaagaccagggtaacagcccttacacatctccaataccgacctcatgatctgggtgagcacaagccccagtttctcagaaacatgcatgactctatcatcacagcaccagggaggcagacaggcagagtcctggcctcttcatgattattcttaaagcctaacaccatgcccgaaagagagctagctttctagcatttgttcacttattgcaaaaagaacgaaggaagacaggaaggggaagaatgaatcagggaaggcaaggctttgtgtcaaggaggagaatgagagtcacagtgatcaccagccatagaatttctggaataccaatgaagaggccttagaaaggtcgctgtgccagctttctattgctgtccaacaaattaccatagacttagcggcttaaacagtactcatttatcatttaacagcttctatatgtcagaggtctgagtgggctcagttgggtcctctgccctgggtctcacgaaactgacattaaggtgctggctgggctgggctcttacccagaggctctggggaagaatccacttcgaagcacatttgggttgttggcagaattcatttctttgaggttgtgggaatgaggtccctgtttccttgcagggtgtcagccagggaccattctcttctcctagagcccttccattttcaaagcagcaatgacacactgagtccttctcatacttctagtctctctttcacttctacagttagccagagaaagttctctgctcttttaagagacacggtcttgctctgttggctggagcgcagtggcgccatcgtgactcactgcagcatctacctcctgggctcaagcagagctctctactttttttttttttttttttttttttgagacagagtctcactctgttgcccaggctggagtgcagtggcgtgatctcagctcactgcaagctctgcctcctgggttcatgccattccttgcctcagcctcccgagtatctgggactacaggcgcccgccaccacacccagctaattttttgtatttttggtagaggcagggtttcactgtgttagccaggatggtctcgatctcctgacctcatgatccgcccgcctcagcctcccaaatgctgggattacaggcgtgagccaccgcgcccggcgagctgtctgcttttaagggctcatgggcccacctggataacctccctatcttaaggtcaactgtaccatctaatgtaacacaacaaagctccatacccctggagctcctattcaaaggctccagggattagggtgggacatctttggagggctattctagaaattctgccttccacagtcacttaaccttgatttgattctgatctgctttctgagagaaacttccacatccactgttttctgcggccctttgcatccctctgggagattcatttgcatataatcttgcttgtccacatttgaagtggatattagggagtatgccttccttgggaatagcacagcttttgcagtctgcttcctgccggcataagctaagatcccaaaagttttcttaattttaaaaaaattttatttttaatcaatacataattatacacatgtacattttgatgtttccatacaaacaagatgtagtgatcagatcaggctaattagcatatccatcatctgaaacatttatcctttgtgttgggggtgttcaatatcttctcttccagctatttgaaaatatgttattgttatctatagtcatcctatagtgccataaaacactataacttgttcctcctaattttatgtcctttaacaaatctgtcttttcctcctctcttccctttccagccactagtatcctctattctgttttttacttccatgagatcttttgttagcttccatgaattagaacatgtggtgttaactttctgttcatggcttattttacttcacataatgacctccatttccatctatgttgctgtgaatgccaggatttcattttttacggctgaatactattccgttgtgtatgtacaccatgttttctttatccactcatctgttgctggacacattttaataccatatcttggcgattgtgaatactgctgcaataaacatgagggtgcaggtatctctctgatatattttctttcctcctcaaagctgtttcctcacctgaacaatgaaaggggtttttagtcctggcttgtgtttctttgtaaattccctcacaaagttagatttctgcttccatgtgccaataatcataccccaaatcctttcccagtcataattctcaagaagtatttcctgtttctcagcaccatacccctcaaatttagtggtgaatacactaagttcatttgaactcacaaagggccacatccttaatctagcctttgccataaggctgagtcgatctgttcaactgagaaattttattggctcccactcaaagctctttttagtctgtctgggatttagaagtggtcaggttttctcacccttcaatctttcacatttctgaatactctatattctttttcatttttgctcccacatagccaattatttctcctgccataccttgccaaaggcagccaagagaagtttccataccccaacgctgattctttccaccacttataaataggctaaccatgagatgctttccaagttatcacaggtaagactttactatcttaccatctttctagcagttttgtttcttgccatgtaactggtaagctagaacctcatattttggaattttgctattaaagtacacaatttctggttcaaatgtatgcattagggtaggctaactgctataaacatcctggaatctctgtggcttaatatactaaaatcttatttcttattcatgtcacagttcaatactgggagtgctcattcaaagacccagcttccgtctagtggttctgccattttctcgggtctcagtgttctcatctgaatcctctggctttggtaggcagagaagggagtaaaaaaaggtgtgaagtattgggcaggagagtttatttttagggaactagatttggaaagtccacattcccctgcagctagctgtaagaaagacaaaaatagttcagctgtggaaatcaggttggttaaaaactcagcagactcaatcacagcaaactgtgttaattaaaaaaatcatagaccaggaagatacaggaaaccaggatcaggaatggggaagggaagaggaggaactgatccagcccctgtgaggtagcccatagtataacgaccaagggttggggacctctgacttggttctggaatgcactaatatatccaaaggcatctaattctgggttggggtaagactgtaattcaactccataaaatgaggaggcatttggctgctgccagaggtttggaaatgtgcttttattttcaaactcaggtatgtgacactctacagttcaatgctagcacacctgtgtgaggcttaacaacatgaggaactgatagccagtgatacacaaatccagcacttcctctccatttactctgtcaggctgtatatggggagcaacacatatggctttgtggcagccagaaagtgaaggtctttttaggaggtgacatcaacaatgacacaaacacatcactctgcaactgaaggcagggaaccagactcctagggctaagcagagatgtcagacttcagaggcatttgggggactcttcagatccacatcctcactgaaaatccagggcctgtttctctccagttcactaccgcttgggcagcagctcccactgcttcaggctggtctttgctttccagaaaagatggactcatgagcactttttcagcccctgtatatatggctattcttatgctcccttttggagatgtccttttcctcgacctcccttgcttacaaatggaatagggtgggagagggcctgtgcctggaagtactcttgcaggcttttctgtggggcagctggaggtgcaggagctctccataactgccttcctggcctttgactcatccagaaacaaaggtaggaaacttgtgaccaagtgaacaatggggccagctgagcctggccctgctttaagggaggcagagattgaacattccccacctggagttctgcttccacggccactctctagaactctatttgcatcctgtctttggctctgagggcctcatgtagctaaagctccttcagttgtatccagaccccctggaagaggccgggcaaatcatccacttctgcccccagagtccctctgccctgctctgtaactctttaccttaatggcacatccttgatcaaccctggcttgggcctcagtcattttctagctactgtaaaggatgcccccttcaataaacatgctattttaaagtggggcatgcttggggtggggggtctctctgaaggagtgactgcattgagcccagtccttgagcttggcaatggtgttgctagtctggtctcattcctgctctctcacagagtagactgaaaaacagaataagctgaggttaagaaagatgttgctttttgcattgtgatggtgctggtactgagaagcatgcagcatgtcagctgtccccaggctgctctccaccaccttaaatgtttgcttgttcttttgagcaacatttaatgacaccctcccaagcgtcagccaccatgctaggcacttacccaagagatgggtaagacatggttcttgtctttgaggaaaaatgctaggggagatggatacataaataggccatggtatactataggtaaaggtcaataataataatgtttaaaacgtgccagaaagcacagaggagtgtgtgacctattatgttgtgtctggtgaggagtatggaaggaaggtcatcaaagctggtatggaggggataatttttgcactcggtcgagaagagtgacctgaagaaaagagaagaacagctggaaaaaaaactagtgagtggaggtccagcactatgagagaaactgtttagttggggagccagagatggagtagctgatgggccacttgggggaatgagactgaaatgtgaggcttccagctaggagaccatcagaagagtcaaggagagcacagctctggagccagcctaccctggggttgagctccagccccatgatttactaccggggtgtccttgtcaagttacttgttctttttgtgcttcagtttccttatttgaaaatgggaagggtaatatccacttcgtatttttttttctttttcttcaggacttaaatgaattcatacctatgtaatactgagaacagtgcttggctcatagtaagtcgtatatgagttttagcaatgaaagcaaacaatatcaataacaaaacaaaaatgcaaaacaatgacaacaaaacccacatggaaatcaaacctctacaaaactgatgaaggcagtggctgtaaaagtggggagagaagtcaaaatggagaggggatgtgctccttcagtgttgtgctaaataactggggatgctctgaaacacccctaattatactggggttggaaaccccatttgaactgaagcactgaggtgcaagtttactcttgcatgtggtcacacacagagtaagagactgaagcagaaagcacatcttctctcctcattcacctgtgaggtgggttaactgttttcaaagagagaatagggaatagattgtgctgtacagcagctcagagttggcatttgaaatggagactagtaagtctgccattgaagccatgagttttctgtgtttttaaaacatcttcaatccatgtggacagctcattgaacaggtgcctggtgactgccccacactggtgaaaatctgtgggttggcttggcatgcatcttatttatccagaggtacacacccagagcacacttttgaagggttgttggctctgtgcacaggcatgttgtgtgtgtgtacacaacagtatgtgtgtatgtgtggacagatgcgtatataataattcatatcttcccatttcaagcactgagctaaattcagcctatacttttttttttttttctgagaagcctttcctacttctgtaaaaagaaactctcattccaaaggaaagaatgggaggctgaagttattgaaaatgagatgggaaatgggaagatagtcactttgcaactccaaattccaggtctgatgcttagggtgttagtcattaagcaaattcttcctgataaccaattacagagaggaaaaaagagagtaagttttttactgccccctacctcctcctcccccgtgccccgctccttacccccaaccaccagtgaaggtgttttagttctccccagccacctgagctaggggcaggagaccttcccttccaatagagttccttggtgaaggtgacttcttcatccactggatgctttcccagggcagttttgttgatcctccaagaacatcaagtcactgtgtatgaatagctcccacagaagtgccgagtgttaaaagaacccttcctcatgacctgatgggatgggcggcagtgtgtccacacttgggcctgacgttatacttggggaaagggtggtagtctgagtgtctcagagcagggcactggctaggtgtgaggtttcctactgctctgtaggctgctcatgctggagtcctgagctccaccaggagtccctctgggctgccgagcaagtggatcttccaaggggcccatcagcctgctctgcacaagagttataggaattgtagagccccagcacaacagtcaagaccagcatcactgcagccatcatccagatcacttgccagtgctgacacagtttgggatacatgacttgtaagaaatggaccaattcttcaagtttgctgtcaatgaaaaaaaatatgcagaggctttagtatactgggcacacatatgatacacagacccacagttctctctgcggatagcttccatgctgtcttgagcaatagttctcaaacttagctgtgcctagattgggttggcagcaattgttcaaaataccccaagcatactaaatgagaatatccaaagttatggtccaggaatcattggctaaattttcccaggtgattttgattccaccagtccacagccttgaagttgagagctacttatctagatcattctacttaattgtttgatcatccatccatacatgccctcatctattcacggggtgattactgatatctgcactctcccaagcccgggggtacaggattggttggccatgcatctttttagcacctagctgcattaatgatcagttccaagctctaacctgtgccttgcctcagatgcgtaattcattgttctcagttccacatctaactgtgtccagagtagaaggactgtgctaaactctaagcagcttgatatccagtgataaatgacaagggactagatcaacctcaagagttcacttcaaaccatccaagagcaggcagaagattagaagcctctagcaatgtctgggtggtttgttcatgatgttatctcaacctcattaatatttattctctaatttctccctcttcctcctcttcttccttcactctctccacacttctttctctatccctttcatctctctcttcctctccatttttgccccttttccctcttgattccttcccaactgtctttcattttgtcctctctctctctctgtggtgtggtaaaaagacaccgggcagatggcctgctttgacaagttcattctagagctctctgaagaagccctgagccccttcattaagccaggatttcctgatgtttttaacctctaacccaatttaaaaaataatatgaaaaatgagaatactgaggattcctgaaccaaggaggtggggaaagtgatagaagtgctttctgaagatcctgaggctcatacacacacagcaatgaccaagccattggctgagaagcggagagctcaaattttgaggtagcagaaaatgcatgactaacaaaggattgacagactcaataaatgccctccttagaaagggaccagatgctcagaatgcctgccttggatgctagggccacagagaacattgacaggtttccgttccatgcgggaaccccatcagatcatttcagtcacaattaaggaaagcacgaaagtgaacacattcgctgatttgaaaatcattgactattttcacaactgttgggaaggcagggtttagaagtagaaggttattttctctcagccctttgtagattctctagattctatttagacagagttggatgctaaaatggagcctttggggctgtatttccatcctccaaaacaaggtgccagagtggcttctccctactctaaccccactcttaagtgtggctctggaggaagagaccaagatctgtctgtgtgaccttagctggtcacccatgcctggcctataaaagagtttagaaatagattagaaatagaatttctttagaagtcaatttttggttataataagtaaacttctgtttcctgagagttattggaaaagtaaaggaacctaaatgtcctcttaaccccatagaactggtttgaacagccgttaggagaaaagacaaaagttttatcttgtcccttatgagtctcacttgttcaatgtcagaagactgtgctttctgttttaatatggttaaaatattggggtttacccaaagtttatttaaactgatcctcaagagagcaatatttgtaacataattgttatatataacagatacgtgactcagacaaaaatactttaatgtgtgatgttgaatctcttaagcgatcagcagctgggctgaacccagtgttttaaaaatgcaataagtaggacatggaactcttaataacctcaaaccttgcttgttagtgaggcaccaacatttcagggaagaaatcatgtttgagagcaggtgcatgataaatgttacaggcaccattgccactcactgatgaccaggagctggacagaaaggaaccaagctaagccttacttcccctggggtttcatgaaatgggagggagctgacaattgcctgagattgaattagctagataagacattgagccccttgctttgcaaaccagactgtttatattccatgtactctctctctgtttatttctcttttgttctttctcagtgtttggaagtgttagaagttccagtctgtctctgctgtattcacgggtgccagaggaaaggctttttgtctagggctttgcttgactgcattaaaggggaggaaggcaatgtggtggactgagaaatatcagcagagaaccctcaggagggagatgaggcctaaggagaacaggatctggttgcttggagtagggattgcactttaattgttaaacttggaggttctttcactggggagacagtgtgtgatttgttttcagtggagaagcatttctccagttctcctaacggctcttcccctgaacaatggggtcgaccagcatgggctgagacctctgactttagttgaattctccaccaactgggctctattgatagctcctgtgtgcctatccattttgcttctaatcttcacttcattacctatttgttgcatgcatgtggtttccagagttttccagcaatgaggcacagatacatacccagattagataatatttcagcagctgattagatattttgtctggagctgccctggaccccaagatatcccaggggtctaaaaatagattttggtgaaggttttccaaggtggctattactacattttaaaaaatcaaaattcaagacttgtggtttaactatactaatagagacaacatagctgaatatatgaaattgggctgtcctgaaaatccagaatgttggcatggttattatatctgtggggtagagtaacacctcatctatgggtgctagtttatcctatccctaagcgtgaacttctaggggataattcaggccaggtggggctgagacctcattcctataatacttcattgcatggagtgccctggaactaaattaggtcatttctacgattctgcatcctaaaggccaggcaggaaccacaagtgggacaagatacaggtctatattctctttatctacatgttatattctccttccccaacttaggggaaagtacctttgaaataggaagtattttaaaagaaaaccccaagtatttccaacctaaagtgaagaccaagcttgattggtcagcatggtaggcacctgctggagactcacctttgccactgagctgagtttgccctctattccgtgtgtcctccctgtccctgttcttgtaagaaactcactccagggcttcgagtcaactctctttgtcttgggcctcttcatggggatggctacccataatttcatctgggaaatgagctaaccatggctgggctgggagggactccattcagggcccttcgcccttccttagctcctggagctcttgattgccatcctcccttcccatgactgcccctgacctctcaagctcttgcaaacttctcattgctagctatcttggctctttgggatttcctctacctccttcccaacatgtgtgccctcttggtttcttgggctactcactggggccccagattcactgctgccctggactggcatttccagggattttgtgcatttaaattagatgaattgtaacccccatttcagcaacggcaaggactccaaacacaggcttcccacctgcttcttgggcccttttcctcttcctcagtttcttctacctcttcaggttcctcaggactctcactcttctgttcttcctcctcctccttcaggtcttgaagttctttggtcttctttagaccttcttggaatctggggggcaaaaaggaacagttgagtctggaaagggcagatgcagtgcatcctttcctgagttcctaggggaggggacttgagcagcacctccaataattatgtgcttcctatggttccacaaaacaggaaaaagctgggaagctccactgaatcctaaggcagctcacgccagtaccatttcccctcactcctcagtcatccttcctgtttatgtgaaagtgtgacaaaactgacagggaaaaaatgtggtgcagggtctcctgactgggttcttaacccacaaaacattccgtagggctaagattgtatttgttctccatgtgaccgtggagcttcagcctctcatctgtaaaagagagagggtgacactcatttcacagggcgttggaatgatttttgcaagtgccaggcacatggcttgatctagagaggtactcagtaaatgtttacgaaaccaatgaaggagttcatgcccataaattccaaggatagagcacagtggtgggtgagaaaggcacgctttcaaagagaaacccttgtggtttttctcccccagggtcaatattaccccaaacatactctgttcacttgtcctatgctgagtgtctaacactagcagtttggctgggcaaacccaccactgaagcccatgggttctgtgccagtgggaagctatgtcttcctcatgagctatggagacaggagacgcatagggcaccatacatggttggaggtgattctctaccttgaggcttggtacctgctcaggacttggtctctccagtgctgacaactggccatgggtgctattgaagctcaaatggaggaggaggcagttcgaagttgaagagactccatttataggaggaaggagtgaccaaagcagttctagggagcagagctgcagctgctcctgggcactgctggcagcaacatgactgctttgagcacgtgtcaggaagcctcaggcaccaccaagaggaacccatccaggacccctgatttccagactattctgagcggtggcattctggtggctctctgcctaaaaagagggcagtcttgttattgtctaaccacaccctctgaccctgcttcctcctgtccttcctgtggaacagtcttgctctttcctatgtagttccttcctgtggcaaggaggtcctgcggccactggttacttccctaaagcctctaagaaacaagaaagacccatgggaaggcatcttctgagaactgccaggtgcccttggggtggctgaggtctgactcaccccttgctgtaggcttcttcctccatcctggccttggtctcctgactaagctcctccaggcagctcagggtcagcgcaggagcagaggcttcacaatctgggtccccatttgtctttccactagtgagaagagggaagtacagggcatcatttcagaaaaaggtggaggcctaaaaacaaaaccatgtttttggcccgattcctgattaggagtgaggaaactcaggctttttcagtaactttcagattttttcccaatccttctaccctgagacaagattttataaaggtcctagtccatgaattttccccagcccattaaatacctcaccagctccccttctcctcatgctcccaaactggcgtttattcttattccaggagatgctgtaatgggtgatctacagcgctgagatgaggaaaatgggggcagaccagcacgtttaaggtcattccattcctgttgtctatctttcacctgaagacccccactcatcttttcaaatatccactcagcatgactaagccacaggcacattgtaatgtgctgggggcacattagaaaataaagaaatggtttttaccaacatggaacttagcagaaggaaaagccccaaaaaaggaaagaaaaaatatgtgattaattacaaataataacttttatgaaagaaattctgtacagtgacagaaaataacaaggagagaatgtgtttagagtgaatagttagaaaaggcctctctgaggtgctgaagttgaagcacaggcctgaaggatgagaagtcagatgtattaatagcagaggagagggttgggtgtggtggctcatgcttgtaatcccagcactttgggaggccaaggcgggcggatcacctgagatcaggagttcgagaccagcctggccaacatggtgaaaccccatctctactaaaaatacaaaaattagccaggtgtggtggcacacacctgtaatcccaggtactcaggaggctgaggcaagagaatcgcttgagcctggaggcagaggttgcagtgagctgagatcgcaccactgcactccagcctggatgacaaagcaaaactcagtaaaaaagcagaggagagatcattccaggaagagaatgcgggttatgtaaagactctgagacacaaaaggtgctgagttgtttgagaacttaaaaagaggcagtgtggcaggagttaacttttggacaagagacatttgcaatgcctgtgaggtatccaaagggagatgtcaagtagacagttgaattcaccaaagtgagtcagggaagttttagctggagatattcatttggtgtcatcagaacataaatgttatttaaagccacggggatagacaagattgcttagggagataatatgaagaaagacaagaggaggacccaggaccaagtcatgaggaactccacacttgtctcaggtggaaaagaaggcatcttcagagaaggctgagaagtagcagccagagaggtaagaggaaacctaggagcaggtggagtcttgggagccaggagacaagagctcatcaaggcggaagagtaaacagtgccacacacttctgagtttgaagcgtgcagacaaggtgactattagatttgataatacagaggtcaacaggagcctctgtgtaatgttgggagccaagcacaggtttaaagtaaagaaggggaggttggaaaggggaagccacagacacagcaattcgagtaggaaggagagtagaggggtgtgttggagggagtgtgcagctgaagtaggtcaagggaggatgcacatttgaatgtaggtagaaatgatccagtagaggatgagagaaagggatgcccgaaggaactcagtctttgcaaaaggaaatagggacagaccttggaaaactagagaatctctccttgtttgtaacaaaggtaagatgatgatgaagttgttgggctggagatctggtgaaggaaagtgagagggctcctatgggaatgtagcttaggtattctctataaagtggaaggcaaggtcatctgctgagagtgagaggtagaggggtctaggaaggtctgtggagagaggaggggtgtaaaagagttatatgagaaagaaggaaaacagacatactagaacatcttggtaagatggctgggaggtgctgggagatcattgcaggtatgggatcacaagtttaaaggaagtatccagatggctatgctttccctagaaatcctgcagcccaccttcatgtcctgattcccaatgggagcaatgtcgtcatggaggagtcctccaacaaggcaacactgtgagcagagctttccagccaggactctgaaagatcacagctgccaccctccctgaactctcagacagggtttatgagtgagccttgtatcttctcctcattcttggcatcagtttcccatctcttagttttcctcagaccttttaaaatttacatttagtcaggctggaaaccacaacccattgtgaacaagaaagataacgctctaaaaataccagctgttcataacatttctccttttgcaaattacattatccactcccttccatgtgaccttggcctaatgtgcagtttcctatttatccaaacgactggagcaagaggagaaaaacatagctacagccaagggcagggaaagtaattctttcatgaaatatatatatatatatatatatatatatatatatatatgaaatgagatattggtatcagacttttgatttatatacaactgtcagccttagaggttccttaatgttaagcatgcgtgaaggaggacagtgtagtataaaggaaaagaactcgcctgaggcaaacttggattcaaataccagctccaaaacatgcaaattatttaatcttcctgaacttcagattcctcaactgtacaatggggatagtaatacatacctgatggtggaggtgtaagaattaatgaagaaatgtcaataaactttctggaatatggcactcaacaaattatatctgctattattattgttatatagtaaatgtattggtacattttgggagcaatctgagctacctccaaatatgactcataaaaaatccaggcaattatttatatcatcaagggagagcttgttatatattactgagacacttcagagtcagaggaaccctaaatgtgaactaatttaaggtatggtaaattaacattacattttcataaaatggctttaggaactttctcaggtgcatgtctattgtgtgtcatcacacattatgcaccttagaattttgcagataagtgactgtaaacaaagctctcattgtccttgggtcactgatctctagagaggaaaacttttccctagcagggccaggaagcccatttcatcgactcttttacatgcagatcttctgttcatttcagctcccctatagggctctcatatacattctctcacttgatctttccaatgataagaagagctaaacattaacttatatgtatcaggctgtggtctaacatctcatttaaggctcacaaatgacccaagaaggtattagtgttctctgtttgacagatgaggaaaccaaggctcaaaaagtaggctgaggcatgagaatcgcatttcaagtgatttcatatctgtcaaacagagaacagtaataccttcttgggtcatttgtgagccttaaatgagatgttagaacagagcctgataagtaagttaacttttagctcttcttatcattggaaagatcaagtgagagaatgtgtatgatctcgggaccagcccaagatcatacaaccagtgtgtggtagagctcaaattttaccctgtgcagtctgatatgtgcccattcttctgactgcactatctgccacctaggtggggtattatcccatttcacagataagaaacccaagctcaggttgattaagtgacttgcctaaattcacgttattggtgctgggactctcaccttggtcttctacctgtgtgtcaagatggactttccagccctccatgaacccccgcttttctttcaatagaagccttccatgaacccccacctttctttcaatagaagccctccatgaacccccacctttctttcaatagaagccctccatgaatccccctgcctttctttcaacagaagtctcttcctttcactctgctgagtgaagcccttcctgccctcaggctggaccatggcttccatgctgcccctcttttcaaggctgcttgtctacagtgtaagtggctgggagggcctttgtttactgtgtgtgtgtgtggagggtgggtaggggggagtggaggggttgtgggtagggtggcaagtgggggaaacacaacatgtaaaatgtttgctgttctctcctgacctctaaactgagcttgtagtttcctaaatatcttctctaactatctggaagtttctctctaagcatctttaagactaagctcaaatgccttctcctctgtgaaacctttgctggtgttctcccctcccccacaccctctggttaaagttgatctctcctttttttttttttttccttgagacagggtcccgctctgtcactcaggctggagtgcagtggcatgatctgggcacactgcaacctccacctcccaggttcaagcgattctcctgcctcagcctcccaagtagctgagattacaggcgtgcaccatcacgcctggctaatatttgcatttttagtagaaatggggtttcaccatgttggccaggctggtctcgaactcctggcctcaagtgatccacctgcctcggcctcccaaagtgctggggttacaggcatgagccaccgcacctggccctctctctccctttatgctgccaccgcacctctgtgacagcatgactcacagggaggcattgatgtatgttttagatacctgcatatgactgtcatcacaggaagaaggactgtgtttgggtcagaatagtgcctggcatacagtaggtgcctttaagtgcctgtcaagttgcatcggtttcactatgacttatccagtccctactaggaatgttgtaaaaggcacaagtcctctctgtaaatggttatttcctgagaacccagtgtttgggttggactaaacgaatctgtaatcatggctataaactggagctgagcacagcctgtgcccaccctagggatttctggcccgaaggctcatggatcttggcatctgtcccctgcctgaaatcctatgtgctttctttctgggatgattcatgaaaatgaggctcattattctcacacgtgcaccaggtcaaaaatgtttgtcattgtgctcagctctcagtaatgtgaagaactatttagtcaaaatatatttttggacaggcaggtatattagattcaacttttcccacatggtaaacaatatttgaaagtggctactatcctttgtgatcggcatatcttcttgggctcagcaatatttccaagtcacccccactgccatggttccctctgacaagcccagcccagggaacccaagcttccttactccgtgttactcagttctagatacctggggtccgccacaagtttattggggtgggtggcgggagggaggaattcactccaagataccatcagcaaaggggagttgcttactgtacaaatttagtgtcctgtgaaatctttaaggaatttaccctgggtgcttcaagagtatagaaacatggttatttttagagattcagagttaaaattgctctgtgatacattaacataataacccctttttgacactaaccctgtgcatcatctacatcctggttttgctgatcgctctgtgaacggttccacacacaccctgtctctcaccccgactctgttctccactccatgcccaaccggtcaccatgctctttcaaaaatagctcttaaattcatcctcttctctatggtcacactgaacttcgttttgttcttccagttgggcggtctattaaaagggtaagggcatgtgctctgctatctaccagctgtgtaacctcaggcaagtgacgatttctctgagcttcagtttcctcatctataaaacagagatattaatagtacacctacctcatggaattactgtgaggattaactgagattattaatacaaagcaattagcaaagcacttggcatacagcgaggtgcagcaaatagttaacagtaattaccattgtcatcagtgcagtagttaacagtaattaccattgtcatcagtgcagtaaatagttaacagtaattaccattgtcatcagtgctgtaaatagtcaacagtaattaccattgtcatcgttatcattatcatcattccttgaatactccatactttgtcacatggacaaagcctggaatgttgttaacctcctgttcacctagttgattatgtaccctttagatttttactttaaaagtaagttcctagagggaaacttttttttttttgttttttgagacagggtctggttctgtcgctcaggctccaggctgcagtgcagtggtgcaatctcagctcactgaaacttctcccggctggggtcaagccatcctcccacctcagcctcctgagtagctgggactacaggtggacgccaccacgcctggctaatttttatattttttgtagagatggggctttcgttatattgcccaggctggtcttcaactcttgagctcaagtcatccacttgccttggcctcccaaagtgctggggttacaggcgtgagccactgcccagccaaggggaatcattttctaagctctctcttccccccacttccccagttcccccaaccttacaccaaaatcaggttaggtgctcattttctgtgcatcattcccttagcaacctacacttccttacgatcccacccatcatgttgtattataataggctgcttcccatctgtctttcccgctagactgcaagctccttgagtacattctatgtgcctggcccttggtgattaattgctgaaggaatgaaagaacaaaagactacaattacatagccatttctacttgtggaactgctcttgagctttgttttctcttcatcttcaggactaactttaaatatcactctccacccatatgtttaagtctacaggtttctaggcccttggtgagtgaagagcagttcattacgaaatgacctccaagaacaaggctcagcattctctgaaatctcatgaagcagtgtaaccagctctcaagtatcttcctgtgaactagccacagggtatttgatcttatcctttgcttagccagtgcccttcctgctttgtcactgtatgcttaggaaaggtgaaatcattttaacacaaagctgaatacaacagtctccaaagcaatgtatattaaactataacacattatttctctttcacgatatggatagggcagttagaattgactgtatttgtgtataggacagaagatacgaattcacttttactcatatattgtctcattgttagtctgttgggaatcaagtaaattttccactttatatttatttatttatttatttgtatttttagtagagacagggtttcaccatcttggccaggcggtcttgaactcctgacctcatgaaccacccgcctcagcctcccaaactgctgggatcacaggtgtgagccaccgtgcctggccatgtttccagttttaaatggaaatcacttaacatctttgagaaatccagaaggggaagctgttgttcatcctgaacccctcttcctctaaagatgccctcacctctttgcaaccattcttacatgggtatattcccaactggcgagtcagccccagtgtgcttgacttgccttaatccccactctgtccatatctctccaggttctataaagcactggaaaggtgatgccactattgatcgtcacccattgacactcctaatttggggctgctgcttattgtctccaattttgtacctcagtttcccttaccaaggataattcatgttttcatgatccccactgccttggacagaagtgctcaactggcctggcataagttctacagagttcaggccctctctgtcatgattaagagtctgttgaagagatcttctgccttgagtggctctgcaggcctagagttgggaaaggggctagagttgagggttctctgaagtagggatctgtgcacccaaagggaaggttggcagggagaattttagtgggtttctcagtcagagcatgaggtgaccatttctggagagattcagagaccctggatgaggtactatgactctagggacttggtaagtttctgtaaactcggttacttccatgtggtggtggttgtgttgcctcttgacaatttccctgtagtgatcaagaaaagacagagagagagaccccaagagaccctctataacacgaaggacctgtgagcttatgggggtgaggtggcaaagagacgaaatgctgggcaaacttcaagactaacaaatcactgggtgataagctggtggctatacagaatgacagatgtaggaggcaggctgagtctggagatgggagcttgtctgtactgaaaagggtcccaacatacaggttccctgccagatagcaaaacttttctaacagcaaagaaaaacaaaggactaaagctgtcttgaggcaaggaagaaggaagaataaggtatatgttttaccaagtgagaaaagacacaaggggaaaattctgagaggcagcaggtgtgatccagatgtttttcagcaagcaaatgaaagaatttgaaaagtaagctataaaatcctctgagtgcatagaaacagcctgccttactctggctgaggatgaaaagatctgcaaattgcatagatgcctagaaaatcacagaaactgctggctgctaatccaatatgcattttccttcctacttcctaacagcaacatgattctgttcaggaatttactcttcttcatggagtcattttgctttatgggaagctgaccctctcaccaaccccagggaatagtttaatcccataatgacaatccctttcccaaagtgattcttttagaaagggacttccttccagatttgtcaatgagataatagagaagactggtgaaaggcttctgggtttattcctaagaaaggaacatggcaagaaacagtccctttcttcctctaggtattgtcctgtctggaggggatcccaggaactaccagccatttgccacaatcctgatgatgaagttaacatacaatgtggccagaggcaaggaagttgtagactcgctgagctagagccctgctgtgccataccaggagcagctctacctctggacttaattaagtcccattgagttggggctttattttgtctgtagcccaaggaatcccaattggcagagaaggctccagccttctctgggctctctaagattgggtacacttggcctcactcagggcatcttcctggttcaagaattttgcaaacaggttctgaaatctttgtgggtttcagactcccattcatttcccttaaaacttaatttgctttccactgcattttggggataaaaatgggaggaaggaaagtaaaatggggaaaatttcctgagagatccctgaagccaagaggaaaatcgacaaacttacttttccaaaagtgcaggcagtgctgaagtgacaggtaggctgcctttcccattgggtgattccgactgagtgaaaaacagaagacagagaattgaggatgcgctatggaaggaagaagccagagctgctggatttctgatgatgctgggagcggggctgctgcttctcctctttcctccatgcccccactttccaatcttcatctgagcccaggacttggccctttccctcaggccttccctgtcctcctttcctctagggcacatgcagcttcctccttttccttcacctctgctaagtttccttaagtgaagaggaaagtttacatcttgaggctccattctggagaggagccatcagtttttctctgtcccgtttagcaactgtgactgaacaccagtgggcctcctacaaatgcaggtctcaggctccttacaatagattcacacaagcccatcactgtccctagagacatagctccaggtacaattctcaggagatgcaaatcactactgaaagctcaaaccatcagaaatttctttacaatacgttccccaggatttccaggttgtgttgttgcaatggatttggtttaagtaatggttctcaatgttggctgcacattagaatcacctgggggaggttttaaaaaagtatcgatccactccagaatcttggtgtggggcctgggggaataatggtttaaaagtaccctgtgtggtttttaatctatggccctgattgccaacccctagtctaaaggaatatatatttggaaaataaatttatgcttttaggcaaagtatgggaaatagatctgttaaaatacactaaccagtcctctccaacattcttaaacatttttttcaggttgttttattttagtgggtaatttgggaatttaggttgatttcatagacgactgaaatgcttgaggcaggaagcagtgaataccactcattggtattacatagagcttgaatttccagttgcttacacaatcagattgtttccttatagggtagtgctagtcataggcaggggatagagaaaccactgaagaaagaattagagagaattagccagatgcacaaaggcctgggatacagaaaatattttgttatatccaaacgtctttgtctaaaagaaatggaaatgtatttttcctgattattaccaatacattcttattatagaaatataaaaaggcatcaggaagaaaataaaaatgaactattttaccattgcctagagataaccattattagctgtttcacatatcttctaccagaaatttctatgtctacacacagaaacacactcttttaaaaagtacaaaacagaattatactgtttatacactaggttttgtatattctattttacttgcttttgattcataataaattatggataattctacagaaaccccttataggaatatccatttgcttaaccaatctcttattagtgaacatggagttgtttcccacttttcattattatgaacaatgctacaatgaactgaggcaggagaacaatgggttgaagaactcaggctgtggaatcagagaacctagggttcaaagctgttctaccacctatcacacattacaaacttcagctacttaagcccactgcagagtagaaaaaaattgtaaccaccttggcagattgtggtgtaagcacaaaaagagttatcatttgcaaagaacgctgagctgccaacaccatgctgagggcagtgggacttcccagagtagtagaatacatgcagcctggtgtatattgagtttttgagcctatcactcagattctattctggaaatttcctctccttgttgaccctgcccccatttggtcaccctccctgccctaggactgagtacgaaggaaaggttattctactattctgtgctgggaggcagacatcgtcatacttaccaaggctggtaaggagggaatggatgatgagctgggagtttggccaggcagattcagggcattaaacttaggaaccacagcaacgctgaccctccggcgaggcatattctgcaggaagagaagtgaccaggctcactgtcttggaggtagcaatagccatagttcagaagggctgggaaaaagcctcctcatttctaatgctgtaatggcattcactggatattttggttttgcagtagcaatgatagaattggtgtggagagagtggccaaagttgacccaaattttctgttgttggtgagtgaacgctcaatctgttctattttagcttatgagatcttggagatacagaatggaaatgaccccacagtctctgggtaacaccctggagactgtattcaagctgcctgtagcaatatgaaggcttatgatcacttcatgttcatttaagggatgtatacatagttaaggaaaccatgagcaagaaaggtaagatgtcagaggctaaacttgagagtgtggaaagccgaatagaaactctgttcagagattctctggcatccatggatcccagaatgaatgattgtttgggtgaccatggaaacttctgtcatactccttccaggagccctggtattccttgaacatgcatacctttcccagcgtgagggacatggaccgtgccgtgcgagggaccccatcttctgcagcaggagggagcagagaagagaacacaggtaagtttcaggctaggcaccagcaggaaacagaaactaggctatcgtatccatgggccagaactggccctcaagggatagcccaagggtctgggtgttggggacactgagtttggcacttcatcctttgagatggggctgcagagtgggggctttttttggacaaaacctttatcctaactccccttctcactataggaagccccagtcttggacctctgatctttatctgaccccactaaacacgctctgcataacaccctagatagtgtatgaaaactactcagcaacacgaagacttattgggttatttcatgctcgttcaaggatgtacagtcagagaaactatgagcaaggaaggtgtggtgccagtaaataatgaaaacttgctaacagaagtagtttcaatatgttacctaccaaatgactcagagcaaaggaagctaccaccccaggattttcttctccttactacatacattaagtgatataactcacgtaatatgtttagcttcatacctggataatcctaccaccaggaaacacctgagtatgtgcagagaaaggtatttgctagttcaattcaatttgattcagtttaaccaatatcatttagcctgcatatctctctctttcatatccatatatttttggtgagtctcttgaaaagcacatagccgtatgtgttttttcaaaaaaaaatttttttttcttttgagacagtctcactctgtcacgtaggctggagtgcagtggcacgatcttggttcactgcaacctccggctcctgggttcatgtgattctcgtgcctcagcctcccaagtagctgggattacagatgtgtgccaccacacctggttaatttttttatttttagtagaaacagggtttcgccatgttggccaggctggtctccaactcctgagcttaaagtatctacccgcctcggccgcccaaggtgctagaattacaggcatgaaccaccacacctggcctgtttttttcataatctaatctgagattctctattaaccaatagatttatactagttatagttcttgtgattaatatatttgtatttatttctaccatgtaattttatattttctatttattttgttttattcattgactttttctacccctcctcccacctgacacttttgtttggaaattatacattctatttttaacctttagcatgtcctcttaacttttgaacatactgactttaaatttaaaattaaacaagctctctattcttttcttgaataaatcttaaaataataaccctccctcttaattatattgctttccaggatttttatttcaccttgtgtttgtattcttaaattattcattatgtttgttgatttctacagagagtgcttatttagatttacccacgtttacaaatgtctttgttgactattctttcttgtatcctacttgtttcttttgagctcaattttttttaacttttattttaggttcagggtacatgtgcaggtgcattacataaacttgtcatgaagatttgttgtacagattatttcgtcacccaggtattaagcctagtagacagcattgattttttctgctcctctccctcctcctactttccaccctcaagtaggccttggtacctgttgttcccttgtttatggccatatgtactcaatgtctagctcccacttcttagtgagaacatgcagtatttggttttctcttcctgtgttagtttgctaaggataaggacctccagccccacgcatgttcctgcaaaagaggtgatctcattcttttttatggctgcatagtattccatggtgtatatgtaccacatttttctttatccaatatgtcattgatgagcatttaggttgattccatgtctttgctattgtgaaaagtgctgcaatgaacatttgtgagcatgtgtttgagttcaatttcaatcttccttaggtacatcctctagttgttctttcagcgagggtctatgagaggtaaactttctcaattgtctccaaatagtctttaccaagccctcaatcttgcatggtatcttagccatctgtgttatctctagattgacagttattttctcttagttcttttaagaaattattccattggcttcttctattattgccattgagaattgtcattcctttgtaagtaatcttctctttgatgacttttaagatcttccctttgtctttactgttctgcagtttctctttggtgtgtttttatttttcctgcttggaattcacgtattttctgaatccaatgattgatgactttccttagttctagaaaatccttagccattctttcttggcatattttctctccttggttttccccttaaggatggcctaataaatgtatttgggactttctcattctgcattctatatcccatatctcaatgcttctttcataattttaatcaatttatttctctgaactatacattgggtaacttcctcaaacctatcttcaagttaactaatttttcttcaactgtgcccaatttgatttaaatgttataatcaatcaggataagctaggttatactagtttaatagcatagtaataataagcaactccaaagtattagtggctgataacaaggaagatgtgatttgcttatgctacatgctcatttacttccaagtctgcagcaagcttggttctctgtttcctcactctggactcagcctaatactggccttctactattctggagcaatgatggttatcatgttaggaggaagaaacagggcaaactgcattctagttcttagaggcctaggttcagatgtgacatgtccttctactcatatttcattcaccaaagcaaatcccatggccttgccttgtgacttcaaggggatgggtaaatgtgcccagaagaaggagatctggaataatgaagaatagcctcaaatatagtaactaccacatctaaactcttgagtttttgatttctgtgactttattcctcattttgaggagttctattttattcttctttgataactgtattcttttactctgtttttgatccattattttatgtctccaataatttttgtttaagttagagacggtctcactctgtcatccagaatgaagtgcagtggcatgatcacagctcactgaagccttgacttcctgggctcaagcgatcctcccaccttagcctcctgataagctagaactacaggtgcccaccaccacatctgactaattgctttttatttttattttttgtggagatagggtctcactttgttgcccaggctggtctcactttgttgcccaggctggtctcaacctcctggcctcaagcgatcctttcaccttggcctcccaaagtgttaggattacagacgtgagccactgtacccagctacctgtaacaattttaagcttatcttaaaaaaattgtcagatcattttattttccgaggttcttaggatataatcctattgttttgtgtaactgatgacttttgttcatgatgaattgttttcttgtgtattttataattttaagttgtgaagtcatcttcagtgaggctttattagaggaatcctgtgtgtccagatgcagggtctgtctctccagagtacttttctgcttatttctaacatatcttagaagcaccatcttgctgttcttttcaaatcctctgcatattgcatcatcactgctgtcactttgtgagcacgtactttccctatgaggaaggagaaagtgttttttcctactacagtccagggtgaaacaaatttccttgtttctctgctggttggtgattattatttttccttatccaaattccatctgaggatatagtccttggacgcccttaactttctgtgggaatctgtgtcaactctctaccataggtgttccaggccttgtctcagaccacaggcaagtgcaaaagctcagctcccagataaccaaggctgacacttgtccctaaggaagctgcagggtcagcttggtttcagttctcttttcttttcttgtatctgggtatttcaatttattttcttgtggattcagctatttagacaaaggtttgctttattttgtccagcagcaatttctaagtgcttgtggtcaaaagattttcaagttttccagtcagccaaaatagcagaaccagaaaatattctttacatgtgaagagttcatataaattagtaaactaccaagcttacaagtggcaaaggtcataaatacagaatttttaaaagcagaaatacaaatgttccataaacatttggaaaggccaagaaatacaattaaaacaataagacaagacacaattgtggcctatcaaagtcatggatatttacaaaaagaaagaacaagaattgtgtcaatggcacggtgaattgagtattgtaacccattcagtgaaaacataaatgggttatttgaaaataatttgctttaagagccttaaaaaatttatttcccctgagctagtattcatacttctagaaatctacactaaggaaataatctaaaatgcagataattggtaaatttcatattcagaaagaaacatgttatttttaaaaaatgtatatcaccttccttgaaatcagggatattttatttactgcagtcttcaaaaccccaggcatagacaaagattgcagaggttgtataaaggcttaagacacaaacactattagggaacagtcatagagtatcttatggaaacacctgctgagtggttacggccactctgcctagcccaagctgaggtatagcttggaagaacaactggagtggaaacaaatatcagaaaaacacgtacagctatcgttgacctttcctacggtaagcgttttctcatcctcctagagtgaatgtgggactctgtggtgtattctcctcggaagtctgctttcttctgtcatagcactggctacactgccttgacttcccaaaggttgggagctcctttgggtctgtgactgtgtgccctttacctctatattccagtattatatagggcaaaccaaaggtactcaataaatgtctgtagaatgaacgaatgagactcatgggtaactgctcatcctataaatcttaggtaaggtggtttgcaggaggccttgtgcagcaataaatgcaggagtccacgcattaggattcctttggcggcaacttcctcagcttccaacactgacggaaaatggttagaggcctaggtgcatgtgggtcaggagccttgctgacagatccaaagctgacagtctggagcatgtgtgcatgctgcctttggactctgggacatgtcactgatattctccaggaaacttgtgaaacctcctgtttataaaggtttctccatctgttatactttctgtactttcccttctgcagctcttggtaacacggatgtttgcattccacagggattcctgttgctaaaaggtctgttttctcctgctagccaccctcatcagccagagttcaaaccctgacagtgcccatggagagatctggtccaaggcaccaacctcttcctgctggactgagaaagagcctcctactgtgtctctctttacctcagcttttgcacacctccaatatattgtccactgaagtcagaataatctaaaaataaaggctgattacctcatgtggtataaactta

SEQ ID NO: 1681 - DNA, 43829 bp, Homo sapiens
gatgagcttctcactcacgttcaccgagctggccaacatcgccatcccacagtgcggggtgctgaacttcaaggccctgcacctcctgctgcacggcatcttggagcacatccacatggccgagctcaagaaagtcctctcaggcgatgaggacttcctgcagacctcgcaggtggtcatcatgcccagggaaggagacgcccagcctatcctcaaccccatgaagaggctcagcaatgtcttcgaccacgtggtgagccgcctcgacaagttggagaaccagctggccctgctgcaggacctgccctccactgcccagctgctggaagccagccagggcactgcccggcccgtccaggacctgtggcatctgatcaagctccggaagatggtggagggtcatgatgaagtcatggccaaggtacgcccccagcctccagacacttcttttcctcccttcaccactggctctctcctgggacgtcttttttttgtttttgagactccgtctcgctctgtcacccaggctggagtgcagtggtgtgatcttggctcactgcaacctccgcctcccgggttcaagtgattctcctgcctcagcctccctagtagctaggatttcaggcacatgccaccacacccggctaatttttgtatttttagtagagatggggtttcactatgttggccaggctggtctcaaacccctgatctcaactgatccacctgcctcggcttcctaaagtgctgggatgacaagcgtgagccactgcgcccagccttctcctgggacatcttgttgcttactcacctacgatgggccatctccttatgcagagtgggaagaagggtgctttagagtcaggcacaaccaaaacgccaagcttgcagcctccatcaagtattgcaaagaagccagacacaaaaggctacccagtgtatgattccatttatacgaaatgtccagaataggtaaatccatggagacagaaagcagtggttgccaggggcttggaggaggagagaatggggagtaattgctttgtggatatagggtttccttttggggtgatgaaaatgttttggaactagatggaggtggtagttatacaacctcactgatgtactaaatgacactgaattgttcacttaaaaatggctaattgtacattatgtgaatttcaccccaatttttttttgagacagggtgtcactctgtcatccaggctggagtgcagtgactcagtcatggctcactgtagcctcgacctcccagactcaagcaatcctcccacctcaacctcccgagtaactgggaccacaggtgtgcaccactgcacctggctaatttttgtattgtttgtagagatagggtctccttatgttgcccaggctggactcaaactcctaggctcaagtgatcctcctgctttggcctcccaaagtgctgggattagaagcgtgagctactgtgctcagccttaccccaatttctaaaaaatgcctggaggagctaccatgggagaagtaccagagtagtcacggtgaacaggcacgcccggcctagcaggggagatagacacaagtgagtgagaatctccaagaaccagccctgtgaggagcagcaaagaggcattccttctgccttacagaagaggaaactgacgctcagaggagctcagtgattggctgaaggcccagcagctggtgggcaagggagctgcgcgctgaggcgtggcctctgaccctggctcacctttgactgctgacccctgctaaccccgaccagcacgtggacagtgttcagttactggcagcccaagaagaaataagaaagggaaaataagccgagcacagtggctcacacctataatcccaacactgggaggccaaggcgggatgatcacttgagcccaggagttcaagaccagccttggcagcgtagtgagacctcatctctataaaaaaatgaataaattagccgggtgtggtggcgtccacctgtagtcttacctcaggaggctgaggtgggagaatcacttaaccccaggagttggaagctgcagtgagttgtagtcactctcctgaactccagcctgggggacagagcaagcccctgtgtctaaaaatagtaataataatttggccaggcacagtggcgcacacctgtaatcccagcatttcgggaggccaaggtgggtggatcacctgaggtgaggagttcgagacaatcctggccaacatggtgaaaccctgtctctactaaaaatacaaaaattagctgggcatgcttgcgtgcgcctgtagtcccagctactcgggaggctgaggcaggagaatcgcttgaacccaggaggcggaacttgcagtgagccgagatcgcaccactgcattccagcctggtgacagagcgagactctgtctcaaaaaaaaaaaaaaaaaaaaaattagccaggtgtggtagcaggcacctgtaatcccagctactcgggaggctgaggcaggagaatcacttgagcctggaaggcaggtgttgcagtgagttgagatcgcaccactgcccttcagcctgggtgacggagaaagtcttgtctccaaaaaggagaccatccagcgatgactgccttcctatccctggaggcagcatgtcctagtcctctctgagccagaactgtgcccgttggtgtgtccagctggatctccctgggagtcagggccattttcagagcgttcccaagttaccactcttctctttcaaattgaggggaaactggctggatgtggtggctcacacctgtaatcccagcactttgggaggccgaggcaggtgggtcacttgaggtcaggagttcgtgaccagcctggccaacatcatgaaaacccgtctctactaaaaataaaaataaaaaaaaattagccaggcatggtggcgcatgcctggaatcccagctactcaggaggctgaggcacgagaatcgcttgaaccctggaggtggaggttctagtgggcggagattgcgccactgcactccagcctgggcaacagagcaagactccatctcaaaaaaaaaaaattaaaaataaataaataaattgaggggaaattgacctaacataaaatcaaccatttaaaagtggacattaaacactgaattaatgaaaattcggtggcacacgatatattgacattgttgtgcagccagccacctctatctagttctaagccatttccatcaccctgaaaggaaaaaaccctatttcccctttacttctcctccctgcaacccctgacaaccactaatctgctttctgtcttacggatttgcctattctggacatttcatctaaaggcataatctgtgtatttcatagagacagaaagtagattagtggtttccagaggctcaggaaggggggaacagagagagactgtaacagggacgggatttccttttaggagaatgaagtgtcttggaagtagatagtggtgtacataccaaatgccctcaaattgcacacttcatttttattttatttttatttttttgagacagagtctcactctgtcatccaggctggagtggactggtgcaatctctgctcactgcaacctctgcctccaaggttcaagtgactctcgtgcttcagcctcctgagtagctggaaatacaggtgcgcgccaccatgcctggctaatttttctttgcatttttatatatatgtttgtttttgagatggagtctcactctgttgcccaggctggagtgcagtggtgtggtctcagctcactgcaacctctgcctcccaggttcaagcagttcttctgcctcagcctcccaagtagctgggactgtaggtgcccgccaccacacccagctaatttttgtatttttagtagagacgcggtttcaccatgttggccaggatgatcttgatctcctgacctcgtgatccacccgccttggcctcccaaagtgctgagattacaggcatgagccactaagcccggccaatactaaaatatttttatactttaatattatgggtattttaccacaaaaaaaagcagagattggcagaatagataaaaaacaaacaaacacacaaaaaaaaaacatgacctaactactatatgaggtttgcaagagacacatttaagattcaaagacacaaatagggccaggcacagtggcatgcacctgtaatctcagctctttgggaggctgaggcaagaggatcacttgagcccaggagttggtgattgcagtgagctctgatggccccactgcactccagcctgggtgacagagtgagatcctgtctctacgaaaaaaagacaagacacaaatacgttaaaagtaaaatgatataaaaagatattccagcggggcacagtggctcacccctataatcccaacactttgggaggctgaggtgggtggatcacctgaggtcaggaattcaagaccagcctgaccaacatggagaaacccgtctctactaaaaatacaaaattagtcggatgtgatggcacatgcctgtaatcccagctacttgggaggctgagaacggcttgaacctgggaggtggaggttgtggtgagccgagattgcgccattgcactccagcctgggcaacaagagctgaaactccgtcaaaaaaaaaaaattagcctggcgtggtggcgggagcctgttaatcccagctactggggaggctgaggcaggagagtcacttgaacccaggaggcagaatttgcagtgagccaagatcgcgccaccacactccagcctgggtgacaaaagcgaaactccatctcaaaaaaattaaaaaataacaaaagatattccttgcaagcagtgaccagaggagagtgggatcttctcagacaagatagacttcaagacaaaaattgttactagagacagggctgcctggggtggctgagggcaagttatgagggccttgcaggcaggatgggcagataccaggatccaaggtgccggcactccagaggcagcttgccccctggcctgccttgatggatgaaggcttctaaaaagcagctcaacagggcaacccacccagctcacaaaaggggctcgtggacaggttcagacctagctgtacagccttcaggactgtttgtgcagctaaggaatgtccccatcattagagaatcttgccttgtcccagcctgattgaagttgcccgaggttcccacaatgacccattgaagggggttgccatggcagctggttctagaatgatgcaaactgcacagctaactgtctgcacccaccaactagtgaggctgccggggggtcgcctggcaaacaaacgtgttttacaatgttcctttcgcgagtcccagtctgcctccttcaggcctcggtttttctcccctgtaataataacctcttgcagctggcctcacaggcgaaaacaagggatgatgtcagctgtttgttgttgaaactgtttcgtctaaccctgtttccataacattgtgggtccaaggcttagggtatttttttaaattgtagaaaacctttaacttattggtctttttgagggaatgagatgcatcgccactgcattacaactaagccattaatcctgtagcttcatcaacattaactggttcactttcatgatgccaatggggaatcagttctttctacagatgttcaagagaaaagattgccaggtgtggtggctcatgcctgtaatccccgcactttgagaggctgaggtgggaggatcgcttgagcccaggagttcaagaccagcctgagcaacatggcgagactccctttctaccaaaaaattttgaaattggctgggcatggtggtgcacctgtagtcccaggtactcaggaggctgaggcaggattgcttgagcctgggaggtcgaggctgcagtgagctattattaatattacagcctggacaatggagcaagactgtgtcaaaaaaaaaaaaaagagaaaagccttttgagaagagtgcaagttcttttatatatttacaaaacctttattcactcaatttttttgtttgtctttattttttaagattgtattacttgattttattttacactaggtggtgggcacacaaagcaatccttaataaagttgacaattagcttcattcaacatttttaataatgcacatataaaaaaagtattcatcttacaaattcttctgcaatccaaacatataatagcttggagaacatttagaaaacaaaagccaatgtaaaaagacagattaaaacaactagaacagtacaggttttatttatatggctcgaattttacaggtttcttactgtatcatcagtgtcagaaatctgttctgtcagctggctccattgttctggatttaaagaaataccttttcttcctggtttcatttcaccttcaggatccatccaatattctccaatatcaattagcactttgcctttaaaatcttgaacgccaacgtacctcattttcccaatctgaaacatgttaccatctctgctgctgctcctctgtcagaagatgacagagctctccaagtttcgcctgtcttttgcttctttacaggtttttctggagcaacttgctttttcctctttaagtttttgtcaacctcactgtcagaatcactgccagaagagtttgaagaaacaagttcctttgctttaggcatcgcttcgctcggctctagcagtggaacaccctcttgctcgttcgctcatgactgactcgtttgtttttatttttaaggcagggtctcactctgtcgcccaggctggggtgcagtggctcgatctcagctcactgcagcctcaacctcccgggctcaaccctggaggcaatcctcccacctcaacctcctgagtaggtaggactacaggcctgtgccaccacactggctaatttgtattttttgtagagacagggtgttgccatgttccccaggctggtctcgaactcttgagctcaagtaatcctcccacttcagcccaaagtgctgggattacaggcttgagccactgcgcccaccctctgttaaccttttttttgtttgtttgtttgttttgagacggagtctcgctctgttgcccaggctggtgggcagcagcatgatcttggcttactgcagcctctgcctcctgggttcaagcgattctcctgcttcagcttcctgagtaactgggattacaagcgtgcaccaccatgcccagctaattttcgtatttttagtagagacggggtttcaccatgttggccaggctggtcttgaactcccgagctcaggtgatccacccgcctgggcctcccaatgtgctgggattacaggcatgagccactgtgcccggcctctgttgacttttaaatcataacatttgtcttaagactagtggtaactgccaggtgtggtggctcccacctgtaatcccagcactttcggaggccgaagtgggcggatcacctgagctcaggagttcaagaccagcctggccaacatggtgaaatcccgtctctactaaaaatacaaaaattagctgctagtcgggaggctgagacaagagaattgcttgaacctgggaggcagaggttgcagtgagccgagattgcgccactgcactccagcctgggagacaaaatgaaactccatcttaaaaaaaagaagaagaaaagattagtggtaactggttttgctttgtttttagccttaaagtgtttttggctggctttgtgaagtccattcgtggacttctgccctcctaatttgttcttggccattgtcagacttggttggatatgtgcacgcagcttctgcagctcaggtgatgccatctgcatgcactgggtccaggaagtccccgggagagggatccagtctaaggggatgctaacaacctattgttgctttctttatttctaaacaccctccccattttactccctcagaaactacaaagcacctgctgtatattgtacaggttaaaatgatgtcacatttaaattggatttttaaggctgggcgtggtggtttacgcctatgatcccagcactttgggaggctgaggcagaaggatcacctgagctcaggagttccaggccagcctggccgatgtggcaaaaccttgtctttactaaaaatacaaaaattagctgggcatggtggtgcgtgcctgtagtcccagccactcgagaggctgaggcacgagaatcgcttgaacccgagaggtggagatttcagtgaaccgagatcgcgccgctgcactccagcctgagcgacagagcaaaactccatctcaaaaacaataaataaaatacaaataaaaattgggtttttaactattttgtaacattgcttaaaggtgtggaagacactttggggtgttagaggaccaaggttgccatgattgcagtaatggtaacgaacactcagatgtcattggtgtcaccttcacagtgtcgtgaagtgctcttacattcctcgtttccgtggagggaaatgttagcattcctgttttccaaagtcccacatgtgaccgtgtggacaagtctagctgcttgtctgagggggtgtttgccttagcccctttttcaggcctcttaaggcctttgtaagtactgggccctagctgaaccccagcatccttaaagccctcttgagagagagagagagcaggtttggacaagccctgcctcgaggactatggcatgggtcagcttctggaagggcaactgtcggggacgcactttcccttgaactcagcaccatccaagccctgaatgtggcccagtcaccctgggcagaaaaaagacctcagccactttccccacagctctctctcctgccccttcttccccaggacaggagtccagagcatgtcccctacatgtgagacagcaggtgggtcttgggtgagaaacctctcactgcatatcacacagagggggaggttgtagtaagctgagatggcaccactgcaatctccacgcaagatgcagggagtctggctctggcgcccaggctggagtgcagtggcacagtctcagctcactgcaacctccacctcctgggttcaagtgattcttgtgcctcagcctcccgagtagctgggattacagctgcccaccaccacacccggctaatttttgtatttttcgtagagacggggttttaccatgttggccaggctgatctcgaactcctgacctcaggtgatctgcccactttgtcctcccgaggtgctgggattacagacatcagccaccacacccagcctcgtttctaccttttgactgttatgaatatgctgctataagcattcatgtacaaacttctgttttgtttttagggacaaggtcttgctctgttgccctggctgaagttcagtggtgccaccatagctcactgcagcctcaaactcctggtctcaagcgatcctcccatctctgcctcccaagtttctgggactacaggcgcttgccaccatgcctggctaatttttaagttttatgtagagatgtggtcttgctgtgttaacagcccacgctggtcttgaactcctgacctcaagcactcttccaccttggcctccgaaagcagtcggattacagacgtgagctaccatgcctggcccatgtgtgcaagtttttatatggacctatgttttcatttcttttgggaatatacctaggattagaatcagagatcatctggtatctctataatcttgtgaggaactgccacactgacttctaaaatggctgcacaatttacattcccagcagcagtgtatgagaattacgatttctccttatggttaacagcacttagtatctgactttcgcttctgaccatcctacagagtttgaagtggtatctcattgtagttttgattttcatttccctgatgacgaatgatgttgagcatcttttctttttatgtgcttattggccatttacacatcatctttggagaaatgtctattcagatctttgcccatttttaattgggttatttgtatcattgagttgtaagagttctgtatatattctgcatatactgggtcagatatatgatttgcaaaatgaggttttctcccattttgtgggttgtattttcattttcttgctggtgtcttttgaagcacaaaaggtactttttattatgactttaatctcttcacttgttttaggtttactcggattgtctatttctgcttgagtcagttttaatgattttctaggaatttgtccatttcacctaaattatataatttgtccacaggcaattattcatagtatttctttataatcctttttatttctgtagagttgatagaatgccctctctttcatttctgattctaataatttgagtctgattcttggccaatctagctaaaagtttgtcaattttgttgaccttttcaattaaccagtgtttagtttcattgatttttctgtactatttttttatcctctatttcattaatttcaccatattctttgttattttcttatttctatttgttttaggttcagtttgcttttctttgttccagtgtcttaaggtggaaggttaagttattgattcaagatctttctttgttaatatagtcacttacaacaataagtgttctaagtgtctaatcaccactttagctgcatcccgtaagttctggtgtgttgtgctttcattttaactcatttcaaattagtttctaatttctatttctattgtgatttcttctttgacatatttcttttctttttttttttttttttttttgagatggagtctcgctctgtcacccaggctggagtgcaatggcgcgatcttggctcactgcaagctcagactcctgggttcacgccattctcctgcctcagcctcccaagtagctgggactacacgtgcccgccaccacgcccggctaatttttttttgtatgtttagtagagacggggtttcaccgtgttagccaggatggttttgatctgacctcatcatccgcccacctcggcctcccaaagtgctgggattacaggtgtgagccaccgcgcccggccttctttgacatattccttttgtgatttcttctttgacatatttgtcatttagtagaatgttttttaaatttttacatgtttgtgaattttcaatagtttcttctgttgcctttttttttttttttttttttttttgagatgaagtcttcctctgtcaccaggatggagtgcaatggcatgaccttggctcactacaacctctgctcctgggttcaagcagttctcctgcctcagcctcccgagtagctgggactacaggcacgcaccaccacacccagctaatttttgtatttttagtagagatggggtttcaccatgttggccaggatggtctcgatctcctgacttcatgatctgcctgctgtagcctctcaaagtgctgggattacagatgtgagccaccacgtccggcctgtttttgttttttgtttgtttgtttgttttaagccctgtctatgggagccattggcaatccaagaacttttttattttatttttgaattatagagacgggagctcactatgttgcccaggctggtctggaactcctgagctcaaatgatactcctgcctcaagctcccaaagtgctgaattacaggcatgagccaccatacctggcctcttctgttgctttctaatttaattccattgtggtcagagtatgtattttgcataatttcagtccttttgaaatttgttaaggcttgttttatggctttaccatatggtctaccctggagagtattctatgtgcatttgagaataatatgtattctaccattgttgagtggggtattccgtagatatctgttatgtctagttggtttatactattgttcaaatcttctcttttcttgctggccttttgttttgttaattttatttattttatagtgacagggtctcccttggttgcccaggctgctctggaacccctgggctcaagccatccttccactgcagctacccaaaatgctgggattacaggtgtaagccactgaacccagcctcttgctcttctttttttctttttcttttctttttaatttttttttttttttttgagacagagtctcactctgtcacccaagctggagggcagtagtgcaatcacagctcacttcagcctcaacctcctgggctaggaagatcctcccatctcatcctcccagggacctgggactacaggcatgcaccaccacgcctgtctaattttggtatttttttgtagagatgggagaccgctatgttgcccaggctggtttcgaactcctgggctcaagtgatccacctgcttcagccccccaaaatgctgggattacagatgtgagccactgcacccaggatactgttctttttatctcgggttttgttttttcgagatggagtcttactccatcttgtgtgacttactcagatggagtcacacaggctggagagcagtggcataatcttggcttgctgcaacctctgcctccggggttcaagtgatcctctcacctctgcctcccaagtagctgggattacaggcaaacactaccacgcctggctaatttttatatttttggtagagatggggtttcaccatgttggccaggctggtctcaaactcctgaacttcagatccactggcctcagcctcccaaagtgctgggattacaggtgtgagccaccatgctggaccttccttatcttagttattctattcattactgaaaataggaaattgaagtctcaaactattcttgttaattaactatttctccttttgtaactgagtacccccatttttctaaaagatagtttattttaaaaattattttctcttcctttctccttccccactgctccccacttcctacttagccctttagaaatgcaaagagaggcctggtgagttggctcatgcctgtaatcccagcactctgggaggccgaggtgggtggatcacttgaggtcaggagtttgagatcagcctggccaacatggtgaaaccccattagcagggcgtggtggtgtgcccctgtagtctcagctacttgggaggctgaggtgggagaatcacttgaacccgggaggtgaaggttgcctaggtgacagagtgagactctgtctcaaaaaaaaaaaaaaagaaggcaaagatagtctttgacccctccttcaccagtcactccctacagggcaagttcatgtaactcctggagagttaagaaacagacttagagaccaaagcacgccccttataggactttcacctgggaacttccactctccagggattgcctgagagctcagtctcaccaggaggacatgttgaaagcgtgcccatggccacttttacaacttacttcttcccaggaaggtgccaactcagctgcccagtagataagacatcacgctcaaaaggagacccctgcccttgctggctgtatcccctacgtcttaaaagtgcccactttttctccagaagtgaagcggcacgtttaaagccagggcgctttgtgccccttccccaagctagaacttttttattttatttttgaattacggagacgggatctcactatgttgcccaggctggtctggaactcctgagctcaaatgatactcctgcctcaagctcccaaagtgctgataattcggaataaattcactttctttttggtaccagaccttgctcatggtaactgaaccctgcaatgcagcgagcaaccaacgtgcttttcagttacactttcagttctgtcagtgtttccttcatgtattttataaagggctctgttaagtgcatgtatgtttataattattatatcttccagatagtttggccctctgagtggaaaaaaactcagtttctttcacactgttctcacaacacgcttttttttttttttttttttagatagagactcacttcgttgtccagtctggagtgcagtggtgcgatcttggctcactgcagcctctgcctcccaggttcaagtgattctcctgccccatcctcctgagtagctgggattacaggcacgcaacatcaggaactgctaagtttttttgtatttttagtagaaacagggtttcaccgtgttggccagactgttatcgaactcctggcctcatgttctgcctgacttggtctcccaaagtgctgggattataggcatgagccaccgcgccaagctcgcaacacacttctgacaccagatgtgtgaggatttctccctacagcaagcaataatttctgcaggcagcctgcttccccttttgccctccagagccaggctccacaggagcccgagagatcctttaaaatgtaaatacagaccgggtgctgtggcactttgggaggatgacgcgggcagattgcttgagctcaggaattcgagaccagcctgagcaacgtggtgaaaccccatctctaccaaacaaaaacaaaaacaaaaacaaaaaaaattagctgggcgtggtgatgcacacctgcggtctcagctacttgggaggttgaggcaggagaatcacttgagcccaggaggtggaggttacagtgagttgagatcgcgccactgcactccagcctgagccacagagtgagactccatcttagaaacaaaaagtaaatgcaaccctgtctctcctgctcctgatcctccagtggctcctacccagggatgggctgtgcttcctccctggctgacatctatcatagaagaaagggcgtgagatgcttcatgacgagtaactcctggtttctggatatattcaaatacagagttgcctccttctcatccaggccacttggagatgagagcactgttgactttagtagcatctcctggtccccttgtaggttccagtctaggccttgggagagccaagaggacctcttgaacaacggctatcatcagaaagcttctgcacttcacttaccttctcccccagccatacccggcttcacattttctcctcctcttttgcagtcaatgcagaccctgcaggacttgctcactgatcttcatgcactccaggtcaccatcacagccctcagaaaagaagtggacatgctgaagaacatgcttgacaaggtaggccctcccccagcatcctccatgccagctgcgttgctcaggcctctgggggttggagcaatgaggaaaatctaggaagcttactgttaggccaagagtgcagctgtgagggtgtggtcatgtggaccctccaattggccagtgccaccgacttctctgtgacccctccatgctttcttttcttttcttttttttttttaagacagagtctcactctgttgcccaggatggagtgcaatggcatgatcttggctcacggcaacctctgcctcccgggttcaagtgattctcctgcctgagcttcccgagtagctgggattacaggcacgcaccaccacatctgggtaatttttgtatttttagtagagacaggggttcatcttgttggccaggctggtctcgaacttctgacctcgtgatccacccacctcagcctcccaaagtgctgggattacaggtgtaagccaccatacctggccgacccctccatgctttctaccccagtgtgttaaaacgttagttgtaagtgacagaaatcacgttcatcctggattaggcaaaataagggatttattgtctcatttactaaaaggtccagggacggccagatctaggtactcatgcaatacttatatttctttttttttttgagatggagtctcgctctgttgcccaggctggagtgtagtggctcgatcttgactcactgcaacctccacctcccgggttcacgccattctcctgtctcagcctcccgagtagctgggactacaggcgcccgcccccatgcccggctaattttttttgtatttttagtagagatggggtttcaccatgttagccaggatggtctcaatctcctgacctcttgatccgcccgcctcagcctcccaaagtgccaggattacaggcgtgagccaccacatccggcaatactgacgtttctcagtgaaactttcctcccagttggcttcattctcaggcaggtgctcctcaagtcttggcaacagcagacttatattccaccaacctagcaaaaagaaaacctcttccccttctggaaagctctgtccacatggaaagtggaataatcataatagtgcaggcatacatacaagctccttctgtacttctgtagccaaaaaccatcagccaagtattttctaacaccctaccatgcatggaaggacatggagtccccgagacatgaggcagctgtccccgtcacaactgatgagtcacagctggggtctgaagccagctctccacacccccaggtttaacaacttcccccaaatagtgtaattttctgtatcatcccggcttcacagatcagggcctgtatttgatcatcatggcaactgtgggagctttaggcatgggctggatggctcccatctaagcagaaagaacgctgttaaaagctgcatcatgagctactcaaaagggccccttagacaaagctgttggagaaaccatgccttctcggcggggcctggtgtctcacgcctgtaatcccagcactttgggaagccaaagcaggcggatcacctgaggtcaggagttcgagaccagcctggccaacatggtaaaacccccgtctccactaaaaatacaaaaattagctgggtgtggttgcaggcacccgtaaccccagctactcaggaggctgaggcacgagaatcacttgaacccaggaggtggagattgtagtgagccaagattgcgccactgcactccagcctgggtgacagagcaagactccgtctcaaaaaaaaaaaaaaaaaaaaggtggggtcggtggggcggcatggtggttcacgcctgtaatctcagcattttgggaggctgaggtgggcagatcacaaggtcaggagatcgagaccatcctcgctaacacggtgaaaccccatctctactaaaaatacaaaaaattagctggatgtggtggcaggtacctgtagtcccagttactcaggaggctgaggcaggagaatggtgtgaacctgggaagtggagcttgcagtgagccgagatcacaccactgcactccagcctgggcaacagagtgagactctgtctcaaaaaaaaaaaaaaaagaaaaaagaaaagaaaaacaatgccttattggcctgtctcttggaggtgtttttgttgttgttgttttgttttgtattctttttgagacggagtctctctctgtcacccaggctggagtgcagtggcacgatctcagctcactgcaacctctgcctcccgggttcaagtgattttcctgcctcagcctcctgagtagctgggattacaggtgcaagccaccacgcctagctaatttttgtgtttttagtggaggtgggggcttcaccacattggtcaggctggtcccgaactcctgaactcatgatccacccgcctcagcatcccaaagtgctgggattacaggcatgagccactgtgcccggccctcttggagattcttaatgtgcttttgctcattcaaggctctgggaagtcctgccgtacagaaacctgttgaaatgttttttatttatttatttatttacttatttttgagacaaagtctcactctgttgcccaggctggagtgcagtggcgccatctcagctcactgcaacctctgcctcctggattcaagtgattctcctgcctcagcttcctgatagctgggattacaggcgcatgccatcaggcccagctaatttttgtatttttagtagagacggtgtttcaccatgttggccaggctgctgtcgaactcctgacctcaagttatccacccaccttgacctctcaaagtgctggggttacaggcatgagacactgtgcccggcctgacatgctttcaagcccagcatttcccaaacttgtttgcccatggaaccctttcccactccttgggaaacactggatttggaacccgttcttccttctcaagctcttagtcacctagagccacgggaaaaggcaggggtgggacagaacctggacccccagtccacagactcagttcctttgacaggtacacccagaaagaatggacatctttgctgaagacttcaaaatacagaactggaagatggttgcactgcagcgggaagtggtgagggccaccatccctgtcttcccccactccccctgggaccccccaacctcccgggtcctgggtgctgagggtagggaggtgcaaggaggagaacacagcctggaaaggtttctttgcaggtgtgggggacactgccccctccaggctcacagccctcattttctacccccaccttgcaggcttctctccagaataagtttaaaaccatccccaaaaccgaggacatggtgctctggagtggccttcatgatgccatgttcacctcagtgagtgaggaaggaaggggaggttagcaggaagctggggagcaggcgggtggctgactgagagtgggaggcggggctggaagccagcagagcccctctgccccctcttctgcaggaaattggttcatcaccactggacctgtggcagtctgtagagcagctcccagaggctgccctggcccagaccaccaagtaccttgaagctactcgtgccatccaggtctccgagcccgtccaaaacccccagctactgcagactgtctggcattatgaggtcccagagctcctcccggagggctcatctgcccaagcagtttcactcagcagagcccaggagccagcgcagcctccggccctcacgcctgagtctgcacctgggtgcacaactgaatttgcacctgggcctgcacctgggactgaacctgtgccaggactggagctggggctggagctggagcctgtgcctgccctggggcctgtcccagggcccagtgtgacacctgggtccttgccagcaccttggcctgtgcttggacctgtgcctgccccaggtgcccagcctccaccactgggagactggcctgcactcccaagacgctggcctcttccccaaggctggcccagggtgggctcttggcctctgtgggacttaggtgtcctgcggccaactcagccccaaccctccagggccccaccaccagccactgagtttggctcattgtggcctcgaccactccagccatatcagtctcgccagggagaagccctccagctcgcagctgtccaagtaaagggggaggaaaatgatgtccccagcctaaggggccttcgggagagggcccgcaaggatggggcccccaaggatagaactcgcaaggatggggtccccaaagatagaggtggcaaggatgtggaccccaaggatagagctcacaaggatgatgtccccaaagatagaggtggcaaggatgtggaccccaaggatagagctcacaaggatgatgtccccaaagatagaggtggcaaagatggggaccccaaggatagagttggcaaggatggggcccccaaggaagcacagcctaaggctccccagtctgcccttcaccggctgaaaaccaccgctgccatcgccgccgctgccgccgcagcctacgccgctgccacatcctccgctgcccaggcagccaaagttgctgccaagtttgtcaaggatgccccagccaccaaaatggccgccattgcaacagacacggctgcagctgggcccctaggggtctttgcagatgtcctgggtgcagggccttcccggggagccacagaatcccagatcttgggcgatgattccgaaatctacgaaatcctctctccctcctactctgctgccagcatcggtcccgatccagccctgtcccaggccatggtggctaccaagcaggccatgagccctgaagacaagaagagggctgtcaagtattccatgagccacatagcccagatacctgtcaaacacgactctctgaaggaagaatttgcccagctgtcctgtaacctgaaccagcgcttgagttatctaggtaggcctggtctggccctgggaagggcacaagggagtggggctctccctgcagcctttgagaagtgtgtcctgtccttcactgggctccaccaacaaaatctgcattccaccattagccattctttcctttggcttaagcatttggctcttaacgagtctattcttttctgttgaatgtacaatgaggtcttatcttagggcagggaggctgttagggtctaaagttggcacgaggaaaatggcatgccaaaattactctcaaaaactcttgtggccaggcgtggtggctcccacctgtaatcccagcactttgggaggctgaggtgggcggatcacctgagaccgcaagttcaagatgagcctgaccaacatggagaaaccccgtctctactaaaaatacaaaatttgctgggcgtggtggtgtatgcctgtaatcccagctactcgggaggctgtggcaggagaatcgcttgaacccaggaggcagaggttgcggtgagccaagatcatgccattgcgctccagcctgggcaacaagaacgaaactctgtctcaaaaacaacaacaacaaaaaaaactcctttgtgatagcccataaaacagtattgtattggctaagcatggtgactcatgcctgtaatcttagcactttgggaggccaaggcaggaagactgcttgaactggaagttcgagaccaccctgggtaacatcaagacctcatctctaaaaaaatttttaaacactagctgtgtgcggtggctcacgcctataatcctagcactttgggaggccaaggcaggcagatacggagaccatcctggctgacacggtgaaaccccgtctctactaaaaatacaaaaaaattagctgggcatggtggcgggcgcctgtagtcccagctactcaggaggctgaggcaggagaatggcgtgaacccaggaggcgaagcttgcagtgagccgagatcgtgccactgcattccagcctgggcgacagagctagactccgtctcaaaaaaaaaaaattttaaacattggccgtgtgcggtggctcacgcctgtaatcccagtcccttgggaggatgaggcaggtggatcacttgaagtcaggagttcgagaccagcctggccaacatagcgaaactccgtctcgactaaaaatacaaaagttagccaggcttgatagtgcgcgcctgtaatcccagctacctcggaggctgagacaggagaaacactttgaacccgggaggcagaggttgcagtgagcagagattgtgccactcccgcctgggcgatagcgagactcctcctcaaaacaaaaaaaaaagcctgagtggtggcgcaggcctgtagtcccaactactcaggaggctgaggtgggaagattgcttgagcctagcagttcaagactgcactgggttatgatcgtgccactgcactccagcctgggcaacagagtgagaccttgtctccatacaaacaaaatttaaaaaaaaatttttttaattattgttattattttttgagatggagtttcacttttgtcgccggttggagtgcaatggcgtgatcacagctcactgcagcctccgcctcctgggttcgagagattctcctgcctcagccttccaagtagctgggactagaggcatgtgccaccaagcctggctgattttcgtatttttagtagagatggggtttttccattttggccaggctggtctcaaactcctgatcccaggtgatccacctgcctcggcctcccacagtgttgggagtacaggcgtgagccactgcacctgataaaaaaaattttttttaattaatttaaaaactaataggccgggtgcggtagctcatgcctgtactcccagcactttgggaggctgaggaaggcggatcacgaggtcaagagatcgagaccaacctggccaacatggtgaaaccctgtctctactaaaaatacaaaaattagctgggcgtggtggcgtgtgcctgtaatcccaggtactcgggaggctgaggcaggagaattgcttaaacccaggaggcggaagttgtagtgagccgagatcgcgccactgcactccagcctggtgacagagcgagattccatctcaaaaaataaattaattaaaaaataatgaagaaataaataaaaaggtaccacaagctgcgaggcccagtgcatttccactgggcagtgctgcctgagatgctccataagagaagcagctagagcccaacagaaacatcttcctccatccgagccctcagcagccaccctgtcctctgctttcagccaatatgggaggtccttccagcctcgggacaacagtggacatattgcagaaaaagattggcagcctccagaaatctaggctcaaggttagtgtctccggcgaagggcttttgaggcagtgatggcttgaggtgagctggctgaagactccttgactctgcccccctcccaggtgcagctgtgttctgcagcaaaacaggctgggggaaagcgagctggctgcgaaggcagctgctgcctctcaaagctgattcactggtgcggtgggggggcccagcaggtgtggggctacacggttctgtgtctcaggtggctgttcagagggcaggtgaagccggtgcggtggctcatacctgtaatcccaacgctttacaaggctgaggcaggcagatcacttgagctcaggagttcaagaccagcctgggcaacatagtgagatcccttctctgcaaaaaaatacaaaaattatccaggtgtggtggtttgtccctacagtcccaactactcgggaggctgaggtgggaggatcacttgagcctgggaggtggaggctgcaatgagccaagatcacgccgctgcactctagcctgggtgacagagcaaggccctgtctcaaaaaaaaaaaaaaaaaaaaaaaaaaatggcaggtggaaggcaccctggtctgataccttatttttttttttttttgagacggaatcttgctctgtcatccaggctggagtgcagtggcgtgacctcagctcgctgcaacctctgcctcctgggttcaagcaattctcctgcctcagcctccctagtagctgggattacaggggcccgccaccacacctggctaatttttgtattttttgtagagactggtttcgccgtgttgggcaggctggtctcgagctcctgacctcagttgatctacccatcttggcctcccaaagtgctgggattacaggcatgagccaccacgcccagcctggtctggtacattcttcttggcctcaaccctccctcaggccccttcccggccatggtaacttcagaagcagaggcctggggtgtctgtgtctcccccttttaggaggaagaacttgagagaatttggggcaaccaaatagagatgatgaaggatcgctacatcactttggacaaggcggtggagaacctgcagattcgcatggatgagttcaaggttaggaggactgggtaggctggagaagggctggcaaagggagaattcctcacctagaccttctggcccttcccgaaggttctgcatgaggtggggatgcacttgaggctgggaaccagtggggctttactggcattttactgtgtgtaaattacacttcaatgaaaagcaaacgaatcccaccacccccccccacccatataaacagaagggccgggacaatgttcgtctttttgaccactgcgtcacctgcccctggaagggcaggggtagtgaaggctccatcacatttgctgaatgactcagtgaatgattaagagaacttcttgtgccaactgttacattcttaacatttccctgagccaagaggtagaaatatttactgacattttgggctgggtgataaaaataaaaaaataataataaaaagaaatatttaggctgggtgcggtggctcacatatgtaatcccagcgctttgggaatctgaggtgggaggatcacttaagacaaagagtttgagacaagccagggtaacacagggagaccccatctctacacaaataaaaaatttagctgggactgggcgcggtggttcacgcctataatcccagcactttgggaggccgaggtgtggtggatcacttgaggtcaggagtttgagaccagcctggccaacatggtgaaaccccgtctcttctagaaaaatacaaaattaggctgggtgcagaggctcacgcctgtaatcccagcactttaggaggctgaggtgggcggatcatctgagatcgggagttcgagaccagcctgaccaacatggagaaaccctgtctctactaaaaatacaaaattagctgggcgtggtggcgcatgcctgtaatcccagctactcaggaggctgaggcaggagaatcccttgaaccggggaggcagtggttgcggtgagccccgatcgtgccattgcactccagcttgggtaacaagagcaaaactctgtctaaaaatatatatgtatacatatatatatatatatatatatatatatatatatatatatataattagccaggcgtagtggcacacacctgtaatcccagctacctgggaggatgaggcaggagaatcgcttgaacccgggaggtggaggttgcactgagctgagattgcgccattgcattccagcctgggcaacaagagcgaaactctgtctcaaaaaaaaataaaaagggccaggcgcggtggctcacgcctgtaatcccagcactttgggaggctgaggcgagtggatcacgagttcaggagattgagaccatcctagctaacgtggtgaaaccccatctctactaaaaatacaaaaaattagccgggcgtggtggctggcgcctgtagtcccagctactcaggaggctgaggcaggagaatggcatgaacctgggaggcagagcttgcagtaagccgagatcccaccactgcactccagcctgggcgacagagcaagactccgtctcaaaaaacaaaaacaaaaacaaaaaaacctagctggatgtggtggctcatacctgtgatcctagtactttgggtgcagaggcttaaacctgtaatgagggaggattgcttgaggccaggagttcaagacttggccaacagaagaaaactgtctctacaaaaaaaaaattataaaattagccaagcgtggtagcacatgcctgtagtcccagctacctgggaggctgaggtgggaggattgcttcagcatgggaggttgaggctgcagtgagctgtgactgcatcactgactccagcctgggtgacacagaaagaccatctcaaaaaaagaaagcaaagaaacaagcaaaaagcaaaaaactcactaacggccaggcgcggtggttcacacctgtaatcccagcactttgggaggctgaggcaggcggatcacctgaggtcaggagttcgagaccagcctggccaacatagtgaaaccccgtctctactaaaaatacaaaaattagccgggcatggtggcggatgcctgtaatcccagctactcgggtggctgaggcaggagaatcacttaaacccgggaggcggaggttgcagtgagcgaagattgcgccattgcactccagcctgggcgacaagagcaagactcagtctcaaaaaataaataaataaataaataaataaataaataaataaataataacccaccaaggttgtttccgtgaaggcttccaagtcggggggctgttgctgggatgcactggggtgtgttgggggaaaagggaccaaggaaacccatggcgtatggctgaccccaaggctggcacactgtaatcaggctgggacccatttgaggcaactttgaatggaaaataactcattaaaggggaaccaattcacagcctatgaagtgggggtggacaggagggttggctgtctctggagatgctgggccgagtgtgggtggactgcatgcaggggtacgtgctcagactgtgcaccactggccaggaaccaggtctcctgccaacactcctcttcagagagacccaggccaccatgtcctggggtcatcttggtgccctttctccatggagctggagccagttccattcagcatgtccatcgtgcacccagcactacgccagaccctgcatgggggtgagcaggggctgcagtgtctgcctgcgtgtccgtagttgtcacttattagaaagactctgaagctgatgaagccctgccacgtgtgccaaaacagagcacatcccttgtcccaggaccgttgtcccagcttcctggctcttgtgctatgaagatttcattgctggccaggctcggtggctcacgcctgtaatcccagcactttgggaggctgaggcaggcggatcacctgaggtcaggagttcaagaccaacctgaccaacatgatgaaagccgatcgctactaaaaacacaaaaaaatcagctgggcgtggttgcgggtgcctgtaatcccagctactcgggaggctgaggcaggagaatcgcttgaacccgggaggcagaggttgcagtgagccgagattgtgtcattgcactccagcctgggcaacaagagcaaaactccatcttgggaaaaatctcagcactttgggaggccaaggcaggaggatcccttgaggccaggacttcaggacgagcctggacaatacggcaaggccccatcgctaaaaaaataaaaataaaaatattagccagatgtggcagcgtacgcctatagtcccagctaccagggaggctgaggcaggagaatcacttgaacccaggaggtggaggttgcagtgagctgaggtcatgccactgcactccagcctgggtgacagagtgagactctgtctcaaaaactaaagtaaactaaaatacagtcttaggattttgaaccacacaaatggtttgtattaccaatagttaaagaagaaaaataaaaaataatgtagaacaagtgtgggaataggcaaatcaataggccaagaagactgggcatggtggctcacacttgtaattccagcactttgggaggccgacatgggcggatcacttgaggtcaggagtttgaaaccagtctggccaacatggtgaaaccgtgtctctactaaaaatacaaaaaaattagccaggcgtggtggcgcatgcctgtaatcctagttacttgggaggctgaggcaggagaattgcttcagctcaggaggcggaggctgcagtgagccaagatcgcaccactgcactccagcctgggcgagagagcaagactgtatctcaaaaaaaaaaaaaaaaaaaaaaaataggccaagaagaccagatctaagatttacaagaatttagcatatgaccactacaggaaggatggattactccacaaccagtgttaggaaaaccatttcaaggaataacagtaagtcttaagtccgatagcaatcctctagatgacacaaggcagtagcacggtgacaaatgcaggatgggagcaagatctcatgactgtgtctctgtcttgctctccaccatgtgacttacatgtaagacttaggtttcccagtgtcgttttgggtcttgctctgtcccccaggctggagtgtagtggcctaatcatggctcagtgcagccttgaactcccaggctcaagtgatcctcccacctcggcctcctgagtagctgggactacaggcgtgtgccaccatgcctggctaatttttttttttgagatacagtctcgctctgtcgcccagcctggagtgcagtggcgcaatcttggctcattgtaacctccgcctcccgggttcaagcaattcttctgcctcagcctcctgagcagttgggactacaggcgtgtgccaccatgcctagttaatttttgtggtttttttggtttgttttttgtttttgttcgaggcagaatttcactctgttgcccaggctggagtgcaatggcgcaatcttggcttactgcaacatctgcctcccgggttcaagtgattctccttcctcagcctcccgagtagctggggtaacaggcgtttgccaccacactcggctaattttttattttgagtagagacagggtttcaccacattggccaggctggtcttgaactcctgacctcaggtgatttgcctgcctcggcctcccaaagtgctgggattacaggcgtgagccaccgtgcccagccaatttttttgtatttttagtagagatggggtttcaccatgttggctaggctggtctcgaactcctgaccccaagtgatccacccacctcagcctcccaaagtgctgggattacaggcattagccactgcgcccagccaaaataataagattataaaacatgaatatagcctggcatggtggcttgcacctatagtcccagctactggggaagcagaggtgggaggatcactggagtctgggaggtggaggttgcagtgagctgagctcgcaccactgcattccagcctgggtgacagactgagaccctgtctcaaaaaataaaaataaaaagcataaataaggccaggtttgatggctcttgtaatcccagcactttgggaggctgatgggggaggatcctttgagcctaggagttccagatcagcctgaggcaacatagtgagacccctgtctctacaaaaaaaaaaaaaaaaaaaaatccaggtaggtggtgtcacctgcagtcccagctcctctggaagctgaggcaggaggcttgcttgagcctggaaggctgagactgcagtgagctgtgatcaagccactttactccagcctgagtgacagagcaagagcctgcctcaaaaaattaaaataaaaaaattaaaattaaaataaagaggaggtaacagagactcagcaaagaaacgagcccaagcctgctgggctgggagggggcctggagtggctgtggttcagagcccaggctttggaacagacgtgcctaggtttgaatcctgattctgccacctgctggttggatcagttccctgcggttgctgcggcaaatcactcttggggttctggaggcgggaattctgaaatcaaggtgtcataggctgtgttccacctgaaagctcagaggggcctcctcgcctctcccagcttctggtggttcaaggtgtcccttggctttggagcaacttggatggaggccggggtcattattctaagtgaagcaactcaggagtggaaagcaaagactgcatgttctcacttgtaaatgagctaagccataggtgtgaaaagacagaccgagcaggataatggacacaggagactcaggataatagagagagggaaggatagaaaactacatattggagccaggcgcggtggctcacacctgtaatcccagcactttgggaggctgaggcaggcgaatcatttgaggtcaggagttcgagaccatcgtaaccaacatggtgaaaccccatatctactaaaaatacaaaacttagccaggcgtggtgttgggtgtcagtgaccccaactactcgggaggctgaggtgggagaatctcttgaacccgggaggcggaggttgcagtgagccgaaatggcgccactgcactccagcctgggcgacagagcagattctgtaaaaaacaaaacaaaacaaaacatgttaaagatacccattcacttctgttgacaccccagtggccacactaagctataagagaggctgtgaaatggagtcttgattctgggcagctgggttccagctaaaagtccagagttctgttcgtaagcgtgagcgggacacccgacaggaagagagaagtagaagcctgtttgcagctttgcaggaactatggcccgaccctctggggaaatggaggctcttcccaagctgaccagctgctgctcctattacaatggggatgtagtaattggagagagggtggaattcatgggggcagttggttctttgtggagttgtggggataggacgtgaggtttttccctaacgcttgagcacagtgtgtgtggctgtgataagtgctcagttcatagtagactggagttcctgctgggaccccaggacagatcagaagtagtaaacatgccttaaacatccagggagcgaaatcgtccacattggtttgtgctttccttccttgggtctaactccccgtggaggaaagttcctatgataccatctctgaggggacagcttgtcccaagtcgcacgttccttcccttttcatctgggcacctggagcccttgagcctgagtcttgtaacgcccatgcccacctgcctgctgtccacacggcctgctatccctccccagcatatggtaatggtagaggtgggaggttgacattttatcctcaaggctctccaggatggcagacatgcctgtgcttctgttcttagactctccaggctcaaatcaaaagactggaaatgaacaaggtgaataagagcacgatggaggaggagctgagagaggtgagtgagcagaggttcctctgccttccctgctcccctacccagggaaacggcaccatccaggcaaagcccaccaaagagtcttccagaatttccctccccctttgttcatattgaaaccaggagttggctgggcgcagtggctcatgcctgtaatcccagcactttgggaggccaaggcgggtggatcacctgaggtcaggaattcgagaccagcctgcctggcctacatgatgaaactccgtctctagtcaaaatacaaaaagtagccaggcgtggtggcaggtaactgtaatctcagctatttgagaggctgaggcaggagaatcacttgaacctgggaggcagaggttgcagtgaaccaagatcatgccattgcactccagcctgggcaacaagagcaaaaactctgtctcaaaaaaaaaaaaaaaaaaagaaagaaagaaaaagaaagaaaagaaaggaaaacaggaggcacatcaactcccattttcagcaattgaggattattaacactctacttgaaaatcacacatcagctgtgcacagggtggctcatacctgtaatcccagcactttgggaggccgagaagataggatcacttgaggccaagagtttgagaacagcctgggaaacataggaagatcacatctctacaaaaaaataaaaaaatgaactgggcatgatggaacatgcctgtagtcccagccactcaggaggctgaggtggaaggatcccttgagcccaagaggtggaggctgcagtgagctatgattgtgccactgcaatccagcctgggcaaccttgaacaagatcctgtctcaaaaaaacacataataataaaatacatcaacttccctgttataggaaaaccttggctttgatctcgagatcgtgtttgaatccacgtagaccccagggttgcatttaagccaaggctaaaagtccagagtcccaaactagaagcatcagacccaaggggtgtgatgtctcccagctttgccttcctccatcccagcagccatgcctccctgaactccctgtctccctagaaagctgacaggagtgccctggcaggcaaggcaagccgcgttgacctggagactgtggccttggagctgaacgagatgattcagggcatactcttcaaggtcacgatccatgaggacagctggaagaaggctatggaggagctcagcaaggacgtgaacaccaaggtgaatgcccccatgttgattttcactttattcctaacaaattaacccagaacttagcaactgcaaacaacaaacgttttcagtttaggaggagcaagaatttgggagtgacccagcaacttagctgggtggctcagggtttcctgtgaaattgcagtcaagatgtcatccagggctggtctcatctgaaggctcgaatgaggctggatgagccaattcaaagagattccctcacatggctgttggtaacactcttcagttcctcatcccatggactctgcctttgggccacttgagagtcctcatgacattgcagctgacatctcccagatcaaatgatccaagaggggaaggaagaagcagcaatgtcttttttttttttttttttttttttcatacagggcctcactctgggcacctgccccatacatagtcaataaatgaattgatccccatttcacagaggagaacactgagcctcagagaggttattatacttccctcaggaaacgctgctgctcatggtggagcttgagactcaaacccagagctgcctgattctaaacctaatttaacctctttgggccagtccagccacctcagttgcaagaaccatgtagcactgttgttggaccaactgttccagtctactatgaggaaggggctgtgactcctctagacacttccccggggtctgacacatcactggcagtcagtaaacgatgaatgaataaatgaatgactgtcacagtccctcagagactctcctcctccaccccacatccctgcacttacgcagccaggagagtggcatagttagcctccagggcggtcgccaaccatacctcttggtattcacacagttgtttagccccctcccacattgaatgggaccagcttgtgtaacctacaggatattagagagatgatggagggtgaccaccttccatcataaaagacattgcagccagttgtggtggctcacgcctgttatcccagtactttgggaggccaaagcaggcagatcacttgagcccaggagttcaagaccagcctgggcaacatggtgaaactctgtccccctaccaaaaaaaaaaaaaagccaggtgtggtggcacatacctgcatttccaactactcaggaggctgaggtgagagaatacctgagcctgggaggttgagactgcagtgaaccaaaatcgtgccactgcactccagcctgggcagcaggagcaccctggcaggcactcagagtgaaaccctatctcacaaaaaaaaaaaaaaatgggcgcagaacaaccaaaagcaacacatgaagagattttacttgtttcctggtttaattgaaccacatctacaaatgggctggagatgacatccaattcaggaatagttgctaattgtattaaacatgataatagtgttgtggttatataataaaatgttatcacactcaaatatttattagtgaaatgtcaccatttctgtaacttaaaaaaaatactccatcggctaggcacggtggctcacgcctgtaatcccagcacttcgggaggctgaggcgggcagatcacgaggtcagaagattgagaccatcctgaccaacacggtgaaaccccatctctactaaaaaatacaacaaaaattagccaggcctggtggcgggcgcctgtagtcccagctacttgggaggctgaggcaggagaatggcctgaacccgggaggcagagcttgtagtaagccgagatagcgccactgcactccagcctgggcgacagagcaagactccgtctcaaaaaaatactccctcgggtggcacagtggctcacacctataatcccagcactttgggaggttgagatgggaggatcacttgagcccaggggtttgagaccaatcctggcaacatagagagactccatctctactttaaaaaactatttttggccaggcgcggtggctcacacctgtaatcccagcactttgagaggcagagatgggtggatcacttgagatgaggagttcgagaccagcctgaccaacatggtgaaacactgtctctactaaaaatacaaaactagccggatgtggtagtgggggcctgtaatcccagctactcgggagactgaggcaaggagaatcgcttgaacccgggaggtggaggttgcagtgagccaagatcgcaccattgcactccagcctgggcaacagaagtgaaactctgtctcaaaaataaataaataaataaataaaataaaagtaaataaataaggccaggtgcggtggctcacacctgtaatcccagcactttgggaggctgaggcgggcagatcatgaagtcaggagtttgagaccagcctggccaatatggtgaaaccccgtctgtactaaaaatacaaagattaggctgggcgtggtggctcacgtctgtaatcccagcactttgggaggctgaggtgggcggatcacctgaggtcaggagtttgagaccagcctggctaacatggtgaaaccccatgtctactaaaagtaaaaaaaaaaaaaaaaaaaattagtcgggtttgggggcacacgcctgtaatcccagctacttgggaggctgaggcaggagaattgcttgaacctgggaggcggaggttgcagtgagctgagatcacaccactgtactccagccagggcaacaagagcgaaactccctctcaaaaaaaagccaggtgtggtaacacgcacctgtagtcccagctacttgggaggctgaggcagaagaattgcttgaacccgggaggcggaggttgcagtgagcagagattgcaccactgcgctccagcctgggcaacagagcgagactctgtctcaaaaataaataaataaaattaaaaataaataaataaatacgattgattatgatggtcacacaactctgtaaatatactaaacgccataaacctgcccactttacatacagaccgtcaataaacatgtgttgagtgtgtgaatgtcaggtgcagtgggaccattgccagaaaggtgtctcagaccgcccagcctgcagctgagcttggtttgatttggtcttttgcagacagtagctgatggtgttttttgcttctgctgctaggaagctcaccttgcagctcccctctaccaatagcatctagtaggggttgagcctcatcgaagctgtgtcattttccctttcctggactccctcactattttagttgaattttgttacaccgtgtaacttcccaggttgctgcaaccctcttctggaaggaggcagggtgtgaattcatagagtattctttcttatcttccccttggctgttggcagttagtccacagtgatctggatcccttgaagaaagaaatggaagaggtctggaaaatcgtccggaagctgctgattgagggcttaagactggatcctgacagtgctgctggctttaggaggtgagtgcccgcccgagcccctcctggtaggggtcctgctgcccaggctgtggggaacacaccctggaagctctgggaggaaagattccagacctttggatgaggggatgggggcttggctgtggctgaaagcactgaggaggagggaagctctggcctgagctggcagaggtgatccagccctattcctgccaatggggaaaccaaggctcagagagggaaggggactgggcagatccaggacccctgacccccacccagacagtgccccaggcagagggacccaatatttatggggctcctgtcctcagaccacccctcacacagctttaaaaaccatccgttgtgtttggggcggcagagaaaccacaagagtggttggagactgcagggcctgtggggctgagctgggccgggcactggcaggagggatgcagccctggggctctggctggctgcagcctcccacacatggcctgggcccagcaggggcagcggctgatgatcatgtgcctttcaggaagctgttcaagcgcgtgaagtgcatctcctgtgaccggcctgtggagatgatgactggcccgtgagtaccaccgcccagggtgccccggccctaagggcttgtggggcccatggaggtcatctccgtgcacctccatgtgcaccgttccatgcacgctgtgtgtctacacatccatatacagcattctctccagccatcaagtccatacacgcccacatgcaccattctctatgcaccaggtatctacacatccacatccactgttctgtaccgtcaagtccatacacatccatgtacactgttctgtatgtgccatgtgtatccacattcatatacagggttccccagccttcaagatacacatgtccacatacactgttctacagccatcaaaaatatacaaatatgcggccttgtatgatagcgcctgcctatagtcccagctactcaggaggctgagatgggaggatggcttgagcccaggagttcgaggctgtagtgagctaggattgtgccactgctctccagcctgggtgacagtgagacctcatatcaaaaaaaaaggccatgttggcaaggctggtctcaaactcctgacctcaggtgatccgcccacctcagcctcccaaagtgctgggatcataggtgtatgccaccgcgcctagcctggtttttacttttggaaatagaacaattgttttttgtgtcttactgtgatgatcagaggtcctgagatgcctttcgggggggccccttctacttctatgctgtggacgcttctggcattcgagggtggtgacctgagtctgcacctccttcctcctgctgggaaggcttcctggaggggtgggagacgagccctctgctggcctagcacgcctcccacagcccctgctgtgcccttgtcctccaacagacagctgatcaccatccgcaaagcccacctgctgtcccggctgcggccagccagcgccaacagctgcgagtacttgcagcggcaacagatgaggtgagcaggatgggcgccccgcagggaggccgccccgcatggaggccactctggagcctgggaaccctgttcctgcagagacacatcctccaggcccagggacctaagattgtcctggacatggccagcccttcgcaagacaggcactccgagaggtggctggggcggcagacaggcccacgagatgatggcggagggaggaactgacatatttactgcacatctattgtgggccaggaactgttagacggtttcttatttaaatctcacaaccccctgtgagctagggttcctatgcccatgtccctgtttcttggcggagggaatcggtgatgatggggaaccctcagggagccgctgctgtgcccggcaggcactgtgccaagcgctggggctcacctggccttgttgagtcctcacagctgccctctaagatgtatcctggtaccatcccatgtcacagttgaagaaactgaggctcagagaactgcagtgacctgcccaaggtcactgctagcaagtccagggctgatgtccaaaccctcaggtttccaccgcacccagctggctccctgggtgccagccccacccctcaacctcctgacatcccacagctctatggatctccccagcctccaaccctgctgtggggacgtctggccaggtgggggaagaaccggtgaatcgtcaccacagccgtgggaaggggagggacgtgggggcctgtgctgactctgccaccctccctccctggctccttgagatcaagagattagaaggacacgctcttcaggccaggggtccaaagggaaatggctgggtctggggaaatgcaggtctcaatttgattcctctgccccactgtgtgtgtctgtatccatccgccaggccccaggcctgcctggctgtgccagctaaacacaagctgaaagaaatgctggtcttccctcgatgctggccaggcccttggggcccgtcctgggctctggggtacagggtctccaggtcgctgctgacccactgccctgctgcagggaacagcagtggctgcagctccaggacctcggtatccaggaggattgtcagcaggactggggtgatggcccccaaaacgccaccagcctcaagtgcaagtcctgcaacctgttgacgctctatccctacggggatccccacgtgatcgactatgacagcgtgagtctggccggggcctccttctcagagggtggacgtcagcgcaccccagccccaggtgtgggaccaggcactgagcagtgggcaaccccagcagaggctgcactctgtctcctgggcttctgcgtgtaccaaagttcgggggcagatcgggtcgggggctccctaacccgggacctgggccatccaacaggccgaggtggacatcctgggcgtggatgggatcctgtacaaaggccgcgtgaacagccagcgtggggctcagcccttggccgtcgcaaaggagctggcaggtgaggggcgtagggctccctggggcacccttgcctggggccctggttctgctgggcagggtgagagggtgcaggtggggcccagagccagcactatccctgaccggggagtcctcacacagtcagtcacaaaaattgggtcacagcaggcccccaggagactcagtctttgcaatgggggagggagaccgcgggagcgaggatctgctgttcccgagatcaacagctgaccagagagagggccgtggccacaggaccatggcctgtgacgaaggacgatgagctaggaaaggtgctgggctggtgccaagggacgccagtccacggaggacggactggacagctgccctgaagcccttgaagagggactaggacttagctggatgaaggggtcgggtgagaggagagtggtcgtgtggcaggaacggtgggtgcaaaggccctgtggtgggtggaagccactcacaggcaggagctcaggacgccgagtctccctgaagggtggagactggggtggggcagtggggtgacaaggaggagacttgggccagaccccagaagctgtgtgttaatatcacaggcaagggttgggccagcgggagacccagaattgtgcacatctggaatcagtcaatgtggttgctgcagtgctgaggcccggctctggccggctcctgctgggaccccaagactctggagtccatcactgggttcgaaggacaaaaagaggagccttctctgcacaccccttgaaggctcttcccccttggggatggggagttctaaattttgcccctgggtgggagctacacgccgccccataaggagcagtcccggagccacaagatggccggggcctgaactccacctgcagaaattctggttttttgttgttgttgttgttgttgtttgtttgtttttgaggcggagtcttgctctgtcgcccaggctggagtgcagtggtgcgatctcggttcactgcaacctccaactcccgggttcaagcgattctcctgcctcagcctcccgagtagctgggataacaggcacgcaccaccacgcccggctaaatttttgtattttttagtagagacggggtttcaccatgtttggcctcaagtgatccacctgcctcagcctcccaaagtgcaaggattacaggcatgagcctctgcgcctggcccaccggcagaaattctttcttgccaacgctgtgcctccattgactcgaagaccagacatggaagaagggaagggggactgtttcatcaatgtgctgggcaaaggaggaggcaccctgattcgtctcctggggttgccgagacaaattaccacaagcagggtggcttaaagcagctgaagttccttcattccccggcccatgtagcacgccgtcccattggccgggcacggtggctcacgcctgtaatcccagcactttgggagaccgaggcgggcggatcacaaggtcaggagttcaagactagcctgaacaacatggtgaaacctcgtctgtactgaaaatacaaaaattagccagccatggtgacacacgccgttaatcccagctactcaggaggctggggcgggagaatcacttgaacccaggaggcagaggttgcagtgaaacaagatcacgccactgcactctagcctggacaacagagcgagacttcgtctcaaaaaaaaaaaaaaaaaacagctgaagttccagctgggcaacaacaaattagctgggcatggtggcgtgcgcctgtagtcccagcttctcaggaggctgaggcaggaggatcgcttgagcccgggaatttgaggctgtagtgagccatgatctcaccactgcactccagcctgggcgacagagccaggccctgtctcaaaaacaaacaaacaaacaaacaaaaacagaacagaacaaaaccaaacaacaacaacaacaaaaacaaaatacagccagagttgatcctcccgctgtcctggaggctggaaatcctaaatcaaggagtcagcagggctgcactccctccaaaggcttgaggagggtccctccctgtctcttcagcttctggggccgatggcactccctggcacttctctgtccccatgtgagcttctcttctgtgtgtcctctcctctgtcccccataaggacatttgtctttggatttgtgcccgacctaacccaggatgatctcatctcaagatccttaagctaattatacctgcaaagaccctttctccaaataaggtcacattcacagcttctaggagatgtatctttttggggagcacattcaacacaccctgtttccaggcgggccagacaccgtctcaaaccctgcattctcctgggcgggatgtggcttctcctcgagaggactggccgttccagcccctgccccctgcctggtatctgctgggagggctcaggctgggcgtcagggatcaccaggcaggatcacaacggtggctaatatttaatgaaccccgacttcgtgccaggccctgccccacctccttcaccctccaacaacctgccaaggagtttcacaaatgaccagctgagtgagggctgcttgccgggcggccagggcagatggagtccacatctgatgcacccagtcctgtccccactcattcactggcctccccaagggctgtcatctagagggaggggctttcccccttggctcattcattcccaagacccacacagcaagccaggacttgaatcatgatggcgtcaactgcttcatcttttttttttttttgagacggagtttcgctcttgttgccaaggctggagtgcagtggggcgatctcagctcactgccatctcaacctcctgggctcaagaaatcctccctcttcagccttccaagtgactggaactacaggcgtgcgccaccacgcctggataatttttgtatttttagtacagatggggttttgccatgttggccaggctggtctcaaacatctggcctcaagtgacccacctgtctcagcctcccaaagtgctgggattacaggtgtgagccactgcgcccggcctcatgtaacttattgactactatatattacattgaaattgtgacggatttatagcatcttaaagctgaaaagtggtaagtcaaaccatcataaatcagggaccttctgtattagaaatcaattggaaacctgtctgtggccagatcttgatcagtttgctgttgtcactcatttatttccccaaaagaactttctaactcaaaacagactcaaagccaggtatagtggcttacacctgtaatcccagcactttgggaagctgaagcctgaggatcacttgagcccagaagttcgagaccaacctgggcaacatcgtgaaaccccgcctttataaaaaatacaaaaattagcagggcatagtgaggctccctgcagtcccagctacttggggggctgaggcgggaggatcacttgagcccaggaggttccagctgcagtgagccatgattgcgccactgcactgcagcctgggcaaaagaatgagacttggtctcaaacaaaaaagaaagaaaaaagaaaagaaatgtccagaatagaaaaatctatagacagaaggaaaattggtgatttccaggggctggggtttggggcggggaaagggagagtgactgcttaatggggacagggccccttttggggtaatgggaaagtttcagaacaagatagtggtggtggtgtgcaacgctgtgtgcgtcctaaatgcctctgaattgtgcactttaaactggttaattttacgttatgtggattttacttcgaataatgaaaaaaaaacaaaggtgaaggacaggaagatgggggcatttaggtgctctggcccccagcgggacagctaaaccataaatagccctgccagcatttcacctgtgtcttactgtgctgaaatcacgtcacactcctctctggcctagagttactttcaaagagccttcttttctttcttagccttgagacactctccactcaagaaggcaaggaaggctgggcgtaatggttcacgcctgtaatttcaccactttgggaggtcaaggtgggaggatagcttgagcccaggagttcaagactagcctgagcaacatagcgagacctcctccctaggaaacatttaaacaattaaccgggagtagtggggcacacctgtagtcccagctactcgggaggctgagttaggaggattgcttgagcccaggagttcaaggctgcgtgcgctccagcctaggtgacagagcggagaccctgcctcaagaaaaaaaaaaaaaaagaagccaaggagggaagaacattgattatcccataaaggaatggaccggggagcctgggaaatggggttggtcccaccagagggagactgcccagtgctgggatcggcctgacacaggcccaggggtggatgccacccacacctgtctcttttcttttctgctaagctgtgaaggctccatctcccccgtcacaaagcctgtatgaccgtgtgcactccagtgccctatttggcgccatctgcccccgtgagtacctggttcccagccccagcccagctgtgattctggaagggtctccagtccctcctcgtctcatcccatcccccacaccccgcctgggctctcctgtccacctcctccacctcctgcctgctttgcctgcctatggcacttcagagatgattcctggccccggtgccatccccggtgcccaggccaagcatctgtccccagcgtccacccagctgcaggggcggcaacaagggaactgaggttggaaggaactgagcttctctggttcggatcaccacgtagcaggcacctgagggtactttacagtttacaaggcagtttctcccttatctcatcagaacctcatcccgactcctgtgaggcaggcactgtttgcccatttcacagaggagggagcagaggctcggtcactttgagctgtggcccaagatcacagagctagtgagctgggagctgagcccagatccgtggactccaagcttcatgttctctcccgggggctctgctccatttaagcaaacattcctggtgtcatttatcttgggtcacccacccaggacatttagggtgcccagggcccaggtgaggtatggtgcccagccggccatggcctgtacagcacttctagtcctgggcttctcttctctttagtggggatggccccatcaggctagtgtctcccaagaaggttcttggcacacatctagggtttctcctgcccctccccagccctgtgcccccgctccagtgcctgctcagctgcctcgggccctcacctgacgatgccagctcgaccaccttccctgccacctctgctgctgctgccaccgctgattccatccctaagggacccccagcaggccccagggtccaccaggctctcaagagctccacacattgagtcccgagtcggcaggaagccccccgaggagcccgccaacccgtga

SEQ ID NO: 1682 - DNA, 30978 bp, Homo sapiens
cggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcgggatgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacatttttttttttttttttgcaaaggcaaaccggtatgtgaagttgaaaaaatcaaaaaccctcaaattttccttcttttttttttttttttttttaaatcaagaaagggggtagataggtttgttttgttttagaaatagtttttatagcagagtgataccgtcacatttaatgatcctactgtgaattcaagaattcacgatgaaagttggattgagcggtattttggtgttcattctttgctgatactcattaatgaagttcgttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggatttctaaccttttttttaatctgtcggttattttttgaaaagaagtggggcttaactagtgctctaaggattttaacaagagattccgatttagaaatctgtccccccttttggtgaaattcttattttttttagagtcagaatcttcactgttgcccagttgtctccccgggacccaagccgtcttcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcatttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctccgacttgtttaaggtagaactggactgggtgttaacagtgttagttcagtagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacacggacacagggaggggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagtaaacctttgaacttaacagattgagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaattttttatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcactgccatgcctggctaatttttttatttttgtagagacagggtctctctatgttgcccagcctggtctcaaactcccgggatgaagcaatcctcccaccatggtctcccaaagtgtagggcttacaggcgtgagagcctgctggggtttttgattgacattgcattgaaactggaaatcagttaggaggcaactgacattttaataatgagccatgaacatggtatatctatttatttagaccttcttagatttttcgtcagtgttttgtagtttttagcagttggatcttgcttgtattttgtaatcttacacatttatttcatgtttgtggtactgttgtgaatgatacttctcaatttccagttggtgattgctagtatataggaaggtgattttatgttatatgctgaccttggattctacaaccttgctaaactcatttttagtactagaagcttttttgtagatttttggaattttgtgcatagacagtaatgtcactggcaaataagggcagtttaatttctttgttttcactttgtatgcttttatttccttttttttttttgagacggagtttctctcttgttgcccagtaaattagcccatgtaaatatttctgtttgtatctcttgaaagtaaagactcttttaaccatggatgagtgtcttgatcaaatcaacatggcttgttcatgtcgataccatttgctcagaggggaaagattaagggaaaaatggggttggatttcaaatgccaggacctgtctactgggtttgtgatttgttattctctaaagttgtagctcttaaaacaaagaaaggagtgagtttggcctattcattaacttttactctttagacagttcaaatgtttattgagttcttctacaggccgagccctgccttcttcatgcttaccaagaagcatttttacgcggtttctctaatgtttgggtggacggtacctcactaagttgtttttcacgcacgtgcgtgctcgttcctgaagagtcctgtccaggtgccctgcccgcttttcctttcaggcttctgtatcagctgccgtttccctatagaacgtgccctgacctccaccccttaaccctaaccaatttgcctttacatgtctgaccatccatcaaggctcttttgggtcatattcagtccatgttgatatttccccttcctcccttctttagtccttactatttttgctttggtcatgttttcttacactgtattctgtaagcctgtttaatttttttatggtggcaggggaaaatatttcataattatgctttgtgctttttatcttccactcaataaatgcttggtaaatatttgttttattgaatgtatgagcctattctagctatattgtgcttgaacaaaaatcttaactgccttgtaagttaactgctaagaatttgtcaaaagtgcagagataacatcaagagcttgtcatggatagtacaaaaaggtctctaagggcttgatggaagtctgtaaattgacttcctatgaaagagagtgtaagaagtgaaaaaaagcaaaacagagtagatgttttactctgtttgccaagggatttgtgctatttttttcctgttttataaatttgccctaatcttaaataatgaagggaaaagagcactctttttcaaccaaggaatcctttttatacttcttttctgtgaagccatgttatgaaagattgttatacaaacttaagtatagtttttccatcttcagtaacagacctgattgccatctagttactggttctgatcacacaagaatgcaaagcagcttgttctaataacttgtgcaggcctattgggaactagtatatggctttgagtccttttgaagtatttaacataatttggcaattccattactccttttatggacttcttggcatctatgaactcttggtagggaatcactgttttagaatgaaaaatgtctcccaggaagtaaattagccggtaaacaaatgaaacttcattttttatatgacttgtagagcataaattattactctttctgcataagtggctgctttctaggctgcttttagcgagattgttagaaacaaatgatcggtgctgtgaggaagaagcagcactcaggcaaaaaagttttctcagcaagacaatttgcttctgcaagtatgctgcttgcattagtcatgattgcaagagcacaccaaacggggtggagcaggggttcttatccctaatgcactccctacctctgtgtcattccaacatgggctggggtaggactgcacaatcttagctgactcagctggatattgtgaatattttctctaataagaaagggagggggaatgtgagttacaggttgggactggtaggaagagttgtttacaaggcaggttactaagcaggtaactaagctggtaagtagggtcgagaaggtacagggaaattgttcttaggaacaaagaacaaggaagttgaacaagttaaacctttgaagaggaacttactgtacctaacaattcccccctcttaatttttgtaattcttcctcttcaaacttttttagcatgtctttgctttgctgttctgcttggttttctagaaggaaaagcttatctgaatagggtggaggagagctaagagaagttttggtaaattctgtgtctatgagtctttgcagtagtccacaaatgtatggtatgatacagcatccaacaagaataagcacacctataacgattgcaagagaagtaaatattgaggacattaagcctttccattttccagaccatttctccattaaacttgtaaagggatcatttattccagaattgcttgctaactcattggataaggaggttaggtcctgcaaagcttttgttactgttccgtcaggggctgtgttattaggaataaaagtacatcattggactccaatcaagacacagacaccacctttttctgctagcatcgtatctagggctatcctgttttcccagactatttagttaatgggacctaattgggaggctgttcccttaatggcatgtcttgtgtagttaacaaacctttgttggttgtaataaatgtagtttatccaatctacatttttatttacagttgaccaccaaaacagcacagattcaaatcctgaagctgtttgatttcgggccttaaatttatctggtacccctcgtggaactccagtagcatctttataaacgtgggagtcaaaggacccatgaaggtcacttcttctcttctgattttctcttctattatgttaatggaatgctagggtgaaagggatggccagttggactagagcacaagtaccactccagttacttggcagagtgtccagtaagggtccaccacaataccaccatacgtatgctcgaggatgaacaagggcagactgactggtaagctcttgggagagtttaagttcaccgcatccctttaggtcttcatgaaatgccaagttttccccttgttgtgagagacccgaggtaaaaattggtgtcaatagatggaggctggatggccctcagggactgacctgcagggtgttggactttagggaatagcagagagagagcttggcaagattcattaccccaggctgtggggtcttggagaagagctaccatacagctcatgcccagttggctggaagaccatccgagtggaaaggggacaacctgggcctctggcctactgtgcgcacaagtgtaacagttgcttttgtttagagtgcggacagaatatttaatccattctaaccaagcatttgcatcttggtaccctgtctcagttgctatggtttgtttcaaatttttaacttctacaatggcttaccttgattttatccttggttgaaggaagaacagcggtttcgttgagagagagtgtagaaggaggtggaggaggtgagaaagtaatgaaatgcatttcaaaggattctataagatgtgtccctgctattttggctcctatgccgtataagcgacttaaagtaggtttagggttggcagaagtggggataagaatagaaatttgcactggattacattggttatactggcagtcagggggtggggaatgtttcctttaacaaagcaaacatggttttagagacttacaactgcctgttgacaaagccctgatgttcagttgtccacataatatcattccagctgtggcaggcctgtttccctacatttcttaaggaacaagagtcgtaatgggggaggcttttgtctgaaagggacggagatacttctctgaggctgagagttgcttttgactttggagatctccacaggatataacaaggcaagcatcaaaggtaatagtttggggtgagctcgacctagttacattaataacgagaggactagcaatagaaggggaaaagaaatatagcataagaggatcaaacccgttttagctttaacttggttggaattggccctgaaatagctgtccatgattctggagtgggtggtgctcttttgactcaggtatggtgagtccattctttttcagtggtgtggacggctgtctcagtcattagaaacactagataatgtccctcccaggtgggcttgagcttcctttctttctgacctttgatgagaatgtggtcactgtccgggctggtggtggtgaactggaaattcaaggggtggtgtatgtgccaagaggcctttagtcctaaggaaagagaaagtggaggatagaccaagtatatagttcttgagaaacagatcttttgtttcgaacgaggaatgtcagcagtggagtgtagataaggcaactcatacagcatttcataaggaggtgagccgacatctttcctaggggcagtttggaatcttcacaagaccatggggaggcatttagtccatggcaaccgagtctctaggactaatttggttaggtggtttttcagagtctgattcattctttctactcttcctgatgaaggtgggtgccaggggttatggtagtcccatgttatatctagtacttgggctagtttcttaagaacatgtgcagtgaaatgagtcctattgtctgaatcagcattttctattaatccaaacctgggtataatattttcaactaatgccttgagtacattactagcagttgcacttgaaaagggaatagcttctacccaatgagtaaggtgatctatcactaataaatattttaagtgaccaattgggggcatttcagcataatcaatttggacactttggaacagccttaatcctggatttctccctccaacaggtggttttctgaggatctgcttattagtcttcttacatactaggcaactatctgtaacttgtcttgccaaaatataaattcctatacatctgtagaccccgaggactgcatcacacttagcttgaggtccctaatgagtcccttgatgcagatgggagagaatttccctcatgaggggtttggataacatttctctttggtctggtgacacccatttcccttctgaattttctttggctcctatttttattaatttttccttttcagcgggagaaaagatggggactgcagtcgagggaggaaggcaagggactaagtgaaaaacaggcattttcagaggaaacggcagtgtgtttggctatttgatctgctaggttattccttccgctttgaaaagaaagacttttctgatgtcctggaacatggacaatagctattctggcagctgcaggttatctaatacttgggtgattaattctttgtggcccaggtcttggcctttgctattaataagatctcgttcagtccaaatttttccaaaggtgtgagctaccccaaaggcatacttggaatcagtataaatagtccgttcttggttttgcaagtgctttaaggcttgatttaatgcaaacaattcattcacatgtttgggcagaccaattatttggcaggcttcctgactctacttcttcaagtgcctccccatctactactgagtacctattacgcctttttccttcaattacttgggaagagccatctataaagaagccctgccccgttttgtaaggggtctctcttaaatcaggcctaacttttgtatgatcattaaatctaaacactcatgctcaggtctctttagatttggatctccagtcaggaaacctctgggttaagtgaattatcagtggttagtgttaaatcatctctttctaacaggatagcttcatactttaaaattctcaagtcagtaagccaccttcctgccttttaatttaagatggctctaacctgatggggcatgtttacaactaactttcccccaaaggttagttttctgctttctttagttaacaaggcggtagctgcaatggattgaaacattcaggccatccacaggttactggatctaaaacttttgataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccggctatccctaggaattttctgagttcttgtttagtcttaagcaaaggtatggatacaatcctttcaaccctctcaggccctatccttcgtttgccgttacttattaagtgtcctaggtatttaacttcaggctctatgaatcgaagctttctctttgaaacccatagcccctctccttacaaatggttaaggatatggacggagaaagcagataccttttctatagcctaaccggatattaataagtcatctacgtactggagcagacatatacattttggggtataaacttgttctaacacttgttctagaatttgaccaaagagattaggggaatctgtgaagccctggggtagaactgtctatcgatactgttgctgtcatccagaatggggatcttcccattcgaaagcaaaaatgtctcagctgtcctcatccaaggagcatgctcaaaaggcatcttttaaacctattactgtaaaccattgatgttcatatggaattttactgagaatggtttaaggattagggacaacaggatgggtagtctagactgtctggttgatggcccagaggtcttatgctagtcgacatgacctatctggtttcttcacaggcagtattggggtgttataaggggacatacagggttcaaggagcccatccttgatgaggctttcaattacaggtttcaggcctattctgccttctaaaggaatagaatattgctttcttcttactatttctccaggggtttttaactttatatgtatagggggaatttggagttttccccaatttccttcccttgcccaaacatcaggatgaatgtatgtttcttctgcagtggtgagcaggtttaatgaagtgtagaatccttctgagccaatacgtaaacctatacctaattttaacattaagtttcttcctaatagattagttcctgcctctgaaattaacaaaaattcaacattagctgagcagtttttacatctaatttctgtttcttttaaaatttttagtttgattccctctccttttacccctgagactacaagctcctctgaggaccaggttatattgtgggggaaggtaacaaacagaggagcaggctgctcctgagtctactaaaaaggtcataagctcggatttgggttccacttctaaatttatcaagggctcttggtgggattcaaggtaaaagagacagagcccctaacccccctattcctcctcaaaggtcgtaagtgggacgacttctctttctgattttaatttgggacaatacctcttgaagtggcctactttctcacaattgaagcattgattctgtctcttctctctatttttgggtttctcggctttgtctccttatgttctttatatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaaagttcgataggcccttcatctttcctttgttgtatgtcgaatgctcgagtaagattttgggttcggagtactgactcccgaatcccttttattatcatttccctaagttcttgcgtatcctcttcagtgggctgcgttattattgtcccagcaggggtcttggttggggaatttttgatccgctgcatgaatgttttggccaggagggtgttcatgttcccagggtaccatagcagctctacagatgatgcttctttcttcccctgagaaaaggatgcctaggatggacattaactcagcccaagtatatataactgtggtcctagaaattggttaattcgatctgctattccactggagttgtctaatagtgtggcttgaactctgtttttaggttttggacctccgagctggttaaaggagcatttacaaagtgaatacctcctcctcgtagggacacctctcttcaggggaagagaggtggagctaattctcccgaggtagaggggaaggggaagttctgaatatcccttttacattgctctatctcacactgaagtcctttcagggaagagtacttagggtgatagtgagcaggctgttgggacaattcccaagaggcagggttataaagagggggaacaatgtgggtaggagaagggtctgggacaactgcctctgcttgagggggaaggaggttagggatattggacgggggaaggtggtggaggaagttccatgtgttggtgagctgtctaggaacagggaccttatctttctcagaggagttaatttctgacttgcttttcaggattgattcctgagtccaaatgaaacaacaatattttatcatttgctgctttttcttgtatttagtcctttcactctcttttcaatattttagcataagccctaggggactatcaggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttccttcccttcccttcccttcccttcccttcccttccctttcccttctctttcccttccctttcccttccctttccctttcctttcctttccctttcctttcctttccctttcctttcctttccctttcctttcctttccctttccctttccctttcctttccctttcctttccgaggctcaacccccctgctggaggtttcttgcacttttctcctttcgcttcatccttctctggctgcttccctcatgggaacgttggtttcctcttagcaatggctgtttcagtagaaacccctgacccagactcctttacagaagggctaccttaagctgtataaggtgaccacagaactgcagatctggactgaacacttgctttgcactcaattgtgagtctcaacacacactttcaatctccaagatatcccaaccaccaagaaaatagtttgtcgctcttgtgatgtttcttacgttggtctgtgcacatagttacctggtcaccatggtatgtgaggatccttttctcttaagttgttggtctgttcctttccagactgctgagagtccgggtttattcatcacactgggtgggtcctgatccctcaccatgaggccacctcagtgaggcagtgggatgcttctcctcactattggtgactggagacccttttctcagaggagaatgggaattccagacgagcccccagattgttagaaacaaatgatcaggctgggcacagtggctcgcccctgtaatcccagcactttgggaggccgaggtgggcggatcatgaagtcaggagatcgagaccatcctggctaacatggtgaaatgccgtctctactaaaaaaaaaaaaaaaacacaaaaaaattagctgggcgcaatggtgggtgcctgtagtcccagctactcaggaggctgaggcaggagaatggcgtgaacctgggaggtggagcttgcagtgagctgagatcaagccactgtgctccaccctgggcaacagagcgaaactctgtctcaaaaaaaaaaaaaagaaagaaaaaagaaacaaatgatcagtgctgcaaggaagaaccagcactcaggaaaaaaagttttctcagcaagacaacttacttctgcaaaagactgctgtttgcattagtcacgaatgcaagagcacaccgagcaggatagagcaggagtttatatccctaacgcagtccctacctctctgtcatttccacatgggctggagtcggactacacaatctaagcagacttgatttgctatcgcgaatattctccctaataaggaagggagagggaatgtgagttacaggttgggactgacgggaagagttgtttacaaggcaggtaactgagcagataactaagcaggtaaataggggtgagaaggtacagggaaattgttcttaggaacaaagaacgaggaagttgaacaggttaaacctttgaagaggaacttactgtacctaataagtttttttgattggctaattaaatgtctattcattattgccaaaaagtgcctacctcaacaacaagataccaaattttagaaaatgttggagctctctctgaatctaggaggaagtgagtagtttagcttttatttagtagttaggaccttaagtaaatcactttttttactgtgtttctgtataacatagataatattttttgccctgcaagagagcatatagaggaaagctctttggcagcgatactgtgccctatgaataaaaaagtgatggtgtcatttgtggctgaataacagtttattttgagaatgctttataacagcttttcatgggaaataaagcaatgctgttaacttcatcttgcatttttctcatttttactatgattaaaaagtagtcagcttgtacaaaggaaagaaacaagccttgactcaggagcctaggactttttctttggtttgccctcctggaacagattacctttccaaattgaatttgtggaggagcattgggaaatatcagaaatgtcatattaagcacctcagtggtacttttaatagaggagttattcagaaattatactaggcagatagagagggtaaggaggcctcagtaaggctttcccttttaatagaaacaactccagaaacatttctttttcttttctttttatcttttttttggagacggaatctcgctctgtcacccaggctggagtgcagtggtgtgatctcagctcactgcagcctctgcctcccaggttcaagtgaatctcctgcctcagcctcctgagtagctgggactacaggctgccaagctttgatatgcaaatgccagcgcttagaaactgtgtccattcaacatggagattcccaccctcttcttctagtcaccacctcaaggtgacacctccagatgaccccatgtgtgcaggacaacatggtgacctacatttgcatattaaaaggctagggtgggagggccacgtttttctcgggctacatgaatgacctgcctggtcaaaccaatgccctgggccctgtgcaaatcagacaccacctcctccagcctcccaatataaccgagtactgttctgccacacacggggctttttctctgttcagacccccctttttctgtaccgcagggagcctttcttctttcttgcctattaaactttctgttccttaaaaccactcctgtgtgtccatgtcgtttaactggcgtgagacaaaggaccccgatgtttctcccgttttcagagccatatcactttgagtccagaggaattattttcatttatctgaccaatttataatatagggtcaaattcctagtggttatcctccctcatccccatttttatacccttccttgaaaggaacaggtatatgaagaggagacaggtttcccttttgtgaatagtatatcccttagtatcttgatttttttttggtgggggtggggggagttaaacttacttagacctggtaaagggcagtatttgataaatgtcagctagtttagggttagggaattgagttgaatggagatagtcactgccaaatgtaaagcatgactggagagccacagtgatgaagccagggtccctttctccagatcctttgtaacagtgttatgtgatctcttctagaagattgttctgaaagataatgccaactcggaacctaggaaaccatccagtgggtttctgcagcttaggtggttcaaatcctcatcagcacgtttgttttctctgcctcagtttgcttacagtgatgttctcagtagctgtaattgctgtctttgaatacttaagcattttttttttagctcacaggggtatgtgtgcatttttcttttaccaagtgttagaactttgactctgcttttgtgggctctggtttagcaacttggttgtttagttgtaaaatgattagtagggaaaaccgtgtgtgtgtgtgtgtgtgtgtgtgtgtgtgtgtgtgtgtgtattttaagtttcttttgttctcagagcacttagaattttatatggaaattctatcagtttacttgattctccaccccacatttcttaaacagcaaagtatgaaggtaatgtgtcccgtaaccagccttcagaataattacagctgctgtgtctctgaactttcaagaagtttgtgcatcaattttcaaaaaattatgaaatccttgaagatagctgtgttctacatttggaaagatacaaaaactgaaccttctagcaggcagttttgcttgctggtgcttgcgatagagccacacattggtctcagtggatttatggagaaaaataggtacggaaagttatttctaaataagaccaaaaatccttttcttaagcagtgacaggtaaagaggttgtcttggctaatattgaattgtgttgcccttgattgagacagttttatggtggggatggtagtggtgataaacttgtttgaaatttgtccacctatagtaacctttgtggtagctgtcacagacagcttcatcctcacaggccctaaaattactataaaactaatagattggaggagaaacaaaggacctgaataattagatgcttagataattgttctgtgttttcataacaagtgaaaaagagcagtgttagaagtacttaaactttccatgtaaggagcactgcctgaatttatattgtgattttagagcatcattcactgtttaaaaacaggcatattgtgggtcatattttaaagacaaacagaaagcttatcttttcaagatggatctaaagcttaaccttatcaaaattacaaaatgtgaaggatatgattgaaaaatattaatgcataggtttaaatattggtcatcattttagatgtctttcaaaataggttgtctcttaaatattaaactgaacaaacattgaacttgttgtagagtttgtgctcaaggttaagtttcctggggtgatggatatttgataatatggataacaaaaagttcttaagaaatttagaaaatttttaggcaaaactagaaaataatactgataattctaccactcagaatgtaccactatcagaattttgtatctttcagtcatctgctcatctcttttctcctttgcttgtatgtgttccctctcccttaaaaaatcagattttttttttgtaatctgcattttcactcaatattgtagatctgtgtcataagttactcctctacagtgccttcagttattgtgtgctttgtgttggatgactgtaccatctagtctttcgtgtttcctggtactgactacataggggtgagtgtgtgtgtgtgtgtgtgtgtgtgtgtgtgtgtattttttttctaccttaactaatgctttggacatcatcaacaggtagagctaaatccttgaaaccttccaagtggtggctttcagttattgctgaattggtttttagagatggaacaaattatattgtatggaaacttttttttttttttttttttttgagacaaagtctcagcttgtcacccaggctggagggcaatggcatgatcttggctcactaaaacctccacctcccaggttcaagtgatcctcttgcctcagcctcccgagtagttgggattacaggggcctgccaccatgcccggctaatgtttgtgtttttactagagatggggtttcatcatgttggccaggcttgtctcgaactcctgacctcaggtgatccactcaccttggtctcccaaagtactgggattacaggcatgagccaccatacccagcctttttttcttctaggtaccagcttttatttatcagattggtataaatgttagaaagcgtgcaatgaaatgggcattttcacagtcgtggcagaaagtataattatctttgactttctagaaagcagtctggcattctagaaacttgcctaacctcttcccatttagacaagatgaattctgacagggccagccttgtccctgtgattccgtatctcccagaaagagaggtctagtctcagggaaaacccagattttcttggcttagcccacctgacagctaatcactggaaatggggcgggccggtagagtcctttggtcaggttttgtgtcaagagagggatgtggaaagatgggagagaggtagcaaaactggcctcaatggaactgtgtaagttaacatagaatggcaaaggaatgtttcttccaaggaagaaattctagggaaggaataaagtagaggggaaggcagcagttctcaaagttttggggtcaggattcctttacactcttaaaagtatattgagggcccaaggagcttttgtgtatgtgggttatatctattggtatttatcactagaaattaaatcagaaatacttaaaatattccttaaaagctcacaaaatattgttataaatgcttttatgataagaaaatttctaaacccaaggtagtacagtcttacatcttttgcaaatttctttgatgtttgatatgtcatttgtacctgcattcaatttattgtgtgatatttgcttgaaaaaatgtgaacaaaggacagtctcatacagataggcatttcagatcattgtggatatttcttttttctttctttctttcttttttttttttttttgagatggggtctttctctgtctcccaggctggaatgcagtgctatgatcacggctcactggagcctcattctctggggactcaggtgatcctcccacctcagcctctagagtagctgggactacaggtgtgtactaccccaccttgctaattttttgtattttttgtagagatagggttttgccataggtattcaaatagaaagttttgtttttgttttagtatataaagaaatataactttccatgttggaaaaatttttaaaacctttttttaattttaaaactcataagcaaccattgttgagaaaattggtaaagtacagaaaagataaaagaaaaaaattaaagtctcccataatttctctatctaatataaccactattgactgttgacatgatggtcattttctaccagtatatattttttctttgctattaaaatacataacccttacacatatgcttaatagttgaggtcatattctctatagttttatatatatatatatatatatattttttttttttttttttttttttttttgagacagagtcttgctctgtcacccaggctggagtgcagtgccgtggtctcggctcactgcaagctccacctcctgggttcccaccattctcctgcctcagcctccccagtagctgggactacaggcgcccgccaccattcccggctaattttttgtattttttagtagagatggggttccaccgtgttagccaggatggtctcgatctcctgacctcatggtctgcccaccttggcctcccaaagtgctgggattacaggcgtgagccactgtgcctggcccttttatattcttttaaaaagtatttactgtattttcctgtgatgtcatagtctttatagaaaaataatcattattttcagttgacatgattgtttacctaaaaatatccaaaggaaccaactgagaaaaaacaatttttaagattactggttaaaagttcttttatataaaaatcaatagccttccccaatgttagctataatcacatagaagatatagtgatgaagtattttttcaggtatttcagcaaaaattaaatgcctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttgtatttccaactacttctgaggctgaggtgggaggagcacttgagcctgggaggcagaggttgcagtgagccgagatcatgcctctgaactccagcctaggtgacagagtgagaccctgtctcaaaaaaaaaaaaaaaaaaaaaaactagaaaagtgtgtgtgtatatatatatatttcatattttataaatatttatatatataaattgtatatatacattttatattttatatatagtgtgtgtgtattatatatatatacacacacacacaaatttcagtacaaattctggcagatttatttttgacacttgacaaaacgactctaaaatttgtttagaagaataagtaataaaaattaataaagtatagactctttcaaccagatagtaaataaaatattgtggactatccctgggccagacagataaaggcaatggaagtttagaaccagagtcatgcaaacgagaatttagtataaggaaaaggtggtattttaacttaatactgaaaagatagattattctgtaaatggttttaggagaactatttgaggaagtctgagtcttaactccaatttttgtcaaaataagttagttggtttaaacacatctattcttaaaaattagaacagaagaatattggtttgaagatattttaagagttaaggctgaggctgggcacagtggttcacgcctgtaatcccagcactttgcgaggccaaggtgggaggattgcttgagcccaggagtttgagatcagcctgggcaacatagcaagactctttctctctctctctctctcgatatagatatacatataaatatacgtatacaaatagaaaaaaaaaagagttaagttttatatggagagccatgaagataagaggtaaaaattaaaggcttgatggacacatgtttacatctccatcaagggggttgatgggaaagaatgatagacatagctccattactgctacctccttttaggaagttgcttctgaacatctaaagatatcagttttataatagaaatgagttatttttcagtgtctaaaacaccacatgagatacatacatacatgcatacatacataaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaattaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaatgaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatgggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtctgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgcggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggatgaccgcgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaaggctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccaggctgccttgaagaagctctcccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacaccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcatgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacatgggcttctataccgcttcgactggaagatccacctccccactgccttttctcactcagatggggacaccgaggtccagaggaaaagacacctgtcaaatgtcacagatctgggaggggacttaagacttatcatgccaagagga

SEQ ID NO: 1683 - DNA, 28973 bp, Homo sapiens
cttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcaca

SEQ ID NO: 1684 - DNA, 43297 bp, Homo sapiens
taagcaaccatttccgcttccgctggcggggtctcctccgtgagctccgggcctgtttgcctgctgaagtagagtcttagggtgaccccagggggacgtaatgtttccgagaagaaggacagaaagaagactgggagacaccggaactcgaaagaaaatcggtaacaaaatgtgggttcggccaacagtgccctgtaggcctgaaatttcggtctggccagagcaaggtgattgagagggcgggggttcgggcctagcctgggcttgagctgtcctttgtgtcttgagcggatggtggggccgtggaacatgaaggagtatctttgtgtacgttcacaacgttcacatcggtgtaggccaggttgctggactctgactcaaagtgttatagaggcattacgtattgtacccgcagctgcagcctaagcgagctgcttcagcttcctagtcacaggatcccacgcgagaatagagccataggttagcgtcgcaggacgttgttcgcccccggatacctcacatgcagcctaccctagagccagtcatttcctattgtgtgctgggggaggagggagtgccctggtgtaggcatttggaattggaaaattgagctcctccccaagctctgccactgattggttggtaatcttggccagtttacaactttgctttcctcagctgcaaacagctcagagtgcctctctgggctaactcagagggtaatttcaaagattataagataatgtaagtgaaagaaattgccagtttataaaggtgtttggggaaaaaaaaagacgaaaatgataggtaccttgatagaaaagcctgaaaagtctcaacatatttccttattccagtgccaggcacattcctgtatctaaaagcttaatgaatggctgcatggttattaaaacaatattaggagatttgacaacttaggtaatgtgattttgtggaatatctgataggatagtttcagctacaagtaacagaaaacccaccgaaaggatgttcaaagagcagttacaggttggttaattcggtggcccagtgacaacatcaaggtcccagtgcttctctgccaccctaagcatgttggtaacgttgacaatagaatccaggtaaaatatacagacatgtattgtgtcatgtacccatcctaaactagttattaccaagaataaataattgtttggggcccatcatgcttcagcccctgtcactaggggaaggacctagcctcccttgataatctacctgcacaaaattagggctttgttacaaatgaaaaaaagagatgtggaaaataagttagataagaaactagcagtatctgccacaaatgatatctcttgacagctaactaagagctagaccttgtggggatggatcacaaaagaggtagctgtgaagtcccagtaaaggtgcttccaggacaggtggaagaatggtaagaacaaacttgcctacaggctagaccagtccaaagcatatatgttgaagaagagctaatagcctgtatatgaaggtgtaagtaaaggagatgttcatggttgagtcactgtggtgttcacgtagtcatctttcccttcttggtttgtgcttatctcttttttttttttttttttgagacagtctcactctgtagccagactggggtgcagtggcacaatcctgactcactgcaacctctgcctccggggttcaaatgattctcctgcctaagcctcctgagtagctgggactacaggtgcccgccaccacgtccggctaattttttttttttgtatttttagtagagatggggtttcatcatgttggccaggatggtctcgatctcgtgacctcatgatccacctcggcttcccaaagtgctgggattacaagcgtgagccaccgcgccccgcctatttaatgctattcttacatcagcactgtctcattgtggtctgagattctccttatctggatttgtggctctttcaccaagaacaagagactcccgtggctctcttctttaaatcctgttgccataattacaaagaaataaacacagtttccaatgctttgaaatgaagcatgtggtattaactcagtggattaccagagagagagggatatacctgaaatgggagaggaaaaaatcttccctagactatctttcctaagagccatcaaaactataaacaagtggacaaagaaggaggaagcttgaaagctttatcttcctgaaaataaagagatgacatacaaagtccaagatagaccaagattgaaaaattagaccacattatatccctaactcaattttgtaaaaaatcacaaatgcttgactgtatacccactatatgttcaagtaacatgttttaatcatcaaaatttaaaaatccttccacgacaatcttttgcaagtttttccatttctgtctttaacatggtaccagtaataacaactacaacctgtttgtattgaaattatttctatagcccagcatctgctttctctgaaaattatctttttaaaaatagtaaaactaacatcattacaaaagtagtatatgtgcatttcagaaagttaggaaaggctgggtgcggtggctcacgcctgtaatcccagcattttgtgaggctgaggtgggcagatcacaaggtcaggagatcgagaccatcctggctaacacgatgaaaccccatctatactaaaaatacaaaaaattagccaggcgtggtagcgggcacctgtagtcccagctactcgggaggctgaggcaggagaatggcgtgaacctgggaggcggagcttgcagtgagccgagatcacaccactgcactccagcctgggtgacagagtgagactctgtctgaaaaaaaaaaaaaaaagaaaatacaggggaaaaaatggcaacacattcctgtcacccagagatcaccactatttactctttattatttgtttttttttttttgagacagtctcactgttgcccaggctggagagcagtggtgcgatctctgctcactgcaacttccgcctcctgggttcaagtgattcttgtgcctcagctaccagagtagatgagatgatgggcagatgccaccacaaccatttaatttttgtatttttagtagagatgcagttttgccatgttggccaggctggtctcaaactcctggcctcaagtgatccgcccatgtcagcctcccaaagtgctgggattacaggtatgagccaccgcacctggcctgctcactgcaacctccatctcccaggttcaagcaattcttctggctcagcctcccgagtagctgggactataggtgcgtaccaccacacctggcgaatttttgtatttttagtagaggacgggttttccccatattggccaggctggtctcgaactcctgaccttgtgatctgcccgccttggcctcccaaagtgctgggattacaggcgtgagcccctgcccccggcccctattcttaagtatatatcttttccctagtgatttttatgatgatgcagctgtatattgaaacggaaagatactcatttttgggagtaaaattggttatgaaacaaaaacaataacaaagttgcttttgaagactatgcgttaaaatggtagtggtagttatatttttaatttttatgggtacatagtaggtgtatatatttatgtggtacatgaaatattttgatgcaggcatgcaatgtgtaatcacttcaaggtaaatggggtatcttccctggcgatgtttaacatgatttccagaatgaattgctcactacgtttggtgtgttttccattcccagatggtactgccttttaaggtctattacttaaacataagtatggctctggttcttaccgcctttaccgtatccttcatgggaagttgatactgatcggaaactgacacagagccttctcacctacactaagggggcctaggtaagcaagattatctttctcccaacttcagcaagaggttttcttactggtgttcagaatgcttgattgagcagttagaaaactgttgctacctagtctccagtcttataaggggacaatggctgcaagtcatgcctgcaagaacaagaggctcacacagttttgaaattagcacaacttctagctggataggagtctttttagtttcatttagccttgagttgaaactaataggagtcttttaattagaaaaaagctcagggctctaaacgtaccttcaacatgttaattctgttaccaaaaactggcttggtctgtgttaactcccaacagaattctttttcagtcactgaggcagaggtgcttccagagaaagattcttgacctactcatactgaataattatcgttactagaagctgcaaccaaagactcctggagggtagtaagaggtacagagaatgcaggttagatacagtgaggacagagaagaaaggatgggttggaggctgggcgtggtcactcacacctataattccagctactttagaggctgaagcaagagaatcacttgagtccaggagttcgaggctgcagtgagctagcattgtgccactgcactccagcttggatgacagagcaagaccttgtctcaaaaaaaaaaaaaaaaaaaacatgggttgctttgtagtttagagaactacatgtttagatagttaatttttccccaaaagggcccatcagattgatactctgagatccagggtttgtctgacactcattagcctatgagttgtagagatgggatggccaggagtgaagtgatggccttgtgtctttctcccctgcagcatacagaaaggctgtacctggaggaaggaagtgcggagccagcctgagttgggagaagagctccagagagtgagtcaaagcgctctgtgtcctgctattaatgatgccctcatagtcagaggaagcctacttaagtgaaatccatttttgacctgtcaagtattaaatattctcttaatttttagtactgaatgatagaaggcgcctagtgaaacaaatgctttcacttttttgctaggagggtaaatgagtatattcttacgttaggtacacagggatacagtacaagtatgccagcctctttaaactataaagaagtaaacaagatttggtttaagcatcagtctcttgtgagtctgatgggtaagcccagtctcagggcacactgacaatgttagtggagaacgagactctcccagtgtgctgccctgaccctctgagattggtctgtgtagccacgtggtggtcatcctgtgccacctctggtttggttctaatcaaaggaagcagtatcatctgtggtgatccgtcttacacacttgcatcattttataccaaaggagaatttcttttgttaaaaatttatttttcattatctactcataaagaaggagccaaagggctgggcgcagtggctcacgcctgtaatcccagcactttaggaggtgaggcgggtagatctctggaggtcaggagttcgagaccagcctgcccaacatgttgaaaccccatctctactaaaaaatacaaaaatgtagccgggtgtgctgggcgtggtggctcacgtctgtaatcccagcactttgggaggccaaggcaggtggatcatgaggtcaggagatcgagaccatcctggctaacacggtgaaaccccatctttactaaaaatacaaaaaattagctgggcgtggtggtgggcacctgtagtcccagctacttgggaggctgaggcaggagaatggtgtgaacctgggaggtgacagttgcagtgagccgagatcacaccactgtactccagactgggcgacagagcaagactctgtctcagaaaaaaaaagaaaaatttagccaggcatggtggcgcccaactgtagtcccagctactcgggaggctaaggaagaagaattgcttgaactcaggaaatggaggttgcagtgagctgagatcgcaccactgcactccagcctgggtgacagagcgagaccccatctgatatggtttggctgtgtccccacccaaatctcatctgcaattcccatatattatgggagggacccagtaggaggtaattgaatcgtggggcaggtctttcccatgctgttctcatgatagtgaataagtctcacgagatctaatggtttttaaaaaggggagtttccctgcacaagccctcttttgtctgccaccatgtgagacatgccttttaccttccaccgtaattgtgaggcctccccagccacgtggaactgtaagtccattaaacctcttttttttgtaaattgcgcagtctcaggtatgtctttatcagcagtgtgaaaacagactaatacatcgtctcaaaaaaagagaaaagaagaagaaggaactaaagaagaatttctttggaagcaaaatatttggaagcaaaatatttggctcctgactgaaagggttttgatccatgcatacattaataaacccttcagaaccatgagttgggataattcactgtcccttgtgctagtctcatggagcttttctgctcttctgggagtgctcctggggtggtctggaggcctctcaggcagagcagaggctggtcagcaagccacagggcttgccatgaagtggtttgttcatgatttgtttctgggaccctgggaaaaatgttctcagggtctgcctaggaaggctggttttggaagcttgtggatttctttctgggtgagtcaggaaagttgtgctcctgctgggcgcagtggctcatgcctgtaatcccagcactttgggaggctgaggcaggcggatcacaaggtcaggagatcgagaccatcctggctaacatggtgaaaccccatctctactaaaaatacaaaaaattagccgagcgtggtggtgggcacctgtggtcccagctactcgggaggctgaggcaggagaatggtgtgaacccgggaggcggagtttgcagtgagccgagatcgtgccactgcactccagcctgggcgacagagtgagactccgtctcaaaaaaaaaaaaaaaaaaaaaaaaagaaagttgtgatccaagggaaagcatacaggttttaatgatgaactagtttgttcctttgtctcctggctttcattcttcatggcatgtgctcagggcagccagtggagagaggcatcattctgcatggtatagaagccttgggtgggtgtttcatcatctgtaaaatgaggacaacaatactgaactttcaaggccattgtaaattagaatgtacagtacaagcattgtaagttagaagtcaattagaacatgcaggagggattataactcagtgtttagcgtatagcagacacttagtaaataatgcatttactctgttccattctagaagctccattgttgtttgtacaacaaacacctctgttgcagtgcttatcagattgtcttgtaatcacgtaactcctcaaaggcaggatgtgtgtaataacacatttccttggtcaccatttgtacccagaatggggaaggaagaaatgaaaagaatccagtatctaagcccagcctccatttcacttgcacgccttttatttatgaaaatatagtacttgtccatgtaaataatatctctgaatggataccaggaaaatggtaagatgagttagctggagaacttgggtactgagttggagggagggtaacttatttttcaccaatgtatccttttgttttgctttaaaataatttaccacaggcatgcattacttctaaaaataaaaatgtttactgtcagaaaactcccccaagttaaaccaaaaccaaaatatgttagatacatctgtaacactcattataaaagatgacatataaatgcctcaaaaatagaaaaggtgatcaaacttactgagaaatgtgcattaaaacaatgagacctttttcagttagattgcagaaaggtaaagaataatacctggccaggtgtggtggctcacacctgtaatcctaacactttgggaggccaaggtgggtggatcacctaagctcaggagttggagaccagcctgggcaacatgacaaaacctcgtctctacaaaaaatgcaaaaactagtgaggcttggtggtaggcgcctgtactcccagctactcgggaggctaaggcagcggaatcacttgagcccaggaggcagaaattgcagtgagctgagaccacacgactgcattccagcctgggggacagagcaagaccctgtctcaaaaaaaaaaatgagcatggtggctcacaccagtaatcccagaatcccagcactttgggaggtaaggtggtcagatcacttgcaccaggagttcgagaccagcctgggcaatatagtgagactctgcctctacaaaaaataaaaaattagccaggtatggtggcgcatgcctgtactcccagctactggggagggtgaggtgggaggatcacttgagaccaggaggttgacgctgcagtaagccgtgatcacgccactttactccaacttggatgacagagtgagaccttgtctcaaaaaaattaaaaaagactaattccctatgttggtgaggctgcgggccatttgccctgctgtagtgggtgtagagtcttcacactcttggtatgagaataaattggtaaaactttctggcaggcaatctagggtttgtttccaaagttaaatgtggttaattaaaactaattttacttatgcctgtaatcctagcactttgggaggctgaggtgggcagattgcctgagctcaggcattcaagaccagcctgggcaacatggcgaaactctatctctactaaaaatacaaaaaattaaccgggcatggtggcaggtgcctgtagtcccagctactcaggaagctgaggcacgagaatcacttgagcccaggaggcagaagttgcagtgagccaaagattgtgtcacactccagccggaggggcagagcaagaccccgtctcaaaaaaaaaaaaagaatgcttggttgagcatggtggctcacaccagtaatcccagcactttgggaggtaaggtggtcagctcacttgcaccaggagttcgagaccagcctgggcaacatagtgagactctgtctctacaaaaaaatgaaaaattagccgggtgtggtggtacgtgcctgtagtcccagctactggggaggctgaggtgggaggatcacttgagaccaggaggtcgacactgcagtaagccgtgatcatgccactgcactccaacttgggtgacagagtgagaccttgtctcaaaaaaattaaaaaagactaatcccctatgttggtgaggctgcgggccgtttgccctgctatagtgggtgtagagtcttcacactcttggtatgagaataaattggtaaaactttctggcaggcaatctagggtttgtttccaaagttaaatgtggttaattaaaaataattttactcacgcctgtaatcctagcactttgggaggctgaggcaggcagattgcctgagctcaggagttcaggaccagcctgggcaacatggtgaaaccctgtctctactaaaaatacaaaaaattagctgggcatggtggcatgcacctgtagtcccatctactcaggaggctggggcaagagaatcgcttgaacctgggaggtgtaggctgcattgagccaagatccactgcactccagcctgggcaacagagtgagactctgtctccaataatgaaatcatgaaaaaaaatttttttttttgagacagagtttcgctctcgtccaggctggagtgcaatggcatgatctcagctcaccacaacctctgccttccaggttcaagcgattcttctgccttagcctctcaagtagctgggattacaggcacgcaccaccacgcctggctaattttgtatttttagtagagatggggtttctccatgttggtcaggctggtctcgaactcccaacctcaggtgatctgcctgcctcagcctccgaaagtgctgggattacaggtgtgagccactgcacccagctaataataataatttgaaccaacattctaggcattttccctaaggaaataatcagaacgtatgcagatttgtgtacaagattgtaagttgcaatattgtttttgacctgaatgtgtaggtttcagtggggaaacctgatccccagtccctgctctcctcccaccccaaccccatccatctactacctttcccaaatagagcttgcgtagggccattggtgtccaggatccagagcagggcatgggtttgtgggaggtggtggttggaatcacctggggttggatactggacttagttcctctatgggtaaatgagagcctggggattgtcggaaagaggcctagggtgaaaattaaaatgacttaatttcaggagcagtcttggccttggagattcatgggacttaagagaggaagggcagaggctgaccgtgtagatggtagcttgttgctctacctgggccagagaagcctgcttgcctccctatctccaaggctgaaagagggttgtgcagctgaagatacaggaatttaggatacaggcaagtgccatgacctggcagcttggtatgtcgctacactgcaggagcctgctggcttcccaccactgggagtgccgttaggtgtctgtgctagacccatggccagagggtgaaaggaggcatgagtaaataggcaagagaaaagcgataatatgctggaagaggccttagagccagagggagaaggagcagacagactctcataaataaggagttctggtgaaacagaatttctgcgagagattcaattatagcaaaactttatggaaccaaaaagcttaaaaaaaaatcagaagtttaatagataaactgaaggagagaatggtcagcacaaactgagtagcctgttagatcaagtggaagaaacactcaaacacagcaaaaaaagagagagagaaaggaaccatgaaagcaaagaggtggaggaccaatcagccctgaagtcgatggtgatcaacccattcctgaaccatccctgtgaccggcagatgtccctctgcttgacttgcttaggcaggggtcctctgaactcatcacagagccaagggagaatgggatgaccttaatgggttaaaccagttagggaacacactggaacaaggggtagagtctgtgccacaaacacaaagagaaagggtggaagtttttttagtgtacaaataaccttgaatatctcctgtagtgacacatggtgcctaaccgaatgaaccgttgtgaagataaatgagatcttgcataacatgtttaacacaatgcctcacacataagccgtggagaaatagttattttctcatttgtgttttaaaggagtatttttttcttttttgagactgtcactttgttgcccaggctggagtgcaatggtgcgatctcggctcgctgcaacctcggcctcccgggttcaagccattctcatgtctcagactcccgaatagctgggattacaggcatgtaccaccatgctcagcaaatttttttttgttgttgtatttttagtagagatggggtttcaccatgttggccaggctggtctgctggtctcgaacctcttgacctcaagtgatccacccgcgtcagcctcccaaagtgctgggattacaggcatgagccaccgggcatagccaaaaaagagtttttagttttttttttttttttttttttgagacggagtctcgctctgtctgtcacccaggctggagtgcagtggcgcgatctcagctcactgcaagctccacctcctgggttcacgccattctcctgcctcagcctcccaagtagctgggactacaggcacctgccaccacgcccggctaatttttctgtatttttagtagagacggggtttcaccgtgttagccaggatgctcttgatctcctgacctcgtgatccgcctgccttggcctcccaaagtgctgggattacaggcgtgagccactgcacccggcccaagttttgggtttttttgttttgttttgttttgagaaggagtcttgctctgtcccagactggagtacagtggcgcgatctcggctcactgcaacctccacgtcctgagttcaagcgattctcccacctcagccttttagtagctgggattacaggcacgcaccactatgcccagctaatttttgtatttttagtagcgacggggtttcaccatgttggccaggatggtctcgatatcttgacctcatggttcacccgacttgacctcccaaagtgctgggattacaggcatgagccaccgcgccctgcccaaaaaaagagtaaagtttgaagggatgtacatgctgttctgtttgccagttcatcttaacggtgctgtatttagaaccctggaaacagccgggcacggtctcaaaacaaacacacaccccgtggaaacaatagaatgttgttactctgttgttacttagggagtgttttttcaaactgtactgtgcttgttactcacatgggggtcttgttgaatgcagattctgaattaagtgcccattctgactcagtccaactgagtcctgaggttctgcatttttagcaagctcccaggtgatgccgctgctcctggaccgcagactgcactgagtagcaggcacctgagttttgcctgtttttatgattgattgggctccccacggcatccatcttctagccagtgggaaaggggagaggaagtacagagcgagcaatttcctttttttttttaaccccatcttttattttgaaaatttcaaacctcctcaatttttgaaagaataatgcgcttcaccagttgttaacaatttagcaatattcttttaagcacatgacacagaagttgccaacattgtgctctctcttgttcactggtgaaacttttggcacatagcctgatcctgctgcaggagaggctgagaaataaaagcctagcttgacagtgatctgcctgctgaagggggtgggattctgttactactagatgatgataaagcagttattttttaaaaggagaagatggcagagtaggacaatggatactaggggacagtttgacacgcagactcaaatctttttttttttagatggagttttgcttttgtcgcgcaggctggagtgcagtggcgcaatctcggctcactgcagcctccacctccagggttcaaacgattctcctgcctcagcctcccaggtaggtgggattatgggcacatgccaccacgcctggctaatttttttgtatttttagtagagacagggtttcatcatgttggccaggctggtctggaactcctgacctcaggtgatccacccacctcggcctccggaagtgctagaattataggcgtgagccaccacacccagccaagactcgaatcttataaccagttctcttcaaattggattctggaaagctcggagttgaaatatacagcccaggttggtcgtggtggctcacgtcagtaatcccagtattttaagaggcccaggcgggcagatcacttgaggccaggggttcaagaccagcctgggcaacataatgacattcccatccctacaaaaaaacaaaaaacccaaaaaacctgttttttaattagccaggcatggtggttcacacctgtagtctcggctacttgggagactgaggcggaggccaggagttggaggctgcagtgagccgagattgcgccccaggctgggagacagagaccctgtctcaacaacaaaaacttcgcgttagatcttgcattatagaacccctacaaccggagggcagcttaagttgcctgttttactcagggacagccctaaactgcctttcgccagaatcggacggctgagaatccagtgtcgtcgcggggtggtgctgccagctggctccgggtggtcggccaggagccagccttgtgcacctgctttcagttgttggccagccccggcgctgcaggccctcgcgagcttaggatgcgcctgccagggcctgtgcgggggggccactcggtagagccgcgggacctcggcccggaaaccgcgccaccggcgtccgcacacgctaggccggggagcccagaggtctggccggccatgtctcggcgacctcccggagcgagggacagggaaggagccggccctcaccagtgccccgcatacgggatcctgggcctggcttcgcacggagcctgcccgctcccaacctgcccgctcccaacatggcggcagcgccggcctcagggggcggggccacgtgggggcggcggccaatgggcttccgggctgcgctgccggcagggagcgggaggcggaagtgccgcgggctgccgcctccgtcccggctgcggcccctgccggttacataactcgttgcgggctccgcgcggtcccacttcccggctcccttcgcctccaggatgcgctgagccctacaacacccccagcggccgccggctcccccacgaggtgaggtggcggggggcggccgccggggctcggacctgcggcggggcgccgagggggcggggtaggcggggaggccgcgccggggtcaggggggccagcgcccaccgggtacgagcgcgctggtgaggcaggcccggccgcgcccgcgcccccggcgcacggtcctcccgggagccggtttcggggacggcggcggggagtgggcgctggccagggacgagggttgaggaggtcgcggctctcatgctgggtgggagtcgggccttctgcctgggggttgcgtcagtgtccgaccccgcgatgagtggtcgggacaatttgcaactagagggtggtcctcatgggtaccctgtggggtgtcgcgcgaggtgaagggccaggccatttccgtcgggtcagcgatttccgccttcgccccgctctcgcctggcctggtcagggcctgttttggtacttgttgcgccgattggagtcatctgcgacttgtttgccctcctctgaactcctgaaagccaggggctccgtctaggtctcctcctagtcttattctcccagctttcgttgttaagacaaattccttacgttcctggccctttacagaccggccctacagaacccacacccccagctccgactttcttctccagattgggtacttcccagggagtaaagggaatctgtagcttttgtggtttgtcctgctgggaaaatttgggggtaagtggtgggccttctctggacgaccacccacaaatctgtgtgcccaaacggagacaggacccagggtctggacatcaggcaaggggtactctgcagtaaacgtggacattggccgtttcgtgggtttgttttcactctgccaagtccttgaggcgtacacttttgtgtcactcatttatcttgaaagaaaaggttaacagcccaacagagtagttcgctttggtatctggagtggtaatcagagtgccagaactggagagaacattgccgtgtacagatgtttgccttttaccagggcactgaaggcataaaacccttagttaatgcttaactgagtgaaccatgaaagtcatgtgactccaaaggtcgactctagaaatgcggcagtccatgtagcactgtgatgtagaaattctatgatatatgggtcagtgttcacaggcagggagagggggagtcttcaacatctttgaattaaaaagcatctggggcaaaaacaaataaatacacacatatcagtgaactgctttaagttcagttagagaaggtgagattaaagaccagaagaaactcgagggagactgctgtataagtcccagttatctttccaaacagacaggttcatcacagcagtgaaggctagtcttcatctcccttcttgtgggattttctacattaatgtgcagatctgcccttggagaatggggcgtgcatgattgggctgtggtttgctggagtttcatcttactgaagttgcagacactgtgggtttctgtgacaatggtttacactgaaagtagcaaagtcaaggcatggtctggtatcagcatgccagaataaaacacacagacagctttttaaaaggtctgtgtccgtcctatctttagcctctcctggttgtaacttgaagtgactttgttgccgtgtttgttttgaccaggccgggacagtatggagagtatctttagatgtgacttatctgggttgcttagcaacagcatgcttcagattagaatggaagaaagttcctggatgtgaggagatttgaatgataaaagatacttacacctaaaaggagaccaggagggattgtgccctgttcttgctaactgggtgctcgtaactggagacggggtgtacctgttagcggtggttagacgaggtggatacagaatccagaatggtcacattgcagccatagggaacagatagatgcagagaagaggcttcagccctctgagttagggcagtgcatggccttgctctgctgaaatagcccagaggtcccatttgcttggtgacatctctcacttgaatagaaagctggctgtttatcagacactgttttcttaaatggcagctcctccacatctgcgtcatctccattatctcccctatccatctctttttggaaggaatccacgaagccctcatgactgtttgtttgtttttgtttttttgttgtcgttgttgttttttggagataggttctcactctgtcgcccaggctagaatgcagtggcgtaatctcggctcaccgcaacctccacctcccaaactcaagtgattctcctgcttcagcctcctgagtagctgggattacagtcatgtgccaccatgcctagctaatttttttgtatttttggtggagacggggttttgccatgttggccaggctggtcttgaactcctgacctcaagtgatccgccgcctcagcctcccaaagttctgggattacaggcgtgagccattgcatccagcccgccctcatggcttttacacctcttttcctggtttgcagaaagcaaggctggggtgtggaccctgcatcgaagctggttctgcttatgtccatgtgaagtgctttcaagtaaaatgctgatctgcaaaaagatgctgaaagtcctttgtctctttctggctaagttcaaatgccgaatttgattcagcaaatagttgtgagtgccttgaagtgcaaagaatgatccaggatcaggactccttccctacatatcattattttgatatgtatgtatgtatatatgtttagtgacggagtcttgctgtatcacccgggctggtctcaaattcctggcctcaagccatcctccaacctcagcctcctcagtcgttggggttacaggagtgagtttgccaggctctatatcattctttttagcatgacctctgataggaggctggcaggacagttcaggacttatcagaagcccaaatatcttacactgctgattaaagagagacctgtgtttgaaaaccaaacgggcatataataggattaacattctgctatgaacactaaggcatttgcgtagtgcttgtgggagtgataggaagggggtctgaaccgggggagccagggctttctgcaggaagtggtttggggtccttgtcaacagtgaatgctgcttaatggagccagagtgcccccctgcggaggtgggcagagaggtgccagtcaccccaaggtgccacagctctaagctgagatggtcagatagagggaagcaaacaagggccactccctagtcccaccttgtcagcagctcagacgggattccccatctctatctcagccagggagaagccatcgcgagaactggctatgagtgcgacagcttagagatgttgcaatgtctcttcaagttaggagtgaaattattatccattttgccccaaaatggactcttaaacccccatacacttggaatagcatgtattttgtgctttgaagccagaaataaacattctaaacaaagatttaaagttgcaatgaagaggaggtggttgtggacagacatgcagaacaaatgtttgagaaatgttccctttgcttccacagaaaaacaaaagaaaggcattttctcgtgtttgacaaaccatgttaaaaaaatattcttggccaggcacaggggcccagcactttgggaggccaagtgggcagatcgcttgagctcacaagttcgagagcggcctgggcaacatagcaaaactccatctctaaaaaaatacagaaattagccaggcatggtggtgcgcatctgtcatcccagctacttgggaaactgaggtgggaggatggcttgagcccaggaggtggaggttgcagtaagttgagatggtgccactgcattccagccggagtgatagagccagaccttatatcaaaaaaaaaaaaaaaaaaacctttcagtgctattttttgtggtatagttactgttattaaaaagcaaatggcatttctctttttttgtttactgtattcctgaaatagggtcgatttggccagcaaagtattgacactggggcccatcttgaaaacaactaactattgaagaaaataatttcattttataaaatagtagttgggtaattctcccttaggtaccaaaaagggctcttttctggaaaatgttaatgcaacaatatttccctcattcctttggtgttcatgggtgttctattgaatgctgttccattcttatttctttctagaagatagctcattctgactcctgctgtaaactgttcagagattattctttccagagtctgttacattcagaatgtcttgctagtctgtcacttgctgcccttctctttctacttagtttcagattactttgcatctcctctggcctcccgtttttaaccttttcattgatgtatacacacagaaaagtgcactgcttgatgagttgacatggcatgaacataacctgtacatccccaacgccagaagacccatgggcccccttaccaggcaagccctcttctattaagaaaagcgtttttcttgttgtaagcacaagaaaccactaatagtaattatactagggatggggcgcatacaggattcggaatttttgctttgtgttgcacatgaattcttactttactatgaacatgggttgctttgacaaatttaaaacaaaggcctgaaaggactccccttactcaagaaaaggaaaatgccttttttaaatgtttttttgaaatggttgtcttaaaatttctaaatattttttaaaattagattttatatagccacgcaaattgttctttaatggttatgtaggaatacaggctgcttggcctcccttgtccacagcctcctctttgtttctttgcgactttgactctgtgtttagaacatttatttccgggatgagtgcacaaaacaccatgctactccaaggcacagagtttcagagtcagcgctgagtctattttagagcaaaatgggtaacactactcataatttgaaaacacactattaaatacccaagctgttgctaactaaaagcagcctgtgaggttattttaatataaaaatgcaagctgaggccgggcccggtggctcatgcctataatcctagcactttgggaggccgaggtaggtggatcacttgagctctggagttagagaccagcctggccaacatggtgaaaccccgtctctacaaaaaaaaaacaaaaattacctgagtgtagtaacttaatgtctgtactgtcagctacttgcggaggctgaggcaggaggattacttgagcccaggaggtggaggttgcagtgagccaagatcgtgccactgcactccagcctgagtgacagagtgagaccctgtgttaaaaaaaaaaaaaaaaaaaaaatgcaagctggcgcggatgcagtggctgagacctgtaatcccagctacttgggaggctgaggtatgaggatcctttgagtccaggagttggagaccagcctggacaacatagggagacccagtctctacttaaaaaaaaaaaaaaaattcaacctagacttggtggcttgtgcctgtaatcctagctatttgggaggctgaggttgagggatcccttgaaccctaaagttcgagaccagcttgggcaacatagtgagatcctgtctcttagagaaagaaatctatgtgtgtgttcgtcattttgacatacaacatcttcacttttttctgacaatgaaaacaacccaaggttattgcaaaaaaaagatccagtaatacagaaacaagtgatacagaatggaaccgtctgctgcaattgctggggcagattcaggcagaaatttggattacttttattttattttattttattttattttgagacagagtctcactctgttgcccaggctggagtgtagtgatgaagtctcggctcactgcaccctccgcctcctgggttcaaacgattctcctgcctcagcctcccaagtagctgggattacagccaccatgcctggctaatttttgcatttttagtagagatggggtttccccatgttggaactcctgacctcaagtgatctgcctgcctcggcctcccaaagtgctgggattacaggtgtgagccaccacgcccagctagatttatatttgatagttatttgattccagaggatcttaagtgcaaacccagagaagcagagagtaaaaagcaaaaaggcaacaaaacccagcagatggtgagggaaagggaagaagccagggaggggcaagtggggacaggaagtgctctgaaacccgaccctctcttgctgggctttctccttttaaactgaggagctgctgtgtccatctcgcccgctgcttcctaggcggtacagagggtttcctgtagccttaagttttctctccgagaacagacagattcttggttgagccttaaacagggtccagtcttgggtgttagtcaagaatgctgttcaagtaaatacgttttactatcatttgactcccatgtgcccccaaacctggtattatttacaggtagttttgttgttgttttgtttttaaaccaaacaggttgacccattcactcaatctgagttaggaaatatattccaggcacaacctatcaggcggttgcctgcaagatcccagctgaaagcatcgctgggacaaaggtgatgctttggcagccaccctgttggctccgtccagcccacacctcagttgtctcaagctgctctttcagtgggaatgtgagatctggtagcagaggctcatttcaccccaattttctatttcagaaaaaggggccgggtgcagtggctcaagcctgtaatctcagtactttgggagtctgaggcgggtggatcatgaggtcaggagattgagaccatcctggctaacagggtgaaaccccgtctctactaaaaatacaaaaagttagccgaatgtggtggcgggcgcctgtagccccagctactcgggaggctgagacaggagaatggcgtgaacccgggaggcggagcttgcagtgagccgaaattttgccactgcactccagcctgggcgacagagcgagactctgtctcaaaaaaaaaaaaaaaaagaaaagaaaaaaggaaactcatccgaagcaagagaggcagccacggggtcccatcttggcagcacatcttctggtccccggtttagcgttctgtccttctcttgggtcatgttcttgtctctgttcttcctcatcccttcttcgtccttgtcatcgccacttctgacactgactgagtggggccacaaaaggtgagtcgtccttccggctgcccccaccacaatccagccctggctcaagagcagggaaggtgctgtcccccaggctgcagacgggggttagtacagcaacctcagacagcttcctctctggggggaccctgcgtgtcttgggtgcagtttcgaggaggatgcagagggatggatccctgccttcttctgtgtgacccctgcggtgggggagcatccctgctcagcccaggggatggcacttttcatgtttgccgtgagattcctctagcaaaagcagtgggttttgtgagtacttaggtaatggtgccagaaagcaccatgacaccctggtatgtccgccccatataatcagagaatctgactctgctcactgctgagaccccgatacccagggtagggcctgaattttcaatgcaattgcgataaattaatgactaaatggattctcagtttgaaatgtaaggcgtgacagaacgttcaacccagggaagattgagtcaggacccgggaccttgccggaacacctgtggccgttgctgctgttaactgaggtgtaattaacatgcagccaagtgcacagcttcacccagcagatccgtacgttttgacaactgtgaaacaagacgtagcacatcgccatcgcgcttctcagctccgccttcaccactctgggtgccagcaccggcaatttgtttggccagttccagagtgtcataaaaacagaatcctccattgtcactcctctgtccttgaagagatatgcatcgagttgtatgcggccactctgcgggctcccctcggcacatgatggtcttcagagagaggctgtttggaaatagagtggtgggtgtttgcttcttgtcacccggcaaatgattcatttttctgctgctctgacactttggaagaagccagggatgctgaggagatggcttgctctcacgtgggcagctgctcctttgagaaacaagccatgcgcagtgttagctgctgacatcctccacttttagcccttgagcccatttcactgatgagcaagacagtggcctgtatctgtcactaacgtgcttttctttttctcccctgttccccaaagacaggagtgtggagttcatgagtgttggatttttcaagctagtaaaccttgcagctgcaagtggtgtttaattcttgtggtatggatgagcacatgctaatctcccttgagcttctcttgagcagaagcctggtgtgctaacgggcaggactggggtggtgctttgagaggaagagggggaaggtggcccgagagggagatctactgagatgtgagctgcctggagtttggggtggggattcctggaggggctctggattttgcagagggacagctgttggtgcaccttcaccagtgtgctgggacagaaagtggggtgagtgggtgagtgaggaataagtgtttgaagggcaggagtaaagcagaaaggtggcagcaggtgttgagctgcaagtggttccattgcctggaaaggaggtggcagggaggcctgcccaagatgggtgcctgcagggtgcggacagcctgtcagaggtgcggaaagcctgacattgaaaatgtcagacagtgggtgcttgggccagagagaaagagcctgaggagctggaccaggggttggggggcggcctttagaagcagcgtctcatgcagccttcccagcgatcctgaggtaggtgggagaatcttcaggccacggctgagaagctgaagcgtgtggcgggagatccgtctcagaacacctgagatccctgcagggtctgggagcatgttaggggctcagagtgcaggtagggactggcagggaggagctgtgggcgggaagagagagaagggagggcagggcagtgtggccatggccagctgaacactgggagtctgctcctgaggtcatggatggaggccaggacacctctcaagccattaagagggtggcctttccaagcgcagcatgacttgttggtcttgaagcagtgccttcgaaggaggaggagtcccccgtggacttggggcattaggacagggactgccaaggagagagggcactaggaaacagggttgtttttggcttttttacctggggtgcaagtggagcaccctgtgggcatcatgagggtgtcaggaaacccttctggtaactgaaacgcagtccattctgtgtcccccagattctgagttttcagcacctgacagtggcgggggatggcagacacacctgtgggtgctggagacatcttggcggcccttcctccagtttggcatcatagtcccctgtgggctgagcacatggggctcctggacagttgttaccgatggagggtatccaggttcttgacatcttgaacaaagaattggacaaaacggcacaaacaaagcaagaaaaagatgaagcaacaaaagcagatttattgaaaacgaaagtacactccatagggtgggagcaggccctggttacagaattttctggggtttaaataccctctagaggtttcccattggttatttggtgcatgccctatgtaaatgaaagtgacctgcgatcagtctgattggttgaggaaagcagccaaccagaggctgaagtgaagttacaaagttacatcctatgcaaatatctgattcattgtggaaagcaaccaatcagaggctgaagtgaaattacaaagttgcactcctatataaatgaagacttggccggagaccagcttgattggttgcaggaggggaccaatcagaggtactttcagttcttgatctgcttggtagaaaagcaggtcggtgtgaagggagtagcctctggttcttttgttacttggggatggaaagttggggttttcctttggatttagttctaagaagtcagcatgaattggccttaggttccctgcctccagaccctattctcctgcctcacagtgatgttgatcagggggctcagcttggctctgccagttcagacaccagccccttccagctactgccagtccttggaggaaagcagtcttggtaccgtgtccggagaggtcatttccatgtaaaagaaatatgaggtctacaggcagctcaggagcacggagttgggggaagcagagaaggtgtgagtgccgaggcgcaagcacggcttttgtttgggtcaagcaggatcagtgcctccctccttgcatcgctccacctccggaaggcggagaactgcgatgcagacccaggaggccagccaggagagatttctcaccccaggctcgagcctttgaagctccaggttctaacttaaaaattcaagggagtggccgggctcggtagctcatgcctgtaatcccagcactttgggaggccaaggcaggtggatcacgaggttagggatcgagaccatcctggccaacattggcctgacaaggccaacaaccttgtctctactacaaatacaaaaattacctggttgtggtggcacatgcctgtaatcccagctacttaggaggctgcggcgtgagaatcgcttgaactcgggaggcagaagttgcagtgagccaagatcttgccactgcactccagcctgggcaacagagccagacaacatctcaaaaaaaaaaaaaaaaattcaagagagtttcgcattctcccgtgcaatacttccctgcttgttgtagtagagatgcgtcctgtgcctttttaggaacatgttctgaaagatggcttgggcaactgtgactttagtgctctatccccccagcactgccctggtacccatcctgtttagagggctcagagcagagagcacctgcctggcagggcccgtctctgactttgccttgctgctcctcccagcactgccctggtacccgtcctgtttagagggctcagagcagagagcacctgcctggcagggcctgtctctgactttgccttgctgctccccccagcactgccctggtacccatcctgtttggagggctcagagcagagagcacctgcctggcggggcctgtctctgactttgccttgctgctccgcacagcactgccctggtacccatcctgtttggagggctcagagcagagagcacctgcctggtggggcctgtctctgactttgccttgctgctccgcactgcactgccctggtacccgtcctgtttggagggctcagagcagagagcacctgcctggcggggcctgtctctgactttgccttgctgctccctgttatcagcactcttgtccctgtgtcctccgggtggcctgcagggcaatggaagatgagtacttagtagaaggttctaggtgggcacatgagggttccttgccagcaccagggctttgttcacacaggtgttgcatgaagccatccagccaagagccagggctccatgcctctgagccctcaggcactgcatcatgctgggcctcagctccatacctgccgcgtgtctgtctcaccatcactgtgctcaaggaaggtcgccaccagatgctcctctgtgcgccgggcctgctggggctgccctggggcctggaaagtgctttaagcaggtcctttgtctcgtgtcaggggatgggctccaaagttagtggttggaactaactttgccatctgctggagggctttgcccctgccatgccttgagcccacacatactccaggggtgactgacacagttggttttgcatcagaattggccattgccacctctgaggggctgggaaatgggtgaccctgccccacagtgcctgcactgcccccagcagacaatgctgggggagcagcttcccaccaggcctggcttggggcttctccagggaagcccaggtacacctcccagcctgtaggtgaaggtgcctggaatggaactcgctattcccagaggcacagagctcccgtcacagcggctgggtgacagcagtaattctcgcagatgttcaggccctgggaccccagaagtgaaatgacccagggcgtcagcaggaaaggaggccccactttttcaggacctctccctccaaccagctccacgtccttcccaaagctgggcccagcgtggccctcatagccagctccgtctctctctccttgggcctgctgtgactgcaggcacggatacactggggagacgggatgtagaaagctgtgggaagagggagcaacggcagggcaggggccagtggggttggggggggccgctggccctgcctttggatcatctccgacttgatcagcatgaacccctgactctagagggaggctgatgggccagggcacatgtgggtccccctcactgcctccgcagcagtggacctacagccatgctctttgaccccatctcttcctttcatgggcacacaggtgacccgagtctctgtttcgtgcaccttcctgcctcttctctgcccctcagttgggctgagacacatgaggtgctgtgatgcatgctgcatttggccctgacttaggtgtgacgcgtttccatttttaaatcgagtgtaaagaactggcctccagaaacacggaagcacttttagtagggatttgaaaatccgcagatcgttgtgtatctcagagcccagtgtttttcttgaaattcacactggaaacaaatgaggatactgggggaaatgtgcagtcccaggacatgagagatgcgagcttattacgaatctgtctttggtaccaagccacaatatagagatttgtgaaaatctttaaaaatcaacttgactgggccgggcgcggtgctcacacctgtaatcccagcgctttgggagggcaaggcaggcggatcatgaggtcaggagatcgagaccatcctggctaacaaggtgaaaccccatctctactaaaaataccaaaaaaattagccaggtgtggtagcaggcccctgtggtctcagctactcgggaggctgaggcaggagaatggcgtgaacccgggaggcggagcttgcagtgaaccgagatcgcgccagtgcactccagccttggggggcagagcaagactccatctcaaaaaataataataataaaaagatctggaacgttttcgtcccctcaggaagtcatccctgccccaggcatccacggaggtcaaggccttgccaaccccacttcctgggtccagctctcaggtggttctccctgtggcctccagacccgggctgtaccggctggtttcgcaggttgcctgtgctcatcctgccctctccggtgagagctgagccggtggtgtttttttcagagccagctggccctgcaggagctcagaaacctgggcggctgggcctatgggctctggagttctgcccagggtggccaggtgggcagcctttcccccgtgctggttcctgtagcaaggaggaggccgtgtgctggggcccttgtgtcaggagctgtctctggaaaggctgaatcgaggaaccagcctctgccttgtccgtcgatgttgtggggttagtggctttgtcccagagtttcaaagtgtgggtaagtggtttctgggtttgccagttttcttagcccttaggggaaagggggtgggagcctgccctcagctggcttcgtaaaaacacagtatctgtgcttgagttacacgcccggcgtccttttgcgttttgagacctcagtggagtgtgcgggccctgagtagtatgcacccactgacagtgaaccagatgctgcccccctgcggttccagtgtatgtcagtgccagccacgtgcccaggacccaccgttcccagggatacaagatcccgtggcccatggtggcagctgcggcacacagcgctgctttccagagctctcagtgcggacaacagaggccttgcattcagtcacctggaaaacccaccatccacattggaaacccagtctctccggaatgagaaatttggttggttttctttagctttttgtttttttgtttgttttgtttattttttgagacagaatctcactctatcgcccacgctggagtgcagtggcacaatcttggctcactgcaaccttggctcactgcaacctctgccgcccaagttcaagcaattctgttgcctcagcctcctaagtaactgggattacaggtgcctgccactgcgcccagctaatttttttgtatttttagtagagacagggtttcaccatcttggccaggctggtcttgaactcctgacctcatgatcggcctgccttggcctcccaaagtgctgggattacaggcatgagccaccgctcctggccctggttggttttaattaagaacattttcaaacatccacgtggcatacccgttatccagatctaacgcccattaatattttgccacttttttgctccaactaaattaaactaaattctggaacattctgtcattttgcccctgcatattccactgtgcatctgttaatataaaatatggactttttgtacataaccacaagactcttctcacacctgacaagattaacaccttcatctgttcttttagaggttttgttcctttgtgtgttctttgtcatctgttttgttttgttttgttttgtttcgtttcatttcgtttttgagtcagaatctcaccacgtcacccaggctggaatgcaatgacaccatctcagctcactgcaacctctgccacccgggttcaagcgattcttgaacctcagcctcctgagtggctgggatgacaggcacaccaccacgcctggctaatgtttgtatttttagtagagatggggtgtgttagtccattttcatgctgctgataaagacacaccagagactgggtaatttataaaggaaccaggtttaatggactcacggttgtacatggctggggaggcctcacaatcatggcagaaggcaaaagtcacgtcttacatggtggcaggcaagagagaatgagagccaagcaaaaagggaaaccccttataaaaccatcaggtctcgtgggacttattcactaccacaagaacagtatgggcgaaactgctcccatgactcagttatctcccaccaggtccctcccagaacatgtgggaattttgggagctacaattcaagatgagatttggggagggacagagccaaaccatatcatagtgtttcaccatgttggtcaggctggtctcaaactcctgacctcaagcagtccacctgcctggacctcccaaagtgctaggattacaggtgcgagccaccatgcttggccccagctttttgttgttgttgttgttgttgttgttgttgttgttgttgttttttgagatggagtcttgcactgttgcccagcctggagtgcagtggtgcgatcttggctcactgcaacctctgcttcttgggttcaagtgattcttccacctcagcctcctgagtagccgggattataggcacctgccatcatgcctggctaatttttatatttttgtagagacagggttttatcatgttggccaggctggtcttgaactactgacctcaggtgatccaccagccttggccttccaaagtgctcatattacaggcatgagccaccattcccggcctatttttaaagggtctggagtcaacagtgcatggatccagaaccgtgggaacaaaggggtgggcacaagggcggggtggggggtgtgagtttagagaggcttctccctataaagctgagcatgaactacttggcacacctgacgttgaaccaggagctgagaaccacacaagttaggagtcagagcagagctgctcaggacgtcagtgctggccctgtcccaggtcaaggggataccccgggaagtggctggactgagccaagtatcagctagtagtgggtgctcaaggctggtgtagaggggcaccgcctccctgccagcactgtcctgacacttggaccccatcagctcgttccagcagagaaccaccctggggaggggcctagctatctccactccgcagagaaggctccaggaatctgattaactaaggctgagccagcagagagaccagattcagcgtctaaattcctccccttgtcaggaaagggaaggttgtgcagaaacctggacagtggacgccgcgggcacttcccacccatggcagcaggagggcgggagctcagagaggctgggctcgccctgccagtggagtggggactgccagataaaagacgaggtctttcctgggcagtgagtgagtcctgggggcccaggggcttgcctccacaccttgcacctgcccccagcagctttcagctgcggatttcacggcctttcctgattgttgtttgactccgtcatttctgttggtgattccaaaatggtgactttctaattcagtcattatttctacttttattagctggcattcttctgtaaagaactttcctcaacgctgagatgaactacgcagttcctcctaaaaaaggaggatgaatgcagcatcttttcccatttatttatgggtttgtttatttatttatttttagagacagggtcttgctatgttgcccaggctgatctcaaactcctgggttcaggcgatcctcccacctcagccttccaaagtgctgggattacaggcatgagccaccacacccagccttccatcctttccttttttttttttttgagatggagtctcactctgttgcccaggctggagtgcagtggcgcagtcttggctcactgcagcctccacctcccgggttcaagcgattctcctgcctcagcctccacagtaactgggattacagttgcccgccaccaagcctggttaatttttgtattttttgtagagacagggttttgccatgttggccaggctggtcctgaactcctgacctcaggcagtccacccaccttggcctcgcaaagtgctgggattacaggcgtgagccatcacaccaggccccatcctttccttttaacgactaatttccaacttaaagaaccaaggcttctgttttccccttctcggtgcccagcacttggccggccagccttcctccctccattcctctcttcctttctatacaaacttccttgttaaataaaacaggggggctgctcctcccgcccctggattggatgcactttcctgatttaaaggagtccttggccactcgtgaccccgacttgaactgtggtgtcccccaaagtctctttctttccgcccaggagtgttcacttgctgggcggggaggagaaattggggtgtgacccactcagcacaaacccacgccctggtcataaagccgcaccatttcccctgcaaatccagccgttcactgccccggccaccgggctgctttgaagggggatgaggcatgggggctgctgaacccacaactgtcactggcagccactggctggagttgagagaagtcaggctggctggggccgttgaccctcggaaggaccactgtcataagatgtgagaccagtcaggggcagctcagatggggagagaggctggccagggcttccttcagctggggctgagcagtggagggcctggttccccatcctgcctgccctcctgggcctgggtcttcccagcgatgggggcgactgcagcgcctcttgggagggcgatcgtgagaggcagaggcctctgagtgctggctgaggggtgtccacccgtgggacatgctccgtgctcttctgtctcgcctgcctcacaagctgagcatgaggaagaccaggctgtgaggtgacgcgtcccccccacccttccccacaggtgtgaatgacagaggtggtgccatccagcgcgctcagcgaggtcagcctgcgcctcctctgccacgatgacatagacactgtgaagcacctgtgtggcgactggttccccatcgagtaagtggagcggattgcagggttggggagagcccgtgagcctcaggtgcagaagctgggcggcgggggtgggggcctcttgggcccttaggaccgtgctgcaaagatgggaatggcctggaggggccacaggggtcccaggttacccacctcatctagggacccctgctgctgggctctttccacctctcagggtgtgcagagttccccagaagggctctgtgagaaatttcagttacagagctatcgggtgtggtgctatttataattcagaaaatttagaagccactcaagtatcttcacagcaaggagttggttacatgcattagagtaattagagtatgtgcatataaaagtgcaatattattcagccgggaaaaaaaaacctgtcaaagagttatattttttgatagagaaatcttttttacaagatattaaaggagcctgtaatcccagcagtttgggaggccaaggagggcagatcacctgaggtcaggagttcaagaccagcctgaccaacatggagaaaccccgtctctactaaaaatacaaaattagccaggtgtggtggtgcgtgcctgtaatcctagctacttgggagactgaggcaggagaatcacttgaacccaggcggtggaggttgcggtgagccgagattgcgccattgcactccagcctgggcaacaagagcgatattccgtttcaaaaaaaagaaagaaagatattaaaggaaaaaagtcagtctagaaaatagtatgtaccacgatcctatttttatttgaaaacatgtacaagataaaattttataatgataggtatgaactgagcgggggtgaaaaaaattttacaagggggtatgtaccatttaacagtgtttcagtatttgaggtgggtagattaatattaggccctatgattgtttcttcttgtctgtcttgcctacaatatatgcacatacagcttttttgatgaaaaaagttgacacaaactttgaaaatggaaaataaacaagatcttgccagccaccagcatttccttgagtgttcacctcagactgactgaacctcatgctcttggcagggcggtggcagggacccctgtgcgtctttgtggaagcgggaactgtcacagtccaggtgatgtgggctggcggtggcaacatgagttaaaaaactgttcttggctgggcgcagtggctcacgcctgtaatcccagcactttgggaggccaaggtgggtggatcacctgaggtcaggagttcgagaccagcctggccaacatggtgaaacctcatctctattaaaaatacaaaaattgggccgggcgcagtggctcacgcctgtaatcccagcactttgggaggccaaggcaggcctgaggtcaggagttcgagaccagcctggccaacatggtgaaacctcatctctattaaaaatacaaaaattgggccgggcgcagtggctcacgcctgtaatcccagcactttgggaggccgaggcgggtggatcacgaagtcaggagttcaagaccagcctgtccaaggtggtgaaaccccgtctctactaaaaatacaaaaaaattatctgggcatggtgcaggcacctgtaatcccagctactcgggaggctgaggcaggagaatcgcttgaacccaggtggcagaagttgcagtgagccaagattgtggcactgcaccccaacctgagcgacagtgagactctgtctcaaaataataataataataataataataaataggcctggtggcacgcacctgtaaccccagctactcgggaggctgaggcaggagaatcacttgaacccgcgagtcagaggttgcagtgagctgagatcacaacactgaactccagtctgggtgacagagtgagactccatctcaaaataaaaataaaaacgtgttcttcagcccagcaatttaactgctggaaactaatctagagaaataaaagctgcagtgagtgcatagatcagactctgcccagggttgcctgagagccagtggagccacgctggaccgtgggccttggccatgtgagccacccagcctgcctgtctctcctgcagttctcgtgggcctaaggtctcaggttcccaagactgtgacatgaaccgggctgtgaggcagcaaaactaaccctacacaccctagaaactccatgtgcctctgtcctcctgaccttgtctctctggggctggggctggattcgcctgttaatgaccatgtcctgggcctttatgcccactgttttttttgcctgctccgctcagaggggtcttggcctcattgttgatgagcagccgttagcagcctcagcctcacattccccttaagggcgggttcctccctgtcagggaaggcattgtaaactcaaacgcctgtcagctgtgaacctggctcttcctggaatcactccactcccctagtcttcagtgtccagaagtctcacagattctcgtaggcactcctccagtgtccaagggtgagaagggccctaaaatcttcactcacctggtggaggaacagggccctgctgctgactctccatgagttgcttccatggagacagtttcatgtcggataaaattatttttcccgggccaggcgcggtggctcacacctgtaatcccagtactttgggaggccaagacgggcagatcacatgaggtcaggagtttgagaccagcctgaccaacatggagaaaccccatctctacttaaaaaaaaatacaaaattagccgggcgtggtggcacatacctgtaatcccagctactcgggagaccgaagcaggagaatcgattgaacccaggaggcaacggttgcagtgagccgagatcacgccattgcactccagcctgggcaacaagagcaaaactccgtctcaaaagaaaaaaattcccatcagagatccccagtcctgtctagacagatcactgctttaagaaggtggctgtgacagttaggtagagacttaagtgatgggcacactcctcggcagccttagagcagcaggcagaagtggcccagagctccctgtggttctgatgtctagagcacgaccatagttggacttgacctgtggcaggttcacctgagtatgttctgtttctcaggtacccagactcatggtatcgtgatatcacatccaacaagaagttcttttcccttgctgcaacctacagaggtgccattgtgggaatgatagtagctgaaattaagaacaggaccaaaatacataaagaggtacgtacgtgtgtgcagtgaggacttggcagtcactgtcattggacgggccaagggggcttgcgatggaatcatgctgcctgctccacagccgtcgtccaaggagcctgtgacccaaggaatccaagtggccaacgacacttgtccctggctggtgcttttctgtgtgtgtgtgtgtgtgatttcatggtgcgtgggcctccagtcgtgcccagcagcaggcttcataaccactgtcgttctgaagcaggcatgagcgcagatgatgcattgagaatctgcagttacaacgtgctatgaaaatacccctgatttgtgttggcggcagtgtcatagaaaccgctaagactgcttcagcttgttgaaggaaatgctagttacagttagaggtcagggaaagtacagagataattttttttcctctaacttcacagagccctttaagatctaagaaccctttgggcatccgtggacccacctcagtctcacttcaggctagcaaaccccagtctgaatgtaaacagtaagaccatggccatattgttccaaatggttgagtttagtcaagattctgtgtgatgatgttggtcatcccagcatctgaggtaatgtttaccacccgaggatttagccaaggagggaaaaacccaccaacaactggcagatggttcaatttgtttggcttgaggttatttctttaaaagttagagaaggggccgggcgcagtggctcatgcctgtaatctcagcactttgggaggccgaggcgggcagatcatctgaggtcaggagttcaagaccagcctggccaacatggtgaaaccccatctctactaaaaatacaaaaattagccgggcgtggtggcaggcgcctataatcccagctatttgggaggctgaggcaggagaatcgcttgaacccacgaggcagaggttgcagtgagccgagatcgtgccattgcactccagcccgagggacaaaagcaagacttcgtctaaaaaaaaaaaaaaagaagaagaagaaaagttagagaaggcctgggcacagtggctcacacctataaccccggcattttgggcagatcacgaggtcaggagttcgagaccagcctggccaacatcgtgaaaccttgtctctactaaaagtaaaaaataaattagccaggcatgatggcgcttgcctttaatcccagctactcaggaggctgaggcacaagaatcacttgaacccaggaggcagtggaggttgcagtgagcggagattgcacttttgcactccagcctgggtgacagagtgagactctgtctataaataagtaaataaaagtgcaagaaggcctgtctctccctttaaggacccgaatccactggcatctaccctgttttgcctgtggtcatactctgtctggcacagcttttttctcctgagtcactttttctgccctagcttcctcctgagcttttttctttgatttttaagagctaagatgtagcagaaagcaagtgtcaacattcttttctctcctcttttttttttattgaaacggagtctcactatcacccagggtggagtgcagtgatgcgatcctgatcccggctcactgcaacctccgcctctcaagtaggattttagacgtgcgccaccacaccaagctaatttttgtatttttagtggagatggggtttcaccatgttggccatgctgatctggaatccctggcctcaagtgatccgcctgcctcgcgggagtgctaggattacaggtgtgagccaccgtgcccagcctgatctctcttgttaatgggacacgtggtcccccccttcccccaatgactcattcccctgaaccccatccccctccgggtggctttcctgagtgccccctggtgactgtgtgcctgcccccaggtggcggctgggtctcttcctcctctggaatgtgtttgtgttccctcgaggccgacatggggaccctttggctcatgttcccggctctcagtagagggccctctggcctgcacgctggcactcattcatctggccccttcctctcaggcttagtgagttcaaggtcagggcaaagtagaccctgttaagagatgtcagctggggaacagacacccttcctgcaggcctggagtaacaagagtgataaggacgccttcctccctggactgacatatctgggtgaactgtggcttgaagagggctgggagagcagggagcctggacaggctgaccccagcccagcacgtgggagcagaaaggccttcttgttctttacgagttggaagatgataagagcctcatgctgatcagattcatgactcccacccggaattccatctctagaaccaagagatggtgggtggctttacgcaggtgtggcggtgtcctctgcctgtgggggcagcagaaggggttggacggccgcccaagtctcactcctccaagatcacctggggcagcgtgcgattctttaactgaacctctaaaactttgcatttgtccactgtcctgcatccaggcctaccaggtgacatgcgtgcattcccatgaggcccgcgtggtgctgtgtagttgctgccttcatgccataactttaccttgtgctggcatcagagcctcattcccgtccttggctaggcctcccacacacccctaggagaagctccttttgtgtgtgttcttcttttcagctgtttttcaccagaagggcataaacgctctcatttccttggggagtgggggcccctctccagtacctcttgattctgcccctcccagtcggtgtccctctggctgtcgtgggaagtcggtgcggagcccgcctgggccgggctgtgcagtgagccgtgcaccagacgtgtgagcctgactttctctctgactcttcctctaggatggagatattctagcatccaacttctctgttgacacacaagtcgcgtacatcctaagtctgggcgtcgtgaaagagttcaggaagcacggcataggtaagggcagccgggcccgcggcttggcgcccaccccacccccttgccctaccccacccccatcccatctgcacccagtctcttccctggccccaacaactctggctcgtgaacatccctcagtctcatcttccatcctcgttcccgtcttgggccagaccttcatcatccctcccctgccagcacacccaccaccttcagccatcctctttccacatgcccccaggcctttctgctgcagcctcgctcagcccccaggatggagctgaggaaactggcacctctcacttctgctgccgccacacgcacaactcgtgtattcactgctcacgattcagagtagaaagcgtgaacacgcacgaggaagcaacactcaccgtttctccgatgtcccaccccactcggccacacggccagtgagcggcagagtcttaattaattttaaacccaggcccatctagtccatgttttcctgggctcacatttaccctgtttgttgtctgaaagggagtctccatgcgggcccagcccatgggagggcgctaccaggccacctctgcagtccctcccagcagtctgtagctaccaggctccatctggccatgagattttagggactttgacagtggtggtgaagaaaggctggtctctgatacggtgggccgagacatctccgagagactcatgcaaagcccccatcctagcccagtcatccttccttcctaactgctctgcctgcattacctttacctcttctccccaaggttccctcttacttgaaagtttaaaggatcacatatcaaccaccgcccaggaccactgcaaagccatttacctgcatgtcctcaccaccaacaacacagcaataaacttctatgaaaacagagacttcaagcagcaccactatctcccctattactactccattcgaggggtcctcaaagatggcttcacctatgtcctctacatcaacggcggccaccctccctggacgattttatatccttaacttctgggggagagggactgtggcttcctgtccataaggtggcagagccagtgagcaagttggagctgtggtccccctcagatgatgttcaggtggccaagcttatggatgcttctctcccttacctgatcgtgttgtgggtaaacctgacacacatttgggtaaatcgagttgcacatattaccatgttgcccaggctggtctcgaactcctaagctcaaatgatccgcctgccgcagcctcccaaattactgggattataggcatgagccctgcacccagctggagagcctcctgctccacttgcactggggatcagcagtgcacaaaacggacaggatcccctgtcctcccagagcctgtgctagcagaggggaaacaagtgcggagagaagagatttttactttttttgaatacttgggttcaaaccttccttataggatgcatgacccaaaggtatgcccttccctgcttcttcctccttaactttcactggcccctgacaggtcagagggaagccaggaaactttataatagtcagaatgtggcccaaaaaaatgctgtgcgtgtgtgtgtgtgttttcaaattcatgagtctaggatttattcattacatagaataataagcaggaaagagaggggtgaccccacactccacaggccgtctagcttatgtgaagacaggcatccagggggtcagcactgttgaccccctccttgtcatatggacagggctctgtccctcttgctgccacaaaggttgagaatctagggagaaccagaagcacctgcccttctgccaggccccttccccaccccccgtgcatccctgggtgtggtgtccacatgcctgctgcctcactcagaaggcccttctgtccccagaccccaccctctgttgttttgcacagcagaggccacttcgtctcatgagcctttccagctctgcagaggcttagcgggctctcagcctccgaagcctggcttgccatctgcacacagtcccacaggccactgcgcgggcccctgatgactgtgccctggcgagcgtggtcagggcaagtcggaatcttccttaacagagccccacggactacatccagcacctgggctctgcactagccagcctgagcccctgctccattccgcacagagtctaccgccaggcccacagcctgctctgcagcttcctgccatggtcgggcatctcttccaagagtggcatcgagtacagccggaccatgtgatgtcggctgggcagccgccaccaggccccacccttcggccgcccgcagagcccgccttcctgtccatctgaccccttctgttttctgcaaggagctgccagccatctaactgggctcgtcggcctgccccagctgcaggcccggtgctacacgggctcgggaacagaacatcgtgggcatgcgcagagcatgcccatccgtggcaggtacgccacagcagacacaaaggtatgggagcttggtgcctccagccacaaaagtggaaggccctggatgggcacagagaacggcagagccggaaggggccgtggggactgcagagtccaccaccttatgcaccagcacagcccagaggtttggtgacttgtgccaagctaacacagcaggctccatggcaactgggctgtgcacccgactttggatccatcagtgcctttatttgtgtggggaccgagaggcgcctagtggctgcaggcagacaccatggcctggagaagggctcatgctcctggagcacccaggcccagctgtgtggcccataggcagggtgtggggtgggcagagtgtctccgccgggccttcaccctgccctgctcttctctttcccacaggctcttcagctcccctccctgcttctggaaacctctgcctgctgccctggccctgcccccctgcgcatgcaccgtccccagggctgacccagtgtggctgcattcactgggaggggcctgccctcactgggcctctcccactccgctgcctgttcttgcagctccttcctggaaagctggaggggactttctcctgcaagggaggaacgcaagtattatggacacacttgaccgtaaaggcacaggagcctcggaacaagggggcgcaataaagggaatggcccgtccccttccagaaccagcccaaagaagcctggggggtgaggagtggcccccactcctccatgaggggctgatgaggggtgggcagcctgggggaggctttcctcgcaagcacagagctctgaggctcagccccctggcacaggcggtcacgcatcaggacggttcctactcctcagcaccttccgtgcagttaccagtgccctgggaggtcacactgcccgtcggaccttggcatgctccattcagctgacctgctgaggacaggcatcgccgagactccttgggtcctccccgccctccctcatgctgccacaagctgctgctccaaggcctggccacatgcagacaggaggaagctgagctcgacattaggcctcaaggctgccatctgtcttgtagggcctggccttgtgggcagggggcagtcctgtgccttgtgggccctcagcctctgagggcagagatgctgtcagtgccgcaggtgcatcacatacttctagcatcctctccaccctgcattccaaatgctgcttgctgcctgccctgccctccgatgcaggggtggggtggggggcggagtcccgcccagcatagctgcagtgtcacaaagccatggcagagggtcctagcggcgccaccctgccccagcctgaggaggagggagagggaggaacaaccctgggcagacggggcctcagggacctgtgtccttccgcctccagagctgcccagccacgggctctcagggtgctggggcagccccaggtcccctcttgaactcagctggggccaggggccctcagaatgaaggcaggcaccaggcaggagcagcatccccctccttgacggtgctggcaggagggccgcgccatgctgactgcttgaacctctgctgacctgacagtgctggcgggagggccgcaccatgctgactgcctgaatctctgctgaggctgcctgcctgccgggcccagctcagcgccctctccactgcgaatcagtggcgatcatgtgatttctatttctgccccacagggtaagggacgagtcttctggaaggctctgccatggacatttgtcctcgggctcagaggccccaccctgccccacacctgcccctgatcactgcagtgtccagcccagtgttgaacagattgtagcgttctgtctcattacgagcaaataaatagactttcattggagttcgtcaca

SEQ ID NO: 1685 - DNA, 28973 bp, Homo sapiens; identical to SEQ ID NO: 1683

SEQ ID NO: 1686 - DNA, 2813 bp, Homo sapiens
atggtgaaatgctgcattattatttatggtgttgaataatcacagcacaatcattgcaggccacagggcagaaagtgctaatgtagtttaaaaacagtacatttgaatctggacactggcaagaaaataggcaaaataaatacttttgtccacccctccctaccctcttttggtgacttggggtggcctgggtcggtgctcagcccagggtcccgcggccagagccaaccatggcgcgcctggtctcctccagataaacgcgcgcccacgtctctgctgggctttggaattagctcaatactcattcagacgcagagtgcgtgtgccctgccaggacagacgtcattgctgtgcggtgcttgagtgccatcaataagccacagaagagaaatccggaaacaagggacgcgcagcgtgattccgtgccacggcgtcaggagcggcatgtagcatcttttggtttgagagtaaaattccgcaatcagaaatgaaatccgagcaaagaagcaaagcgcacagaggctggagacgctaaagcatccaggcaggactccgccaggtgggcaggcagaggcctgtgcacaggcagacggtgtgcccgtgagcaggacatgcttgtagggtcacaggtcacccacccgcaggacacgcatgcaaggtcacgggtcagccaccagcaggacacgcatgcagggtcacgggtcagccacccacaggacacgcatgcagggtcacgggtcagccacccgcaggacacgcatgcagggtcacgggtcagccacccgcaggacacgcatgcagggtcacgggtcagccacccgcaggacacgcatgcagggtcaggggtcagccacccgcaggacacgcatgcagggtcacgggtcagccaccagcaggacacgcatgcagggtcacgggtcagccaccagcaggacacgcatgcagggtcacgggtcagccacccgcaggacacgcatgcagggtcacgggtcagccaccagcaggacatgcacacccatgtgtgcacatgggtaggtgtgctcgacccacacatgttgtgccatcaccccatccttgtccttggagaaagggctattggccatcgtgacggggagcctctcagctgcgactgggccctgggagccatggagtcttctggccgcctctcctggccaccaaccaggaaccccaggccccaggcccacggttgcatctgctgtgccatcctgtggacaaacggacgatccaatccagatggcactgcaggggactgaacggggctctgaaacccggccggagctgccctcaggccaccctcctcaccttgagccattcccctgctccgtcacctgtgtcaggcctgggtgccgccaggaggcctccttccagctctctgcaagctggccccgtgttcacgggcatccagcgggatccaccatggaaagacagctttctcagaggcatctcagcacgtgggcccagccagaacctcgagggcttctgtccctggagggcagggcagagcgggaggacacagggacacagagaaggtatcagctggcgagggcagggcagagcaggaggacacggggacacagagaagatggcagctggctgagggcagggcagagcaggaggacacagggacacagagaaggtggcagctgactcggcgggagcggaaggtgctgctttcttcgaggtccccctctttgcggctcacccttctccctctatggcccccttaaccccaacccccctcggctgcctctctgagtaaaggacaggccagcgccgagcaggtatgtcccctgccagggtcccccgcacacctggatcttctaggctggggagtagtggaaggatctgcggggctctcgaagccgtctgggaggaacgtcaatgaccagaggaaggaacaagggtttcgggtgggattggccaattccctgggtcatctcagaaccacgagcttgtcttcctgggttacagggtcctgagcttggccgaaaagggacaaacgaagggccgggtgtgatgaccctgcataggtttgacagccctgtgtccttccaaatcaagtgagtgggtctgggtccccggccccctccagcctggggtccaagcctccctggtctcctcgggcagtcagcctctctgctccagtgccgtcagttgtcacctacgtgggtaaaacgccaggagaggctggatccccagctcaccggcctgtggcccgggcatcctgggcttgcagagggagggccgagggtggtaactaggaggagtggctctgagccggggagggaacacggccagagggggatgaaggccacacggagcaccgcgggagccccgccgtctgcgcagggttcagcctttcagcctcgatgtgggaagtctctccatctgttcaggttttctttgggtctttttaccagccatgtttcgcagtttgcagcgtacaagtctcacacttcctttgcgaaattattcctaagtagcttattctttctgatgctatttgaccaggacgctttctgcatttcatcttggggtgttcactgtcagtgcagaaatatcctacgccccatgatcttgttaaactccttcgatcatcttatcaggttttacttcattttattttatctttgtagattccttaggcgattccacctacggcgtgaggcgtacttctacatcttttttgctaatctcggtgatttgagttccatgttcttgcctcactgccctggctggaacccgctgtgcagtgtgggaggagcgggaggggagggtccccttgacttgct

SEQ ID NO: 1687 - DNA, 1318 bp, Homo sapiens
atatctttgagcaatttattcgttatgaacacatgtaatctgttggaacaaagttctaggacaatccaggtcatccttcaatatttgcagaaaacatcacaaagaaaacttgatacttatacttagttggaaactttatgccacagccattaaatacagagatcatacaaaggaatagaggaagctgttgaatactaaactaactcaaatcatcaatatccttacggagtgcacactgaattaatgtaaaaagcatttagtaaacaaaaagtattttcaatatacaattaagactgaaaagtattgaggcctcataagctgaacctgacacaataaatttaaaagggaaactaatttggaaatcagaaaaccactaaggaatttgggaattaggcttctgctgccctctctgctactgacggtcaaggcctcctcattgtattctgtcctccatatctctgctgattcccattttgtctatttccatttaccccactactgcttgctcaggtcactctccttcactgtcggtgtttgttcaaattcctcagacccatccacttcccatctaaacttccctccccttttctcgctcgttggctctacctccctcctctctgttttctcctcactctcctgccccacctcgacatccacagcgaggcaatgaagaagcccctgccaaggaggagcccgcttctcagtgggacaccgggaaggtagacacccaacagtcaccgctagtgggaggcgattgtgcagaagcacgagggttgttacaggatcgggcaggtcccctaccccagtctcggactcagggtcctgtctgaggcggccaccccgaagcgtggggtttgcggagacgtagggcctggcggagggaaggacggggaagcatctcagggaggactggcgtctgccgaatcccagggctgccctgaggggccaagaggggcgagggtggggacgatggaagacaagccacatgccgaatggggacctgaggccgcgcgcgataggatgggcggacggtgaagagaactagggtggaagggccggacaggggcgacctcagtgacggaaccggacacagacgcagatctggcagctgagcgacaggcttcggagcatttccgggcgtcgcgggactccccgccgacaggagggcggttgccgagcctgtgacatccgcggagaccagcagaccccgggtgtggaggacgccgcagggaggggactgcgtggctgggtttggccacaaaaagcggagggcactcacccgagcggaccttggctccggataatccgtttccgggtc
